United States Patent 7,892,730 (COMPOSITIONS AND METHODS FOR CANCER) - sequence listing, part 10

SEQ ID NO: 955 - DNA, 168325 bp, Mus musculus
  misc_feature (1)...(168325): n = A,T,C or G
ctgtatcaggtgtcaccatggcagggataggagagagggcagaatgtagagtatgtcccatgacgaatgcagtagttctcaatcttcctaatgctgtgaccctttaatacagttccgaatgctgtgtcaactcttaactgtagatttattttcattgctaagttgtgactgtaattttgataccattatgaatcctaatgtaaacacctgacatgtagaatatctaatattcgacccctgtgaaagggttgtttgaccccccccccccagtgggtcatgacccacagattgagaaccactgctttcgggactctttccagccaagaatttctataaagatgagactgggctcatcccacatccttgtcagtgtctaggtgtttagtaagtggttggcattctcacctttcatctttagatcttcaaatccacacttgatgcttttggttttaggcaattgcttggctaacatatacttcatagagaagtacaagatcccggaggatctcagttaggaaagtacctgctatccaagcatgaggagctgagctcatatctccaacagtcacataaaagaactctaagcacggtggcgtgcatctgtaacacctctctggaggcgagagggacagaggcaaacagacaccaatctgtctccagatcgctggagcccattgacgaggcagcctagctgatggatgatctatgagttcagtgagagaaactctttcaaaaaataaggtacagagatattgagaaggttcctgacaactcctggtttccatgtgcagaggcacttgtgtgcctctgcatcacacatgcacaaatgcacacgaagtcttttctgttgaagaagggagtagagcccgcagaccaggggttctgtgggctccatgcctgtggcttcagtggctttggtaactaatggctgcttctagtctccaagggcattgcagatgtatttcctattccatctgagaacttctgacatcactggaggaacttattcctccagtgcatatacataaccttgctgtttaaaattctatacacgaactgccataagaaagccagcgacagaggatggccagacttgcagccaggatcacgctcctatgtatgaggggctatggagggagagtgtcctctgatgtgtcctctgcatactcatgactcgtttctgactgtgatgaccttaactcctccaggtcatgatctctacatgtgtgcttcatggagctgttcttcacaaatacaggattctagtgagattctaggcccaacctgctccagaccaggcaggcctcaactctgttggtgtctgtcttagttagggtttctattgccaggatgaagcaccataactaaagtttggaggaaagggtttgtttgacttacacttccacactatcgtccatcattgaaggaatccaggacaggaattcaaacaggacaggaacctggagacaggtgctgatgcagaatcatggaggagtcctgcttagaagcttgctcagcccactttctaacacaacccaggaccactaggccagggctaccaccacccacaatgggcagggccctctccatcaatcactaattaagaaaatgccctccagctggatctaatggagacattttctattgaggttccctggtttcagatgttcctagcttgtgtcaattgacataaaactagtgaggacaatgtctacattaagaagaaggtaaatagtcacgttacacagtatccgttacgcagtatctttactctagaagagggtgcctaggcatccaggcctgcaggcaggtgtcttgcttgaacacttgggctttctgagctctgaactcaaagtgggacattggccatagtgactgaggagaggcactatcaaacatgaagtggtcagtgatttgcctgattgggtggataacaggattccagggtaagagcagctctgctccttcccctgcagggaagctgggggagtagctggtgtggagctggcaaagagggcttgctgagacctgatgctccctggaacagttttctttggcctggggatcttaccaaagcccaaccagatgaaagaacaagatgagtaggaagcttcccacatgcttgtctgaaggcatttcgtggggtggaaagtaaatgactcttttgtgacatttgagttcccaaatacagggtggaggccaagtggggaacccatctataggagaatgtacaaaaaaggcatcagacatttgagacactgagatgagagatttaggtctgtaggtttctccctacttaagtttacaccattttaattctttaaatgtgatcacagttctctctccctctctctctctccctctctttttctccctctctttctctctcttccccgcatgtgtgtctgtatgtatatactctttcatgtgtatgtgtgtttgtgtgcatatgtgcaaatatgtgtatgtgtgtgcatttgtgcatgtgtatgtgtgtgcacatgtgtggggtatttttacaagagtgtgggtgcatttgtgtgtacatgtgtgtggtgtattttcatatgagtgtgtatgtgtgtgtgcacatgcatggtgtatgttcgcatgagtgtctgggtacatgcatgtgtgtccatatgtgtgcatatgtggatgtgtgtgcatgtgagtggtgtatgttcacactgtattagggaatgtgtgactgtatgtgtacatgtgtgtacacaagtatgcatatgtacacatatgtgtatttgtatgcatgcatatgtttacacgtatacagtgtatgtccacatgagtgtgtgggcgctcatacctgtgtaagcctatgtaaggtttgcacagaacaggagtcgggtgtcctgctccatcactcaccaccttattccctccatacagagtctcttactgaacctggaccaggctgccaggcaataagccccagaaagccccttgtctccacccctcatagcactacattgtcgtgtccgctctcgaccagcaagaacgacacgaccaccagtccttctaacagcagtgtattcagcaaatttcagtcttcatctctctctcttcatctttttcctcatctatctcccccgaaccccgggcctctcactcttatatactctcagtccccatccactcacaacaggccacgtcatctcaccaggcacacagcttcagccaatcagggcggcaggggcacgtctccaccaaatatggacttgtttaaaccgccagcatcatagtgcacctgtgcagctctcatgatggtcatggcttattttcaggtgtatgaggaagtcaggtgcaagtcataagacttagcgcagtccctggcaccttcttgggactgctgccacacccgctcctcacactacactactagagttataggtgtgctcattaccacacccagatgtatatgtgggtgctgggatttaaactggggtcctcatactttgcaggaggtgctcttcctcactgagctatctccaagtagtaaacagttgaacacagtgtatcgataattcaccttaattttgaggtgtctctaaggtgaagatgctcccatgggcagatgggttctggtgacctgagaggaactcttgttgctcgggctagctgtcagtaaatgcttccaagcccaagggtcatgaaaacattctagcaggaaccaagagctggaaaatcctttccatatggccaaatgggagggattgcatcccgggccagtgccagctgaaatgctgccctagtggccacagactgttgtcaaaaacagaagacctggctctgatttccccgaaccaagatccagcccagtgctccaagagccagctgtttggggccccttggtgtaataccttagggccagagtgacctcccctgccctgcttgcagagccagccagagcctaacaaatctctctacttatctttgaccagaggaaattgctgtgaatccctgtacataattctagaatgtgccttgctttgtcttcatggtcaaagatcactgaatgtactctctgcaatgcagttaccaagtatctgtgtggagcaagttacccagactctgttcttcgtgatgatggtgtcccttagtgtaacaacacatacttagnnnnnnnnnnnnnnnnnnnncccccacccccacagttgatgctaggaaattgaatgacctcatggactctttggtagcacagtcatggaagcaggacacaaacgaaggcatcttcactatcacttaaagagcttttgtgcaatccttgagtgagacatctctcagaatagaatagagaagagagaagagagactggattttctgtttggagggttgatatctgggagaaataatctttcaactgaaacagtttgaggtgagggcatagtgagaagcagcacgggctctagggataaggaaggcggcatggtccaaggaggcaatgtgggctgctgctagggacagaaacagctcctagcaggtgagagcagtggggtggggatcttgtaggggctccaagtctctttctggggtcatggatgtcacttgggctgcctggcctgatttctacaaatatatgtcactctaccccaaacatgcctatgctctaatccacagtatgtcgttacatggaaactcaattaaggctgccagtcagcatccttgagtggttctccatgtggaaccagtaaaacctgcggctcctgaagtgaagaaggaagtcaagggggtcagaatgatcccctgggagtgagccccatgcgagccccatgtatactgctgcctgggtctgagggatgtagaaagggctatagcccagggagtgcagagaccccagaatatgcacaacagaaatagattctccagtatggggtctaggaggataatggccttatcaacacccttcctcccagctcagagagccccattttagacccagcttctggaaatctaaaattacgtgttccgttttaaactaagaactgtgtagtaatttgttacttggagtaacaaatgtgatatgacagcttgtctctattttagaaacacaaaatgctcatacacatacacacgaaacatttatggaatataactaacttgaaaatttttatcaaaattaattttgggatttttctaagccaattttgccagaggaagaactggaatgggtctctttccctccctctctccatcctgaccttctctcttcctcttcccctctctttctgtttctctttctccttctctcatggggaagtgatctctctccgctttcctttccctctttgtttcatgtcttccctccctccctagtatgtagcctagggttggcctggatcttctggcctgagcctcctgattgctggaattctgttgtgagcaactgctataatccatctttaccatcacatcactcactgcttagatcaatacctagatcttaacaaaataaggaaagcaacaacaacaaaacagatgatacagctgcgttttgggaattcatcaccagttaaagcatacggctgtgactggattgcatggagtcccttgcatttgtatttggagatgagagtcttggttagaacttggattaaattgaaataaaagtcacgatttaacctgagtcaccctaatctaaaaactaagaacccaggttctccaaagtctgacccctctgaatgttccccatctgtgcacactccaggacaaatgtcatccatctgtctgtcctgtatgatgatcagaacatagtgagcatgctaagatgatggagtctccttcagacagaggagatgggcatgggtttgtgcttagaggtgggtcccaaccccaaggtacctcaatgtgtacatacagaactcccaaaattggaaacatatggcattttgaatcgtccccagcattttgggtgggttgtccctcctgtacttcctgtcactggaacttcccagcaactacatagagttgacacattgacctgccctttgcttgcctgactgccaacactcatttctaagtgaatctatttattgtatttttcctctcccttcctcctcctcttcctccccttcttcttcttcctcttcgagtcaggctttgacctcactgacctgaaactccctgtgtagaccagacagcccttgaactcacagagatctgcctgtctctgcctcccattaacagtgtgaagcacatccctttctcattaaaacttcttgatatccaacagtctttttttgtgtgtgtgtgaaacttgttttgggaaatagcatcttctagaaacaaggctatttctagtgctgatctattcgtccattcatccactgactccagctttgctgaaatactagcatgcacctggttctgggaagtaaaagaaaagagagatgctcttccttagaggagcccacaccctaggtgggaaggcagactagagagctggtgagacaggaagcagctgctgttagatgatcttggttctgagtagagcccctgtcagcttcccagggagcatggtgcatagcaaagaggtctttgagaccaagaaagcagacatttccattgtttgtcagataccaaggacctggtttgggattctgtttaatgcggccacttcttagtcattttttccatttattttcctaaagctcaaaggcatactttttcacgaaggaccggagagtgaacgtttcatgttttaaaggcactgtcattcttatccagctccttccaccattgtagcatggggaaaaacagaacaggtaataagagaataaataaacatgattgtctcaataaaactttattgacaaaagagaacagccagctggatctgaccctggcagttacaatttgctgaatgctgttctagaacaggtaaagtatcattgtttgtcgttttccccagagtgaggctgtaggtttcagtagcttctcctgtgtgcaagtaagacctggtagttgtgtgagtttctgagagtcttctagaaccacacaaagaaatgatagcagtatagattcataacagggactcagattgacccagttttccagcatttcacatcatggttaatatttaacagacctctgaaattccagatctaatccatctttaggtcattatagcacaggaatccaacaagaaaaccacactaatccagtcccggcagagggcttgacattgagtgagtgtgtgtgttttaactataaggtttttgaaaaataagaatagagacgattggtttggagctctggggaggaagtgtggtgattatctgagcaggtgatctgagggaagcctagagcagagaggaaggcaggagcagctggtctgtgtagaagcaagactgtgaatggaggcccaggagcagactggggagaagagtgtatctggacatcttaaagcaggaaaccaggaaagtcagactttaatagcagattgtgtgggaaaagtcactacatccaaatgtttgagtaatccttcagagcaaaacagtacagtttctaaaggaggagtctttccaagagcatattctaaaatatatgatatgtagtaggacattaaagaacttcaaaatgtcccaagcaaacaactgggaagccatctgagttgcccctgctggccttatgtgcccacaagctgtctctttcttggctgataatgaaaaagtgaatgacttgggaaacttttttaaaagatgagaagcagatggtttggagtggcttgaaccattttctcaaggtcagatgaaaagtgaggctgtgctctccggggagcctgagtgggttatttgatctagcttcccatcaggctcccggctgctgccctcggggctgaaatggaggaagagatggaaggctgcagttgatagcttcctggagaagtcttagtagaagaccgcagttattctaagcaagaatcacttaaaccttgccttggttttctcatcctggatgaagactttgtcttaggtatagcatgtgatttggggacatgcaccacatgtgtcatgtggagcgtggggcttgctggcccaccaagcactgcatctgtcttgaagggatcaaactgatccacttagcacatctgtccttaccatttcaaatccgtgatgggtatctgctctcagctgtttccagccactctggcctagaggctaccttagtcttcttcctttcctattctctattccaaccagactgaccacaccatgtgtctcttgaacatccatctcccactcccatctcaagagctcggagttgggccttgttccttccttgcctgagtgtgctcatcattgattgtgcagggctttctgtgatctcccctgagcttcgctccaacatcaccttctctgagacgcctaggcatgatgtaatctacaatagaagccctcacacctaccgtggttttgtccttgtgcttttcttacacactcggtgtgtgttgatcaatcctgtcattcaaatctttcctacttagatcccattactcggaatatgtgtctttggtgacaaaggctctggtgaatcactggatctgggatactttgtacacatagaccaccaagactgttgaggattgagtcaaggagagagccagacttctgacattgtttggagcctgagtctacaaactagatcatgttacagttaaagtttttaaacagtgctgtaagttttctttaaaaagctattttctatatcgttcaaggcttgccattccatagctaagagttatcttattttgcttcttggtaaagacttcagcagttagttttcattgatttgcaacatagctcaacattacacaacactactggaagattgcagtgagcagggctgtagtgatggcctgtgctgacagccagtgttgctgtgtgcacatttccctcccttcaccacaatcacctggcaaatacttagcataaggagaaagactcatacttacccatttgtaatccagtggtttcctctcagctgtggctgtagcttccaagatgccctgcagggtgtctgacatcatggttattatcaaaccatggcttgataccatgccaaaccatatataagcagttttttccctatgcgtataatacatttcatgtatgaatctgtacagttaagtacctaataataaaatagaccagttataacaaaattttgtaatttgtttgagtattgttttctctttcactttatcttgttggacttttgtgtgctaacttagaaagcatgccgtagcttcttacttcacttcttacaggttaccagcgttgtactactgtggttgagagcacagttaggtgggataagggtttctcgaacacaagcactggagacactttgacattttaactgtagaggtggctacaaggtaagcagcatgtgggtgctctacagaatgtggtaactctgggcaagggagtgagctggattgggtgagatttcctcacgctgctaaggatggtgtagagccccagacttcataacctaagaaattggttctgaaattattcaaatagtatttgtagaataagagggactgtagagccctcagactgtctacatgccagggcactttaggaactgtcatacagtgaacagagcctttattccttacacatgtaatcgtcatccctaccagtaatccccctgtaaatacgtgggaagaaagcaggagcatgcgtctccaaaacaaacaagcgtcatgctgtgtaggaccttgtagccaatagttttgttgacgtaactgctgagttgcttttaagtcagattcatcactatataatttaggtatagtaacagtcttccctttttagtgtggcactgtgttgtaagtggatatagtatatcataatccacacatgagtatgtgtctgtctacaaattcctcatcctcctttctgtttctatgcctgtttcctcagctatagaaagaggctttgctaaccggaactagtgatgactagctgttaatatgaagacagtgccaagagcagctgctgtggtcattgttaataatgcacccaaaaacctgtttctcttgtttgccacagtctgcggtgtgggagctggacacctgctcatttccttctctgctcggtgagatcaagactgaaactgctcaaaagaggaatgattcatattcacttgacagaaagcaggtatttgatggctcctctgacctctagtggccagtgcccggctgagggctgcttctgttaccattcattgactcgggccacaggcctttaaagggcatggtgtctctgtgtcctttactcatttcttagagtctcagaggtgcaagagaaagctattgtttctggggtgctttgtcctgctctctcagattgtttcctccatttgaagagttgagttatgaattggacaattatatttgaactagatgtttggggagttttttgtttcttttttttttctttctttttttttttttaatgtggctcttttggccagctctcacactgactcgcccaggatggctttgaactccaggtcttcttgtccctgcctttgaaatctggacgcctatactctctgcttggaatatttgacacagattattctttaaatgttttttttttcttttttattgctatttccatctaaaaattatcttttgagcactgtttccctttatctttgacatttcctcataaagcagcttcacattttatgattaaagaaacccatggttaatgtgatacagaaatacaaaataggaatttgcagaagtggtactttaaattgcatgctgtatttatgtgaatcatccctttgcctgcatattcaggctgtgtgtatcgccattctgttagttagttagttagttagttagtaggcatctgggttgttataatttagtaatacttgcagtttggacacctgctggacttggtcaagaagaaattatagtatactgagtgaccatttgtcaacaaacagacctggaggaaatctaaccattttggctttgcatttagaagtccttgtcatgaggcttaagcataagcttgatcttaggggaccaggaagcatacacataagcaacgagcgagaggatccacaggatctattcatggcctacccacggagaactgggtatattgattctgtccatgaatagtcactgtcattgatgcagcctggcttcactcttgatttcagagttacctcaaggagaactaggaatttatattgtgctaagcattgtccgtaggctgtatgtaaagtctcacaaatgcacattcacttaagaatatgactaagaaagtataagagagttggagaatctgctgtaggctcttggcatcatgcacatcttactacaagggcagtcactggctcatagggacactcatccttgaagctttggagagttacctggtaagatggtaacaagggatccaacttaaatgatggagagaaaagatgaaggctatcaggactcagtctgggtccttcaccttcctttcatactgagagtatgtgggcagggtacgcacagtgagcctgggccggacctgaattgctttcatattgctgatataaaacatgaaccagaaacatcttgaggaggaaaaggtttatttcattcctcaggtttccattcatcataaaagctggtctggaagatcctggcaactgaaacagaggccatggtggtgtgatgattatctactgcttgctcctcatggcttgctcgtcttattttattatacaacccaagactacatgcccagggatagcatcagctgcatcagtcattaatcaagtaatgcctcctacatagaccagtctacaggccatctgatcagggcgattcctctatgaagtttccctctttgtagatgactctaacttgtgtagctaatcatcgcaagcccttagtgtatattttttggtatcatatctagtatacagaacagcaagcttttaaaattgctatttgcctaggtgtcatctaggtagcaaaaattaaaatctggccagtgtcatcttgtttttgtgaaaacatgtctactaaaagttaggaaagaaaaaacttgctttcacccagattgaaagtggtcccaggaattcagagaacagtcaagatgactcaaagcacatgttgctcttgcctgatagccttgcactggggagtgaccctttgcctctctcatagttttctcactatgctggctaattcagggacttgattgtctgtaacacattctcccatgcttacagatgtgttcaggtccttgcagtgaattgtgatgttctggtgagacactggagtgctgtcttcacaaagatgccttattgaaacagtatgtgtgcttaattagaattgtaattattatcctcattggtttaatcctagttttaaattacaggattggatcttagattccgatgctgtaggtgatatcattgcattttatataagcacatgcctgtcatgtagcaagaagaggttttcttcagtggttgctacttatttgttcattttgaggttaggagtagaagtcaccagatgttgttgttatgtgtttgtttgtttgcagtattgaggattgaacccaagactttgtatgtgctaggaacactctgttactaagctaccccatcaatccaccaaaggctttagaaactgtgtgtatgtgtgagtgtgtgcacgcacgcgcctgtgtgtgactatggatgcaaatatacatactaatggacatatgtaaacagcaatagctcaagctcacaaagcgaagagcatatcatgcaggaagctgcccctgaggacagaagcgtgctagagtttggcctcattgagaggattgtggttcttactttagctttctctgctttctgtgtcctctgtgtcagctgctatttgggctgtgagtaccgtgggaccaatgctgtgcctggttctctgtcagcgtccattgagacttacatgcccattgatttaggggcacatgatatcagagaggaatctggtttaccaaaacaagcaggctggtttagaggagcagaaacatgtgaaatgggggtactgtcgccggagtcaactttaatatgtactcagtgaaaaccaccaacatttacttaataatccattatttaggaaaatatccactcggctatagataatattctagtgtacaatattctaaatctcgagtcacaaaataacataatcttcctgacagataatatggacaaatgctctgtgctgtcagccaggatagtctgtgacttattctttgtctcagtgctgcatgattgtgcatacatataacacacacacacacacacagagagagagagagagagagagagagagagagagagagagagagaacatagccctcaagatggagcacagacaccacctcagtgtgccatgagcactctctccattttctaaaggcattgcattgggcctggagagttgtgacaggagcccttcctccaccttgtctccgctggctgtctctgggtagtatcttttcactttgtcattgtcctttgcttctatacttgtttctttcaccaacaatttagtttcttactagtagttttctttcaacttgttcccatgtagatttaatgctaacagaatgagaagctgaaagtagcagtctgttaagtatatgtgcaaggagctgggctaggcctagcctattagcaggcacacggtgatgtctattgtcataacagctcctaccagcagagcccctttcatagtgagttgttcttattttgttttgtttttatttggtgttatttatttatatcttgaaattgttttgacaattttattaaagaggtatttagtctttagaagcagccaaatattgattgatgagtattctgtagttctgatcacagtcaatcattgctgtggctaaggcaatcctaaaggttaaggtgaagggtcagacccctgagcctacggattcctcaacctctgcagaccaggcatgttcagagcaagcaaacccctatactgaacatacactgactctcctcattgttgtactgtaagcagtggactgtaacaatgaattccatggcacttgcttgttagtattacaggtcacctggagatgaagaacagctctgggagggctgtgggtaggttattcaaataccccattgtgctgcttaaggaactccagcgtctgtgtgtttggctatccacagggaacatggaaccaatctcccaaagatgacctggccaccactgtcctgttcattgacagatgtccctgagcaggaagcaaggcagtctagaaaagtgtccctggaaaggagcctgagaggatcttgagaactgagtctggaggaagtgcctgaggccctgtgaaactctctaagaacctgtttcccatgctctggatatcctgggaggagactgagaaatacccagcatttagaagccaggtcccatgacagggaacattcctcagtctctagaacaggacccactagatgcctgaccaccagaccctgcttttgaaggtagctgccactggggtaatttagaagtacatgaaccaataccctggaagcatctgtatgctatgggcaactgcttctgtcaacccaatgagtctttagaaagaagccctgacctaaagctaggcctcctacccttcccagacaggcacacctagtatagaaagtgggggataccttgagaaagaagggagtagccccagagaggcagacaggtgcttccgtgtggccttgactttcaactctgtctcttctcattttttaaaaaaattacatgagtacctacatgcatgcctgtatgtatctcattgagtgtgtgatgctcacagaatccatgggtgtcatatctcctggaactggggttgtggggcacttgtgaggcacctgactgtgctgggaatggaccccagatcttctacatggaaagcaagtgttcctagtctctgagctggctcccagctctgctcctccctttttcatatcaaccacatgaggaattctcttctcagtggtccatttttgccttgctttctttttatagctcttcccctcctgcccccattctttatatcagtttgactagatttttcagtttcaacctgtcactaaacttgactttgctcttttctttctcccacattgtcctgactgcagtgagcagacccctccccccaccacatgcacctatgaaggtgctataggtgctgaggaagtttctctgtttagttaccacatttgccttgaagcaaactgcatttttataacaacccagtggcgtgtcagttttcagaatccttcctggtacctaggctgctgattgcccttgaagaatttcttctacctcaacctacacttctacatcacaatgtgtcttgtgcacagcaaatttagagacccctattctcagggctctggaggaaggtgtcatctgggcagagatgagaattgccttctccagcctgtggcttgcttccctctccctttcttttcatgtgaatgtctcccttgtcttccccaagtttgacactccactctgtcagaagcagccacatccctctatagtttaaggcactgaggagtagtcccagggggaaaggtggtctctaattggtctagcccactttataaggcctccaaagcagtttattaataaacagacttgtggagaaagcgagaacatgattacacacacacacacacagaatggtctattctatttttataagcaccacggcagtttttgtggcttcaggtattggctgtctaaatttcaccacgtggccgtgataatcattttgccttgtggaaacttcacaaggcctgattaccagcccccttctactcaagctcaagctctgcctctggttctggaagtgagccccattctctgggtaccagtcagagcaagcacacttgtaccatgagttggaaactccatgatgctggggcgtcttcagcctgttcactgctgggcacttagtgctcaagtgagctccttcctaacaatttcaaaagctgatacaggaagtgatgaagagacttgccatgaaataaatagaaatagcttggcacctacaggaaaacattacccccagaattcactgtgggcctatgaccttggttttgctctgcatcttgggataataggagccttgctgtgtcagcacctctgagccatcagaataccacgtggccactcacccatttcaaatgtgagcgttgattctcctggtctccctatctgtcattacactcaacatctcattacacaagatgggtggaggggtgtgtgttgatgatcattctactctagaaccttctagtgcagatgcgctgttcccatactcaccaatcttcgaagaaagtaagtgttcaagactgttccaccctggattcagtgttcagagaagtgtgctaaatcacctgtgtggacgccttaggtggcctgctcctgcctctgcgcatccaacactcattcctctgagggacccagaattgtcagggactcttagatgtgacatctaacttccagaggaggccatctgcccttttgcttccaggtctccatgtgtttaaaagaaagtctgtgaagtgaggtagtttttgctcctgggtctgagctctgtaattgtagccaaggattgggtgttggggagtgtgttatatcatttgctgttttcgttcttagacctcagtgtaagagcttgctctctccccaccccccaagagagctcaggtagataacttggaagaccagaaagctgaagcagtgaggatgaaggtgtctgcatcgaagccatgatttaactgtcaaggtgagtctttgtggtggacacacacattttggaaagagcacagacagggctgtgttttctgtgagcagatgaaagcacacagtgaagggtggccctgagaagtataatctactcctggggtgagcatgtctctaacttacatggacatggggttctcagcagtcctgtatcctgctgttgccattggggctgccaggaaagggaaatcaaaggtcttaggagtaggtctttctgagcagaactgtggtcctcaaaaagctttgactgcctgtaacttaaactttttaggttttaacataaactcattgtatagactggctccaaactcatgatcctcctgcctcactcagtgctgggattatgggtatattccatcaagctcatctttctttagactttttataaaggaacagagccagtgcagaaagaaaggtagaggtatacttctggggctgttattggcctacctcagggtggtgtttcttcaagtatttccttgagcacagcttccaggctgctcatgcagtgggcatagcagatgtagccaggtgactaggggacactgtattgaataactggtctttctcagaactaatggaccctgcaaatctctatggctgtgtgtagtcagcagttttgccatgatcctgtgcaaactgtggcttgtgaccagcatcccacatgtgaattagatatcttctgaacatcagccacaagtgatgagaaacactaaggatatagttataagctggattggcatgcttatatgcagaatgtaaatactataagcaaacaaaaggaattactaagccacgaaagcttaagagaatgacccctagacctaggtgtcctagcttaaatactgagtcagatgtagtctgtcttccttgttccacgcctacagagcactggtaatcatatctgcttcgtaagaactgttgtgacaagtacagaaattatgagcactggcaggacaaaactgtatccagataccaatttgttcatacaatgaaaagagatggatactttgacccaggttaaaggttgatgtgatgactaactgaggagagatgtaatgccatacagtagaggcttcacatatggaagaaggaacaagctaagtaggtaggcagagggtaagaaggtggtgtggcagacacagggactgagtcctgtgttttactgtgtttagtgacactcagaaattcagtgttggcactggacttcttcacctgaaaaggacattgatgcaaagcctgtggctgtttcagtttggacgggcagaaagctttcccctaatggcagagatgagaggaggatgtccatccttatcactgcccttgagtatttgggctggttaatttcaatatatagacttgactagatggaaggatcctacatatctgataaagcagtgtgtgtgtgtgtgtgtgtgtgtgtgtgtgtgtgtatgtgtgtgtgtgtgtgtgtgtgtgtgcagatgtccacacattctttgttacagcgtcagagttttctgtttgttttctcactgtgtatccctagctggcctggaactcgctttgtagcttagttaccaaactgtagtcagatttttaaggctatcgagtgccattagctaaaagttcttccttttcttctttttcttgtctggaatatggacaatctactactaatggtaaaaaatttaaaacttgttttctctgattgagttggcattgaacaagagaatgctctctttttactagcctcagttaagacctcctggcataagaggttgtgtgtgtgtgtgtgtgtgtgtgtgttgttgtttatttttgacccatgatctgggagttgctttgctgtattttcttgtacatgttggaaatatatatatattggtagttttaaaacgtggctattcgagcatagacatcttaatttattctagaacacaggttctcagggttttaaaatgtgttattgtgagaaaatgaggattgacaagatggctcagtaggtgaaggagcctaccatccagcctactgacctacgtggtggaaggagagaactgacttccacctttagatctcacatgcacatcatggcacacagatacccatacagatatgcgtgcacctacacaaataaagtttcacaatataattgattctgtgtgctactctatgaaccattatactgttgtcttcgcagaagctctgactttaaatcttgggtgtgctctgttgttgttttgctttttacatttttgtttcagttcctttaggactttaacacctatcaacttacactcatgggatcgaggaatggttatctgggaggaatttgttgaccttcaatcgataatttggggctgtgcgctaaggaatactttgaattgcttgatctctaaaaagtaagagaaagtgctgcagagaggaagggttggaagtctcttctgggggactaagccttggacccaggctgcagcaggcctcagcatggccagggccagcccaggtcagtgtcttatagtctgttttttttccggagctgctgtgggtagcaggtgctgctgacacgcagctgccttgatgaaggagttctgctccatctgctccgggtggatctatgcaaattgctttgtttctcagaaacatcttatttgtcttgggtagtagccaggcctctaatgtgggtggtgtgttctgtgtcgtaaacattggaccccagagcctgagcctgtcttgccttgctcagatgcttgcgtgaagccagtctgaagcccgtgggaggcttccacgtgcagaggaagaatgtgctcacacctgtgtggacagatggctgaggtgaggtgagctggtaccatgagaagacagtggaagaggccaggtgagggaactgggcttgtccccaggcagggccatgagctgtgtttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctccctccttccctccctccctccttccttccctccctccattttctcttcctccctcctttctattccttctttctctccttccataccctccccttcctccatttttctcttcctcctttctattcctccttttctctctccccctcccaaccctcttcactccctttcttatctctgtccttccccccatttttccttccttttgctgtcatctgccacaaacaccaaaggtatccaactttctaacaggtaaaataaaccagaatataatccttctaaaggaatccctctcctttaaaatcttttattaaatcaatttatctctaggcctaaaatataataatggaacaggaagaaggcaccatggatggctgtaaggctggtttgcaactctgcaaggctctcctgcatatgcagcctctctttgtccatctcccatatacacacactgggaacacttacacaccctgcctacaactgcatataaaacgggctgcacaggctttgaagggcaagcaggatgtgcactgcagtacagtaagaggttgactctaaattggaatgggtcttagtgtttctcatttctatttctttggattgtttcgctaattctcatcgctgggcttaagacttttcaaacattctttggccctgggagggagttgtataaccataaaacttgagaatcctggccctggaataaatattcctttaaaacaccaaggacagaaaattgaacacagctgtgcaaaaaaaaaaaaaaaaaaaaaaaaaaaaaaaaaaaaaaaaaaaatgcagggcggtggttccaggctgtagccatcctgaccaactttttcagggctcttgggcagtggctccttcaaaatgggaggtagggtgctgcttcaggaaaaagcctgcacttcctcaaagctgtgctgttgctggcggggtgcaaagtactctccagttcttgattgtgctctgcacaggctgtgatcctccctgcaaaggattgggggattggggtcattttgctagacatgagtccacaggatttgcagtccctagtaattgccagcctcacccccagcccaagtgtgaaaaccaggatgttggttgtgctgtgtgcctgttgggtccctctctctggcccgtggctctcagggaagtgttccccatgggtcctaaccttgaggtggcctgtggctctcagggagtgctccccatgggtcctaaccttgaggtggcctggcattagtcacttctctctatgtcagaccatgtaactacgatttgtacttcttcctttacaagattagattactataattttcatatcctggatgtcccactagggatttcaattattactccctagtacaggaaacagtctcgtgtttctggggagaaaagactaagctttctggttggtcatggtctgaatacattaggcagccccttcccccatctcccaccacgccccccctccccccgccagaaaatcaatcctgccttcaggactcactgcatcagatagctgtccacgaaggtgcctctgtgtatggtccccataaggtgtatttgcttaagctttgccaagcctgtaggataaaaatgtttggtgaaagccagggagcttcgtgctgacatcagactgttgaatgagagaattctcccccaaccaggtgctttggaaggaggcacgtgatctagacctgtgggatcatctgcccagagccagcttgggtttgaaagggcgccctgaggggcagagctgccttgaaatactcgtaggttttctatgtgacatgtatttatatatggttctctctctctcgctctctctctctctgtctctctcgctctgtgtgtgtgtattctctctctctgtatattctctctattctctctctctctctccctcccaccctctctcgctctgtgtgtgtgtattctctctctctctctctgtatattctctctattctctctccctcccatatatggttctctctctctctcgctctctctctctgtctctctcgctctgtgtgtgtgtgtattctctctctctgtatattctctctattctctccctctctttcaccctccctctctcctctctctctctctgtgtattctctctctgctctctctctctgtgtatattctctctgttctctctctgtatattctctctgttctctctctctctctctctctctctgtgtgtgtgtgtgtgtgtgtgtgtaagtgtgtgtgtgtatgtcttcctcagtcactctctactttagtttttgaaataagaacgctcactgaaactggagcttaccaattatgctagactgactggccaatgagcccagtggtccttctatctctgcctctctagttgtgggtttataagctgtgcctggctttatgtgggaaatgggaaatcaaacacaagtcctcaggcagtttatcaactatggcatctccccagccctaggacttatactattatagtctttaagcaatcatttattgtgcctatctgctaggcactgttctaagtcctgaagacaagcaacaggccataaagtggacagatatgtttgccctcacctatgttatgcttcatgagcctgtgccttggtggggccatgagcatgtatggatgagaggggcattctagggaggagctcagaaggaactatggtcatgcaaatgcatttattctttcctcccacacaatgggcctttctcttctaccacaatatggaccctgtgtgattatcaactaatcctctgttctttgtgtatagtcaagaataattcacctggtctcaggaggactcagctgataatgccagacctttgaagggatggtctgctataccaggttcttgggagagggggtttgaagtgtgtcttgttcttgtcttttctttcccctgtgtattgagtctcctttcttaccactttactcatggattccatctctctttcttgctcacctcatgtccatcacaccacccttggaagctgttgtagttctgctttggggaatttgagatagtactttgagaatgagtcttggctcttgtagaactaaatgcagcctcagacagagacttcatccagaccagtgatgttcagtgcctggacacaaatccaatcttccctaacagccaggaaatgagaactctaagaaactgaaatgtgtgtttagagaaactaaattttctcagctgccttctatgtcttcccattgcttattgttcctcaacttgtactgatggagacctatgttcccaatgccaagttgaagccacagaaacatgtgaggtgtgacagtatagtaccatagaatgagtgtgtagtggagggtccagtgcaatagaatgagtgtgcagtggagggtccagtgcaatagaatgagtgtgcagtggagggtccagtgcaatagaataagtgtgcagtggagggtccagtgcaatagaataagtgtgtagtggaggatccagtgcaatagaataagtgtgcagtggagggtccagtgcaatagaataagtgtgcagtggagggtccagtgcaatagaatgagtgtgcagtggagggtccagtgcaatagaatgagtgtgcagtggagggtccagtgcaatagaatgagtgtgcagtggagggtccagtgcaatagaatgagtgtgcagtggagggtccagtgcaatagaatgagtgtgcagtggagggtccagtgcaatagaataagtgtgcagtggagggtccagtgcaatagaatgagtgtgcagtggagggtccagtgcaatagaataagtgtgcagtggagggtccagtgcaatagaataagtgtgtagtggaggatccagtgcaatagaatgagtgtgcagtggagggtccagtgcaatagaataagtgtgtagtggaggatccagtgcaatagaataagtgtgtagtggagggtccagtgcaatagaataagtgtgtagtggaggatccagtgcaatagaatgagtgtgcagtggagggtccagtgcaatagaatgagtgtgcagtggagggtccagtgcaatagaatgagtgtgcagtggagggtccagtggtgtagtagactgtaccacagtgagtacagcttcctagaatggctttacagtagagagtccatctctgcagatttaatgaactgaggaagatccagaactaggattactgtactatggagtatccagtgatatagataaaaactgttctatagtgtccagtgctgtaggattactgcgaaatagagggttcagcactttagattgtactatcatagaaaattgagcactgctgaattactgtattacagaatgtccactactgtaaaatgattgtactgtggaatgtccaggattgtaagatgactgtttaatggagggtgtagcattatagaatgattacgtcttcagtggtccaaggatgtagaatgactgtatcgtggagtatctagcaatttagaatggatgtatcattaaggattcactcagaaaaatgaacgtactgtgcaggatcccactttgtaaaatgattgtagagttgtgaattcaggattgtagaatgactatgttgttgagagtccagatttatagaatgatgatactgtagagggtccaaatatctataacagtattgctgcagattctgctctgcaaaatggctgcacaatggagggtccaatcctgtagaatgactatacagtggagagtccagcactgttaaccatgcagatcccaaatgatagaataatagtactttgcaagatccagtgttctagtgttactctactgcacagtgcccagtgttatagatgactataccatggaaggtgcagttctttaactgggctgtggaaagtccgtctctgtagaatgatggcattgaggaaggcctccttctataaaatgactgtactgtcaaaaatccagcagtgaagaatggctgttctgtgtatggtccagtactgtgaagggtcctctgctgcaagatcactgtactctatactctagaatggctatattatgaagggcccattgctataggataagtgtgatgtgcaatgtccagtgccttagaataactgcaccttggagtgcccacctctgtattgtcaatggtccagctgtagaatgattgtaccatgtagcattagcactgtagaactgttgtgctgtatgtgtatatagaatgtttgtaatgtggagtgtcgatcactttatgatggctgtactttagcgtatccagtgctgttgaatgactaaactgtagaggatccagaggtgtaggtttactgactgtggatggtactatgatatagagttactataccattgtatgtaaagtgttgcacaatgacttttgcgtgcagggttccttgttatagaattattataccattgaatgtccagtgttactgagtgactctagcatgtatgatccagtgttatgagtgttcagtgttgttgggtgactaccatgcaagttcgagtgttatagaatgaatgtactgagcaaggtgcagtgctgtagaacaaaagtaatgtagattgtacagtactatgaatgactgtactatagagagtccagcaatgtggaatgactgtgccagtggtccagctgtagaatgactttattgtgtactacagagtgtcaattgctgtggaattattataccattgagggtctagctctatggacttaaccatactcttggttgtcctcattgtaggtttattggacttctgaattgccatgatgcacccatcacatgttctgaacaggggaaggctaggatcctctcaggttgcagaatgtgtgctaccagcggggtggggcacatatctgagagcatgcacctcagtccccctgcatccagtatacataaggcttctggtattctgggggtcttagttagggttttactgctctgaacagacaccatgaccaaggcaactcttgtaaggacaatatttaactggggctgacttacaggttcaaaggttcagtccattatcaagacaggagcatggcattgtccagacaggcatggttgcaggcagagctgagagttctacatcttcatctgaagcctgctagcagaatgctggcttccaggcaactaggatgagaatcgtcaagcccaagccgacagtgacacacctactccaacaaggccacacctcctccaacagggtcacaacctctagtagtgccactccctgggctgagcatatacaaaccatcacactgggcaatagcacaagtgcttctcttttctggcagtccttcggaggaacataggtttgttttgcttttcactcagtgactggtcattttctgctgatgtgtaggccaagcaagggaaatcatggtggcactgtgcctggtgatgttggtagctatgtagaaaggagaagtcctaacaaatctttgctagtgtaggaaatcctcactcatttggatctgtctgtcagctttgcctcacttgagaagaggctttgaggttctgccataccatgtccactgcttcagagagacagaaagtccctatttttagatgtctaacagcctaattggagcatgtcacactttgtacatccctggttacttgtaggactcttactctggtgtccaggaatgcgaggttggtccaggctatgtccctggagtctgggccaggctcacccctggcaatctcctgtttcattttggttgtgaggccagcactgtctgggtcgagccttgtggcacaaccattgctctgtagtggccacttgggagaatcagctgaattgtttgtccagcccactgacttacaaatgaccctggagttcaaaaggtcttcatctgtagccacttaagtttgtcagacgctttcagagagagagcacagacggatagactctgcagactgcctaaatgaccgacaaagcaagggcttaattggaaaccattattactgaagacatttgtcttgtaaatacagatgaatggctatggtatagacggccacagagttagatccacactgatgcatggatgtagatgctaggagaccatgcatattcctgttagaaccctaagctctttgaaaaaaattaatgaatccaagttttatcttgacacagcaggaatcaggatagtacacaggtcctggccatgtagcctttcatctcctagaaatgagcatccctaaaaagatttccagtaactgctcaagtttattgctgttggaaagcaggacttttagagtactgtgaaggcagaagccttagagaattgtgcccttgttttccctttcctggtcaggctctgatatcactgttattttagacaagaaagaacataatgagaccaaggctgctgctcagaaccacttgggcagccctacctagttggatttctggattatgcattggttggtgatcctgagaagaagtagaaaatcttgtagctgcattaagacatcaaggggcttggaaatgtgctatccctagaactcagataaagaggctggatcaagtagcatgcagctaaagtgctttagctaaagctaaaggaaagagaaatcaagagcatccctgactgagttcactggccagtcagctaagtctatcagcagtcctaaaccccaatttaaaagccaagctagataacagacaccacataaaggatgacacccaaggttgacttacgcccaccctacacatgtgcatacgcaaatatacccatccacacacatagtaaacaaaagaaagcaaagaaaaggagcagggaggggcagaggaagagagggcaggagaaagggggggaggggaggatggatgaatgaatgaatcaatgatcaatcaatcaatgagtctacccacaagtgcttttgatactggtgttagagtctcatatggcaagcatttattatgtgtatggagtggctactgactccatttttgcagatacaaaaagatcatgggtcccctgctctttaaagtggaatttttaagggtggtgaagacttttctgggtgaggatgagggaaaggcattaactggagacaggagcgccttactacagcaatgtggcctgtgtggctgctgacggttgtgtgcacgtgacttgatggggtggtagtgatgtgacgtgctactaaagagggtgagtacccagtagatgtgtttgctcacctttgttttctgccaataggactgtgtgctgggtaatacctgagaagttcctcctagtgctctaaggacaaacaagttctctgtaatgagatcaaccctaggctaagtgtaatttctcaagtattaataagactatgattagacctcttctttagacaatttaattttaaagcttggcaggcaaggtgaagaatagctgttacccacccacccacccagtagctgcagttcctcacaggtccactctgaaaaccaaagctaggagggaagccatggcatgcagggcagctctggaaagccagtctggaagcagcaggcggaagagaagagcttaagaggcacctgtaacagtcctgaaatacaagaagccctcggccacacagcaagattctgcatttggggtcgacctgcctcctggtttgggtgaccaagacgcagggttgaagggtggtcacttgggaaaatagaattaatttccacaatcagcagatgcatgtgacactatttgtcttgagttttctgttcctgggtgacatcctgggaggctagagagatggctcagtggctaaagggcttgttgcacaagcgtgagaacacaagcttggtccccagcacccatatagaaaacaagccacattcacctgtaactaatgcaatattaattatctggtggttgctctgcccctgacacctcttaatatctatctgtaggggttctctgacccacattttttggtataactcccaattaaagacacaaaaacactgtaaatttacacacaaactgtaagcctaaaccgggaaggttctgagctattctaacctatatccaaaccacaggccctgtgttacttgcagtttgaattactcacccggcttgttctgttccacgtgtgtcctcaggaatgagcttctcttggccgcatgctcatcatccacaggcctcttggcaacccctctcctccattgtctcccctccttctcgtggtctctcaagacccatcactagattccaagtcccaccttcttctcctctgcccagtcaaaagccccagccattccttgaccaatcatggatcaccggggagtattctttacagtacaaaggttagtgaagtgccccaagatcaggttgcagtctggatcagggcacagaactcagcttctgaatacacagtgcacagaactaaccccaacccaggattggaggtggagacaagaagattactggagtttgttggctgccagcctagacaaaaaaaaaaaaaaaaaaaccaaacaaacaaaacagtaagctttaggttcaatgagagaccctacctcaagggagtaaagtagacaatggtaggggagggcacctgaaatccttctctgatgtctgtctgaactcatatgcacacacatatatatgcacacagctatgtacatttacatagagtaaacaaaataaaaaagaattaatacaaagatgtcatgtctcttcagccagtatcttccagtgggaatgtcatatacagatattatgtctgctcagacagtgtcccccagtgggaatgccatataaagaaatgttatcacccagtgtcccagtgggaacaccttgcaaattatggaacagggttgcagccaggacactgccattggcaaagtcagtagatgaatggaaagtcgtataagaaagatcctcctagttctctctgtagcctgcttaccacatccttaacctttagtcctcactgcctgcttactgcatccttaatttatgttcctcactgcctgctctctgtttacacaacattgtcactgtggaaagtcatgcaaatgagattatacattaacagtctgaaatcggctttcttttgctcagcttggtttctagaatatctttccaggtcaatacatgtgccaataattgattattttattctatttagtagtgttcgatggtctggatataccacaatgaagatgttatttctttatttgtgtttgttgctgtccagctgctctagggtgggcatatttgctgtgggcttattactgagttccttattttgcaccaatgtctcgtttgcctttctgctgctgtattaaacatcatggctgaaggtaacttggggaagaaatgtttatttggcatacactttcaggtcacaatttaacactgggagaagttacttcaactactggcctgctctctctggctcctgctcagcctgcgttcttacatacaggtagtccagggtagcactggcctctgaggactgggacctttcacatcatcaatgatcagttccccaccaatgtggtcacagccagttccatatgaattgagacttcctcttcccaagtaactcttacttgaactgagccgatcatagaactgaccatagaactgtcgaagacaaacatgggtctgtgtatatggaggcctgtcttttcatcggtattttgagatcttgatggccatagctatgtggttgtccttaacgtggaaaaagccaactcttccatatttttccttttcatggatttttagcaaattttagaataagctcaaaattcctttgtgtttttgataagaattatataatgcttaccgataagtttggtattgatatctttattatgctgatttcctcaatccatgaacatagtccatgtctactgatatattgaaatcatcttggattttttttcaatgttttgtggttttattactggtttatatctcaatattttacctttttggaatgatggcaagttgtattttatttattcaatgttcattcttgatataaagtcagtatcataaaatgcattctccttagcaacgctgacccgtttatctacttatttttgaccagtttctttgtgtagccctggctgtcttggaactcactctgtagaccaggctggtcttgaactcagagaaccacctgcctctgcctcctgagtgctgggatcaaaggtgtgtgccaccaagcctagcttgatgtattcagtaataatcattattgttaaaggggtagtgatcaagaacagtgcattgagaaatggttacttatcaaagatgctgcaaatacctgaggatagcaaaactcaattcttagcagtaatttaactcacttgagttttacattttcttacaacattttgtgggattctgggtctggtaagcattttccgagttagcccaaaacttgaggcccttgtttaaatggattgtataattagaattcattgagatctagataatgaaagtcagaaaggataaagaggagaccaggggctcagcctgcctcactccagatccatcaactagagattgtggggctccaagcagcagccccagctcatggaggctgggtgtctatccagacacactggatcttcttgtaggaaaacaaagctgggtggcagcagagacccaacgttctttcccattttcctcgtagttgacatattcttttttgaaatttttatttattttgactctggctgcaggacaagcttaaaactgctcacataaatatgtatagcaaagtgagcacatttgtgttcacctctaaccccagcactgaggagcctgaggcaggaagtttgttgggtttaagccagcttaccttgcatagtgagttctaagctagccttggctacctagcaagagttgtctaaaaaacacagcaaacaagcaaagtccaaaatcttcagagctgggagatagctcagtggagaagagcacttgccatgcaagccagaggaccccagagtccttagagcttaatgtgataatgtgacttttgtgggtcctctagcctcaatgttgagggggtggagacaggcagatccagggagttcactggagaggcaaccagtctgaactagagtaagcttcaggttagggagagaacccacctgcatcatggcagaaggtccagagccataaaggcacccgatgtcttccactgactcaaatgtatgcaaatggacatacatgcctgtgtatacacagacacatactacaaacacatcagaggcacttaaacaggataaaataaacctaaagatgagggaaacactaaacgtgtgagaaagaacataagatgtggattgcaactcaaattggatgtcaaattataatgaaaacttttgtgtaattgtcatctggaagtggattaaaaattggcttgacaaactcttttaacccttaaataaaacagactgaagccagtgtccaattgctacacccctccagggtatctgctgtctgatctttaaatcatcacataaaaaccacacatatttgtaaggctttgatccatggatagagttgtgatatttagctttttcatcaccacagtctcctttcctcatggctgtagcattcttttggtattttgaccacacagcagagcaccctcatcttttcacctgagcaagggttgtttcttagggatccataatctcctgcagggttaattagtaacagggattctgacccttgttgtcagccctcagcactcctccttgctgctgcagctggtggtctgggaacttgatagcagaggcagaccagccggaggaggcctacagagcacacagctttgttctcagcctgagacttaaggagctttgagatttacatggaagctatctcaaacaattaagactcacccttatccttgtaaacggcagggatgattgccctggtaagtacttttgtaaacagagttgcagtatttagttttggtgtttaaaaagtgcaagtggctatttaagaagtggttgcaattggtttttttcctcctctgtttttagtggttaaggactgtctggtgttgtgtcttgttgactgggaggataaacctgggttgtaagcaaaatgttcacagagctttacaaaatacttctgaaagtgccgttttctactgatggggaatactagtcagtgtagagagggctacactggtacagtttgtaaaggccggtgctaccgtgtgtgctgtgtcactgtgtacccatctgtccatgtgtcctctctttgtggtgtttaggatccgggttttatcatagcattttgttcattctgttagtttaagcccttgggtaagaggcgtgtttgctcatcttactctgtactgtcacctgctcagcaacctgctgtaccttttaaatttctctataacacaagctagagacaatgcagccaattgagttgctctcagagtggctgctggccaggcctgttgcaacagctgatggctctcagtgtcaggagctatttctgccccattagctgctatcaggccataaaaggctggtcccatgtggagttgccacattgcctccgattgtgtcctccacggcagtgtcctcaggtttcatgtggatttacccagtaatggatgactctgccaagaccagactgggcaagcgcagcctcgaagacaccaggggcctgggaacttcaaaaagaagactctttttattaatattttggtgttcttccttcagagaaactcttgggatatagccctcacctatttccggaatctggcatctcagcaccctctggaaagcaccgatctaaatataccctgctgtgaatcacccccctgataaaggcctttgccttgtttgttgaccactgatcttgtgcagtgctgctgatcttacttgggaaatgttgttttttgtttagtctttaaaggtagtattcatcaaagagactgtactcaagaatacccaaggctgaattagaggacatagatggtttttgtttttgttttttcttattacaacaataaggggagtgtactatgttcctggcccctctcacttagaggaacaaggattacacagaaatttgaagtaagtgaaaaatctttctatgtatctaaacgcagctgtgtatctggaagaagctctctgtgagcatgattccgggggagttgttgtttcaaagcttcacagttttctgccagtacatgctagttactgcaattaccctttggctatcctggggtgtagtttaggggtttggaaagattggattttcttacaaacaaaacaacctactttataacacagagaagtttattactgacagttcgcttaatataacttagtaagtcctatctacaatttagcatttgaatttggaattaaagaatttttccaatacgggctgtcactttatttcacatctgcctgtctgtcgtctatctccctctatctatctatctatctatctatctatctatctatctattatctatcatctgtctatctatctatctacctacctacctacctatcatctatttatcatctgcctatttgtcatttgtctatcagtctatctatctgtctgtctgtctgtctatctgtctacctgttaatctgttatctatctactttgtcattcaatgtggtgctgaatatcaaaccccagagcctccagcatgctcagcatttgtttttccacagggctataccctggtcctaactcacgttattaattcatgtgaaactgcaaaggcctgagtcttgtgtgtgccttctctttgctttcaggccagtgctgctcagattctgatatccagaacagctttggtccagaatcttaaaaactctcagatgaggctctaagtttgtcactgtagttcatttttaaaatttccaataaggggtgttaccgtgtctttttaattcctggggagagagctctggagtctgctctgtagtttgatgatttggggctggaaagcagtggtgaggtgtagaacatagcaggtggatttgacatgtgccactgatagaataaaaaaggtgatctatgacatgaagaagtatgcacagccactattatttatagaatacttctagtgagaaacacccctggggagccctctatgctgctccactggaagctgtgccattggtgaaatagatttgtacatacatacctgctgctgctgtgcaagggactcagctggaaagggtcagtgctcaatctgcatgttgtatgtagatgcatagagggtttctatggccagtagtatccctggctgagaagaactgtagtatgaattgtgaacacacacaccgcaatcatggcaagggtcagggtggggctgcccctatcaatgagccagaagagccctcagacaagcctagcaattgactgtcctcctagaaatagggcctcatgtcaccctctgaaagtgagtagctgtgacatagatgctaaggagaggtggtttgtgactgacattgttccttctgtaggacaagatgatgcctgttagctaacccccagagagaggcttttaatggatcagttgaactatcaatagttttaatagatcagttgagcataatctttgcagtttggtaaagttttgaccctctgtggacattcccctttcatccaaaagacacttgtttatctttgcctgaacttctgagacatctggaagactgagttactagtccctcatgcatacctttgagaatacctggggacattaaatgttctacagcagaagacttgcaggcacgggcaaagcctttggattttgcaaggataccctgggagctgcagcaggcaatgacataggccatgagcagttatccagtggaaaccacctccattgttggaacctggcttgatgaacaggaagtcatgtcctcatgggtctgactgtctagaccctttaggatgatccttgtgttacagggtagggagtgtcttgccaggatgacaaatatctccccatctagaatgtttgcttgttccccaggcctctgtgtctgtctgtgatgtgaccagccaccctgtggcaagtcttgcctcggacctgtgctttgctggtagtggactcccttttctttcagctcttcctgcatgtatccagtctaatgtcagatgttctttgtaaacaaactcttaccatgctatttctcaaagtggatttgtcatattcctctctgccctgtgctactatccagacccctcagcctctctctcaggatcctcctaccaccaggcctttgctgacgtcctctccaaaatgctctgtgtgcctgcctgagagatatcacatgacatgagccagagtgtcctcttactatctgtctctggctctaaagaccttgacactagcttctactgtaggattcctggtgctctacaaatcctggtgtcccccctctacaagggaggtagggtagccaacaggcattgggtctcagtacccttgatcttatcttacccagtggccattccacaaatgtaagttgtttggattggattgagttgtggctttatcaagtcataatttagctatgttctgtcagaagcttggggtatttctcctggaatatccactgtggagcccagtgctcactgttatatggatgtcttttcctcagttctaaatatgcatgcagaaagatgtcttcctgttacaagtctgacgagatttctggatgcaggcttttgccaacacaggaaattgaggtacacttggcaaagacagactctttaatgttggagtcttgcctgagtccttgacttgggtacttttccctattaggcattgtctcaagtagcatgtcctgggaggggacttgcactattgacctcctcggggacagtagcactttggtgtggttcagaaaggtcttagcctcaaagagatatttgccatggatggttctgaagaaagcatgtgtttcactcagaaagtcaacccactaaccccaaacacagttctaacccagacagagctgggtgtttctgtaaatgtgatgtaggcccagttctcctctctgccttaggatcagtgattttcccttccctggtgaaggcttgctcatttctccagcttcctgggcatctcactcggacagaacactggactcaatagtgtgaggtccagaaggctatagagtgtgcctgtccttggtgactacatcccctaaagagatttggagaacatagtgaagccctggtgcctgtcaacggcaagtaccacacagtgaaataaacctaccctggcatgtgccttccagggctgcagtgcaaatactgcatgggggcctttccccccaacccagagctcctgaggcatgttaccctcagtgtgcccattctaccagggaaccacctgagccttgaaatgggggagggggccggatttgaatgcagacctatgtaatgacacctcacatctcataactcctgaataccagtgtggcttcaattgtaatagtagttgccagctgtcttagtccatattctgggtaatttataaagaacctatttcttacagttcatgtccaaggctgtttaaggtaaggaaggagtgacattgttgggacctctggcaaggcccaaggagcctcatgtggtgaaagagctcatgtgccatagaacatgttctcctgtgacagagccactcttggctaccctattatcacatccacacagaggcttatgtggccgattgcctcccaggggtcctgcctacagttacccttaccatgtgctttggagatgcaggctctggcatatgaagcttgagggatagagtgaatgtgtgcaagaactactaccatcaaagaaagaaggggagagaggaaggtgaaggtggggagagaggaagggggaagatggggagaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaggtggggagaggggaagggggaacatggggttgtggaggagggagaagacttacagactgctttctcctcggggacccattcctgtgttcaaaatgaagcttcctggtgagctgcatggtagaaggcttcccggaggcccacttcctatttcaaccagtccctcccatctctaatgctgtccttccgcctgtaccttcatgtgtacctcccatctctctaactttgaacttctgtctccttcctggctctgtctctttgtgtggaatacatactcaagtttcatccttctaaataaagctcccctgacctccagcctgctctcctgccaatgactttcagtcctcactcaaaccctcctgttcctcctgcccagccttgtgagcacctctgaggctgaccactctgtagggagcccaccgcaggcctgggccagtgaagtgaataactttctctgtattctttgcacttgcacacacacacacacacacacacacacgcacacacacacacatttatacacacacatacccacacatacacataaacatgcacacaaagacccacagacatacacacaaatatgcacacacagacacacacacacacacacacacacacatacactgcccccttctgttccccagtctctcatattaacatttctattttcagggcttttaaaatgtattttaattatcttctgtttctccatttgcttgcctgcccacctaggacatgatgcacacacaggttgtcatgtggtgcagtctggggcctgtccctgttgggtgggaggtgttcatgtatgagtctcagcttttcactttgtgagtaaactctgtgttctagttagttgtctgaacatttgtagtctgtatatgtagcattggtagaattatgcataaaacacaaaatcagattctgaatggccatcagcagcttttatacacactgcactgtgtgtgtgtgtgtgtgtgtgtgtgtgtgtgtgtgtgtgtgtattggcatatgcacaagtttgtgtttgtgtatgcaggtgcacataaatgcatacgtgagtaactctaccatagttcaatgtggagtccccgtctcagctgctctcccccttaggttttgaggcccggccattcaaaacctggagctcatccaatagactcctggccgtgaccttcagggacccacctgtgcccaccgccccagcactaggctcacggggttctacaaagcttgttcagcaagtactttactgcctgagccatctcttccgcccccacactgccagctttcggcattcagttaattggaggcttcttgtctcctgatggacctctgcttttgctctaagcacacagacttgtctggtcacttggggtcagctacgtaatcacctaaccaaaaaatgcttgtatgtctgaagagacataaagatttcagaaattgtctgttctaagtggatgttgtatggaattttactccatctcagcagaaatacaacacattcacatgtttttgtctgttttttgttttttgttttgtacatgtgttatatactccacaaaacaaaacattcaagcccaaagtgaaaaaggaaagcggggccttttagcttcgaatatattgaattaagaagtagcttaagggaagtcatcacttttggaaagttttatatgcacacattcttggtattgtggtgctgctgaatataagccaatcttgttctacgagggggcaggtgatcatgaagttgagcaacgcttgtccatgctgtgtctggctcatatcatgagtggctactgttacgaacacaaaatggcattctgattgtttgcagatattgtttctgattctcaatcagctaattgtatagatctgagtcaggctagacaagaagggggcttggggaacaggtggtggtgtagctcagtggtaaggccctgggctttataccagcattgcaaaaaaaaataaaaaataaaaaaataaagacaaaccatgaggaagaaaatttaaaattcaaatgacttagttgttctgttatgtagatgcttctccaatttatgcttgtagtcttaatttctatgagacgttcatcttagccaaggaaacacagccatttggctttatgatttcataatttttatggaaagtgatgaatttttaaatttttgattacattagagatgtggtgctggtgataaggatgactgaacactgtgaggcgtgttttacctatagaggacaagagccttatcttttcgttttggagtttttgttgttttgtttgtattgtgtctaagcaggctctcactgacagagctgatttatttagaggcttcctgtggcttgctggggggaaggcagattggggaacgctgggaattgatgtggagaccatgatgtggagaccatgatgtggagaccatgatgtggagaccatgatgtggagaccatgatgtggagaccaagggcagcttacttggggttcgcttcctgcttccagcagagaaacctgaaatggggggatgggtgtcacctccaggactgcctcaagccatggctaggtagaggtcacactgtgactttagagtgttctttgtcctctgggccttggtggcatctttctggtgaagaggttcttacacatttctgttctgtaatatagacttttcagagactaacatatttgatcattcctaggtagtggctcaagaagggatgcaggaggaagtgagaaatggctggagggaggctcttgctaggtcttcctgttctgggctgcgtctgcgtcagggtgcccccattgcttgtctattggtgattctcccttcttctccagccctgtgtgttgggacctcttttccctctcttcagataaaactcttgtcactccttttgtatacattcaaatactcaaattttatttcctctaatctgactttctttctcttcagcacttacttttcttctgtgaattaccactggggcagcaagaaaagacaggatgctcttattttccaaacggatggtgactctgctgcctctgccccttgggtagctctgtcttgggacactcaccatcaacctctactttctgagtacttacatgtgtgaaggcggatgcagtgggaagcagcgagctgtgttctaaaggatgctcgcccacacgtgccaggcttctcaagtgccaggtctgctacagtgtagcactcactcatctggagctgcagcttcactccatgagccctccccaccagcctctgctttatttctgtgactcgatctcagagcattgcatcacacaccctcagtgcaagtacctgcttgtcctttcttcatggctcacatttctgtctcctgtaacccttacagtttatgcagactctgttcataagcttctttcgttttaaatttgcttcatgcaagcaagagcaagtcagatgccccttcctgactttttaaatccgtgttctctctgctggcataaagttccatttatagatgctgattcaccatggagcaaaggttgatggtgctctcatccgaccagggtgtgataagccattgactttacaactttctgactttgttccagagctttattgaaagtggaaacagcttcacctgcaggttgtaatttattatttacttgctgcagttgtgggaattgcatccttcctgcttgggagactagtgctctatcatggagcaacaacagccccagttccctcctttgctttttactttaaattacccagtctggggctgtacatatggtgcagagggtaaggcacttgctgccaggcctgactgacctgccttcaatccctcagagctatatggtagaataagagaactgacttcccaaagttatcctcccatctccacattgtgtgctgtgctattccaccccaccccttctcccacactgaaaaaataaaatgtaattatttttttcaattgccaaagctggccttgaactgacttaatagctctgacaagtcttgaaccggccctgcttcgggtttctcaggaaactggattacagatacgctggaagaccatgctgaggattttgaagtgattttaggatgagttcattcccatgagataaatgactgcatgtcaggggagactcagcaaaactagtttacacctgaaacattgggtctgcagactttcttcacatttttctttttaatacccttaaaatttttttctggtaacctctgacacgagtttcatataaaccattccatccttccttcctgcctccctatgctgtgctccatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataggggagcagggagggatgcatggagcacagcatgggggggcagggtagggatgcactggagcacagcatggggggggcagggagggatgcatggagcacagcatagggaggcagggagggatggactggagcacagcacagggaggcaggacaggatagaatggagcacagcatagggaggcagagatccacacatgcatgccctcacactggggcagctgagtacagtttggtaggttctttgaggccctgaccacattaaatgttcattcccacattctgaattatgaatgcagagatccatgcttctgcctcctcatcaccaccaatgatgcttgaggggaaaaccagcctcacatagcagggcagcatggcgatctgggacaagggaacctgcggtctccacattgtccatatcatgtgctttgtctaatttcttgcttgggttgcgggggaaattggatgaaacatttgatgacagctttaggcagccctacacattgcttcttagtcactcagtccagctctttgggagtacggacttgaaaagtctgatttagcttaggggggcactgagatgggttagggagggaaagtccttccttagaagagctattaatgccatgcacagatagagagggcagtgtatgaagaccttgagaattgtccaggccccagcacaagagacaagaacctgaagagaggactcagagcctacttagcagatgcggggtctctttttatgccatttagaggatggggcagtctcacagcataatccagccacacatgttctcacaggttacctcacaggaggaaaaatggggaccggatgtgtaccaccagccactggccaccggtgttccctttgatgtaaacttaccctggctcctagaagtctcttagctagtaggttgcctgttggtatctgtgtgaagggaagctgctgcaggtgttgtggcctgagcaaaagctggcttctagcatcatatccatacactgctgtggtccctagtggtcatgtgttacactggggatgggtggaatcctgtgatgggtgtgtttgcctggctagctggaggcatctggcctttatcaccaaaggtggtggtggtggtggtggttttcctgcaaatgtatatagctcacaaagctgacagaggtatgcagagtcagaagccctggtgggagaacaggactctacactgttgacctggacaaatacaatgtggctcagagcttgcacaagtgcaaaggaagttttggctcacattagtgttagaaacattgctgctttctgggagaggggagaaagagagggggtggggtggagggagtttagcttttactagtgatctttagtatcagtgtgaggccaccactgagaagaacaaaagtactgctgggcagtgtaagaatgcccctctgagggctgcataggatccaaaagggtccaggctagctgtgcagccaaactccaaggacttaaccttgaccccatcagaggctatgactcaggggctatctcaatgtcctttggaagtctggtggacatccaatttctaggcgtcctatttctgtgggaagcagctgttatttctttttagacaaaactgattaatccataggttctttttttttcctcccctgctctgtctgtgtttgctctcttgcaagcagctgcttccttctttgggcattaaccttgatggcagctcccagactgagtgctatcgcctgtctctctccttactcttgtgttttgctttgcaggtctggggatctaaggagggcctcatatgtgtttgacaaggtccctgccactaagcaacacccttagtccacagtctaaaacgccccttccccttaacacacagagctttgctgtgaacttgttgctttcgtgggagactccccttgggcagaagttccatcagtctggctggcacagtgttttctgagcagtctcaagcagccctccacagagatgcacgtagatttacacagggcgtacactacgttcctgtcactgttcttttcccctaaaatcaaactggattagactgaatttccccaaatacaagactttcctgtttcttaaaacgaaagaatgcagcgacctgttcttaagtacaagaaataaaaaaggtagggctaattccccccttcctcagtttaccccttgcatgcagagcccatgaatacaggggtttaaatggattagtgttgcgtagcacaaacactccaacccagatgttgagctaatggagttgttaaaataaccaatgcagtagactgggttaccaattggccttacgtagttcgtcaaaagagtggtgaatatttagggacacagtaaggagagtcattctctctgtcttcctcctcttctgtcccctcttctccctcctcctccttgtctctctcctcctcttctccttccctttcctgtttctctcccttcccatgtcttcctgtcttccttgttttctcatattctcttctcttctgctgcctcttttactcatcagcagctagcaggtcaagacgtaagcacacagccatggatagctataagccctcctgatttctgtggataccaagatcatttttaagatacagatttgtcaaagtcttccctgcggcacactcaagaaccacagggtaactatgaatgtggcctaatgcaaaactataaacagggaatattatgaatcgctaccccacccccacacacacaccaactttgctttgtaacctgattttgtagttcccaagtgtggactttgtagatgacattgctgatttcattattgtgtcaaaaagttggacaccctcactagtctggtagcttttatgatatggtacttctgaaaatgatcaggtagaaattcttaggtgttgaaatatagactctgatttctatgcaccatcatgttttatggagaggttcttgttaaagtaatctggtaatctctgtatgtgtgtgcacttacatttcatgcatgcatccgtactgatgaataccaaccaaggatggttgtactgatatttttgaaataatatagtttgctcttggtactaagaagaaagaactgtgtagcattctagtttaattttagttgagcaaaatttaaaatcagcctcaggttcttggttattcgttaactcaaacttaaaattagaagtgtggaaataacttgcttggcagttcggactttctgagggaaaccatatcatgttgtgtgtgtgtgtgcttttaaaaatagatctcatagcagagagataggcttccccatctgtattcctggctgattgctgcagaggtgagcagtggtctatcagacaagggctatgagttcacagctctcccaagagggctgcatactagctgcagctgccttcagttcatctttggtcaaagctcttttgttttaagctaagtgccagagggtaaacactcttgacccagactgtaaatatttgtcatacatctggttagtttagcttttaactgaacaaaatcattttggcagaagagtcgttaaagtttgacaacctacaaattacacaaaaccctgacttcacatccctcgttttctcacacaggcggtgactggcttatgaagcgtttcttccctggtgttgaaaatgccctgaaacatgtattcttaagccaatgaagcatataaacatggatgaaaaacatgagccatgtgtaaatatgtgtgatgtcttctgtcagtcccttgaggatcattaattgaatgcttttccatattaaggggctccgggaaatggctctgtggagagtgcttgctatgaaaacctaagaacctattctgggccacgtaggtggtagcaagccagtccctcttgcattgccacttttggtataaagtcccctctgctgtgctctggaacctcagagcctatgtgaccgtccttgttcttggaatgcaagtgtctatgacatgtcaaagttcatttatggattggaatatggctcagtggtagaaagagttcttgcagtgcgtagtagagagctagtgttcatgaagccttgagttccagccccagtcctctggagagcaatggcatcaatttgtagcccaggaggaggggctctgtgggctttgggagaagccttgtgtttgtgaaaaggcacagcagttcagatctgtctctctagatgagtgagacatgagtagcaagaagactttcaagatttgctagagagggtcctgcctgggctgggcattgtgagtctgtgagaagctgtgttgaggaaaatgtgggttgacctcacttttagttgttctttgctgtgtctaatccagaaaaaaataaaatgctgcctaaggcaacgaagctgtgcctgtctcgtcagtggggtctcggctgtcagggagctgtgaacaggctgaggtagtcagacaagactgttttccttcccaaagctttacaatgcaatgtcaaacttgagtgagagaaactgtcagaaatctcgtccctggaatcctgagtcctcatctgtgctgagtgagcagctgccgggcgttttggctccttataaagcattgagaaaagtcagatgcattaaacattctcccgtcccagggaggcctggcttagccaggaggatacgagcattcctccctatctgtgttaaagagagcctcagaagaagcctagagcaactgggaccatggtgtcactgatctgaagttagcaggatatgtgtatgtagcctggtaataacaaccactgttctgcgactggtaacttagctgcgttttagactatccacacagacaagtaaaacctgctgctcttaagagaggaaccggacccccagtacttgccagggaggacttgtaaacatcattgatgaaagtcaggttaacacgaggaagcattatacattttactagtattttatgcgcacaggattcctagaggagcagccacattctaagagtttgagcttggagagataggctgtgatgtcatggtaggtcacatggagaaagccaatgaacgataaggatcccttcatggaatgggacccatgaactggccatggtgacttattttgggccagttctccatctctggttaggagttggtctcttctttttaacttatttttgactcagggtttctctctgtactcctgactgttctggaactcactctagagaccaggctggcctcgaactcacagagatccacctgcctctgcctcctgagtgctggtattagaggtgtgggctattatgcctttaatatgttgtgtgcctttctgtttctttgtgtcccccctccctctctctccccctctctcagatatgtataccacagaagtcacagagagagagagagagagagagagagagagagagagagagagaaggagggagggagagagagagagaccacctccctaatttttttttagaaaaagtgcagtacagtaaatcacaatatgactgtaaagttgctaacctgaggcttcacttctctgcagtctgccttgtcttttgctttagttgatttgggagctatttgaacatttaactgactaatcccgatgttatggaatagttatgtcttaagacatcaatgtagttttctcagattagtagaggtttgtttaagaagccacctgattgcggaagcagccatgctgataactagttacctgacagtgagtctgctcttgtttagaaccgcagtgtttagatacaggctgtcacgtggtactgctagttgcttaggaaaagcagcgatccgcatttcagctggttgggcagcgatgactgtgctcaggtggacactgtttgaagtctggtgtaagcttgtgaatgttctgcatatggggtatttaaataatgtaaacctacaagcagagcttcatgttgttagggctggacagattcctcagtggcagggcacatgttagtcatgtttcaagccctgagtttgagttccagcaccacaaataagttttcctattgtatgtgtttgatatgtctagtagacggtgtttgttgttgcctagagcttagtaatagcaagtactacataaatatttgcagaatagagaagttgatgaacgggaatgtgtgaatgagctgatagtggaaaggttgaatgcctgttgatttctacatcgactaaagcccctactagcatctgctttacaacactcctgactccttcaaacctctccagaaggaaagcaacgggatgtttttgttttagactgttacattctgacactgcaggtgacaaactgttaacaaaatgagtaattaagcacagaaggtgttgataatgaagctgaaatcaatctgtcgctgaatccagggctctgtttggtgggaaatgggctgactactgcaccactgaatttgaagaactagctgggaaaattaggggttttaaacaggcgtcaaatgttcagcttcacaaaggaggcccaatgtctagaaaattgtgtgattgatggtaaaacagataaggtgtgctcagtccctacaaaggcatcacagctttccaaaacggccactgttagatctgattcttgatatgctgtcatttgttcacaagatttgatagtgtgctatcccaattgtaggcttgcctggaatctggaatgcattgttctaactgcagctccttcaggctctgcttgtctgagtatgagctagtaactcatctgctgctttgatttcctcatctgtaaaatgggcgtgaggaaggggttaaccagtgaaccactgagttttaagaattcaagtgatttaaacatgtctacctgagaacttgggtccagttctcagcacttacacagtacctcacaaccatctgcaactctagttccagggactttgacactctcttctgacttctacaggtaccaagaaggattgtggtagacatactatgtgcatccaaaacactcagacacataaaaaataaaataaaataagtaaatctaagaagaagacagagaaggggagaagaggaggaggaggaagaagatgaggaggaggaagaggaagaggaggaggaggaggaagcagcagcaatgagacacagctagggacctgcttgtttgtcttcatcagtccagcgtaatggtggcaggttgaggacagcagggaacttgtggccaggctgcctccactgccaggatgttcttgtcactgagattcttactgatccgactgaagtcaggctgtgttctcccaagagacagaaagaggagagaagcctcaggttcaagtctactgctctgaggcgtgaccacacccactattgtgcacaaagccactgcctttgcctgtgtacaacccaattcaatagaactgtgggatacctacacgtgtcaccttgtgcttaatcacataacaaagtgccatatattaggcaagatctctcagtaggctgcatgcttttcttggagttggcccaagtcttccctttctttgtttgtttggttggtttggtttgggttttttttttttttccgagacagggtttctctgtgtagccctggctgtcctggaactcactctgtagaccaggctggcctcgaactcagaaatctgcctgcctctgcctcccaagtgctgggattacaggcatgtgccaacattgtcccaccaagtcttccctttatcctagatttcaagctcctttggccctgaccacatatgggatgaatgtcagactgaaaggcctggatctgcctggatctgctcctagctgtgtcaggggtatgcccagcttgtcacagtgcaggtgagagctgcctctgagcatctttcaaggtagagcaggaatttgaccctattgaaagctacagtcacctgacacaacctatttccaagactatagtgactaaaagttcttttgtactacagtaacaattagattgtataccaagaatcaagcttggtgtgaagtacttaagtcaaaatccacagggtattcctaaagaatacaaaagagggagctggggagatggccacctacaggagaaggcctgcgcttagatgtccatgtgacaaggaagtatggtcgcacaagtctctaatgctggcactgtataggtgggaagatagagacagccccagagctcactggctctgccagcctatcctgttagtgagctcacgcagctcagttagacaccgtgtctcaaaagataaagtggaggtaaactgagggaaggactgaggaaggacttggaacattggggtagaagagccattgagtgttgagagctcagcaggctgttctgtgcgaacttggaagatgagaatgttgagagcagtgcctacctagcttgtgaagtttcaaaggggcgcagtctctactgggtctctgtgtggagaatctgtgatgtctggtcagctggagctgaagaatcggctgtggttaacaagagagcagaatcactataataaaacctttgttttactgcgacagctgatgtttcaatgatgaacatcagcgtaaaagtgtaaccttcatctccctaacttgcctttggccatagtgttctagtaattgtaaccctaaccaagacactagcgaaaactggatgtcagtcaactttaggtatgagcaaaactttcaacgttgtgtacataggaacaactttggaaggaaatgctattaatctttaaagttgtgttaatctttaaagctgtgttggagggtaacaggctgaaaacaacatgtcttaggtctgccctaaaagctagggaggtgggtagtaaggatgctgagtaatcactgagcctgggaattcgggtatataggagtttattgtagcagtgcctgcactttatgtagacttgcttttgtttaaaattaaagcaacaactaggtaccatgcatgattcaacatgggaaattcctacagctatggatttggcagaaccttgcagttgatttcaaatccaaaaaccattaaaggtggctaaaagtatgattttaaagtgcttttacatgtaatgtaaaaaatgtgccaaaaagaaaaataatcatactctttgcaagtcctgtcatagaccattggccagagttctaacatagaaatgtctaaggtaggcaaaggatctggacagacagctcacaacgaggagatggcagtcgaatgtgctgaaacacgaaccaactctcagcctcatttgtgagggaaaatgtgcagggcttgggccacctcagaccagcaagcctctagctgttggtcagacatgaagattggtaaggctgtggagaaagttcagccgatgggaatgtgagatggctcaatgccaaggaagtctaatttggcagtttctgtcaggattctttcagatgcaatcacagtcagggttacacactgaagctctgttagtagaactcagccaaggctgggaaccttcatctctcctctgtgggggtaacctagaaaactgcacgccctggaatgccatacagctctgagaaggaaagaagccccctgggtacctgttctggaaggcctctcaagaacatcactggagacccaatacttgtgtatgaaatggaaaataagtatctttaattaatttgtgtaaagaaactatgtaaagacctggaggaaactcagccatgcaagggagtgagccaggactgtagtgcctctgtgagaaccttcaagttcatgaaggcatctgtgcaggttgagccagcattatgtgatgtccattagtggctcacttttatataaagctgagtaaaattccaaaaataacagttagatcatttgaaaatatatggggtaggtacccatgaaatgtttgcctcaatgtgtgttttgtgcacagtgtcctgccagcccaggttaagtcctgggcccttcgattaagtcagacattgtgactgctgagaaagaaagcgctctgctccctcctgggacatttcatcacctccctcctggttccgccagctgctctattaaatatgaggagcaagcatgctttcaccgactagggaagaaatcagatgaactgtctgcccataaattatatcatggctcttcggagagttttgtagcctggagccactgctgttttcctgtctcaggcttaagttcgagcagctgcatgttgaatgcttttccatttttgtttaaaaatgtgtgttagcacctcctccaagtcctcttacttcacaccccatcccagccccaaactctcccctggaaacacaaagatttttaaccttttaagaaacaaaattaggacgttctcttcctatatctttcccttctctgtaagaaaaagaccactggagacactccttgtatttgcatatgatgtatctgctggaaggcagagagagtgtgagtttgcatggccatcccacttacgtgctactccagttttaggtggaagctgagcaatcatgcacggaggtcctttatagaaatgaaaaggtttttaattgttgcatttctccatccccccacgtcctgtgtgtgtgggtgtgagtgggaggggagggagatctgagctcaagttctcatccctgtgcagtagacactttacctactgagccatctccattctttaaaaatgaatatctagtcttgttgcagatcagactatttgcatatttaacatattaaacactccctttaaagcagcctgacagctgacttttctgagctctgttcacaggcttccttccttcttgggagccctgccctcttaagctttggaactcatttggctgaaaactgtctcccattgtcctgtttctcccgctggtgctttgtggacaagctcagtgcagtggggatctgtgttgtggagctcagctgcctggattctggaaggagttccctgtgcacaggacacatatcgagacatccagaaatgttccccttgtttttatattattgcaaaataatctaaactctaccggatggcatttaggtttgctaattcattagtctgtacattggtaagggcaaacagactacaatacaacaacataataaccaaggtgtcaggatttgaacgaccaatcacaaacatcccaaatgttatctcttacatttcggttttataatgaaaccagcaaacattgggctagcaaaagaaaaaactggcaaaaatcgggtatgtatggatcctggtaaattaggctgtgtgtgaatgtggctaccaagtgtaactggagagagaaaggatctggggaaggaagaattggggtgggggtgggtggatggatggatggatggatggatgcagagtagccagtgactgagaccaccagcccacgtcctcagctaagctcagcactctgttaggcatgtgagtgtctgcagggcaagctggcctgaagtcccgaagctggagcactctgagcctgacactagactcacatcttgtcctggcctccgtactttctctcagctcagggctctgggtttggttcttgtgcctttgttttgttgctttttctccctgctgtgttgctgaggagggaacccgggactaatgctctgcactgagctgcaccccagtcagcattcccacttcattaagtatcacctacagtgtgtcaggaattgactgtttccatcagggtgggatatcacaggttctgtcttgaaatggacccgtggcaagaagcactgtcttagttaggcttccgttgttgtgaagagacaccatgaccaaggcaactcttataaaagacaacatttcattggggctggctcagaggtttcagtctattatcatcatggtggaaagcatggcattgtgcaggcagacctagtgctggagaagccaagagctctacatggtgatctaaagagagccagcctgggactactgtctgccttaggcagccaggagaagggtctccctccacatcgggcagagcctaagcataggaacctcaccaccacaacaaccaaggctacacctcctactagtgccactctgagccaatcatattcaaaccaccacaggcaccctgcataattacaccccaagcataatgctcccctgaattgaggaccctaggaaataagagcatgagaaggatgactcagcttaaacatgttttctggggtcacatgccttccagtgcagagctcccagacagctcagcagcaccccgctttctttcttttcttttcttttcttttcttttcttttttttttctttttttttttttacttttagctccccccttgggtttggtaaacttgatgtgttcgctggttcagatgaaacctgggtgtgtagcaatttggaaaatgctgtgcacaaatgaactgtagtcggtaggaccagtactttccccgcctttgtgggaaaacttgtttatgctgctattgttagctgtttttcttggatgacaaaatgcctacagttgttgtaacatgtttctgagagacagaggatgaaaatcgcaacaaaaacgtgagcctttcaagttagcacatgagctatgtgcatcgatgatggggaggaacagagccaggaaaacgattataaagaaaaagcatacatgggccgggaggtacttctgccaatgagcgggcctgctgccaagcctggccacctgcattccatccgcaaaacccacatggtgaaagaagggaggcggcccctgcaggtttcccttaggactaacacatgcacgtacacacgcacacgctcacacacgtgcgcacacaaaataagtaaaataaaataacactgaaaagacagccatcaggaggcctctgtcagtatttttctttggaactaatttctagctattcagctctcaccagctcctgttagaagcaacaggagcttcctaggattaagcatccactagagctgagctacaggatgctcacttagtgggtgattgacaagtccctcaccccaagggtacctgcccctctgcattctcctgctgctcagccaaatcttgactagtaggtttttgggaattggttttcttcttacttctgcccagaggatcacgtttggaaacaaaaggaccaaagaaccaacatgaagagcacatggaggacagcagaggtcttttggggtgaggtgtagttcagtgtggatgaggggggccctgggttccacaggggaaagccatgctcagagcctggcctgggctcccggcgatttccagtgagcctcagtgaaggtcaaggcagatggagcaggagttgggtgttgtgtgggtgtctgcagaggacctgtcctccttaccatactctgtctgacttgctcaggcaagtttctgcagaggtgaagagctgccgtgatagaaaaccttattcctttgccaaattatcatgatcaaatatttcttttgtttgtttgtttggtttggtttggtttggtttggtttggcttggtttggttttttgagacagggtttctctgtatagccctggctgtcctggaactctctttgtagaccaggctggcctcgaattcagaaatcctcctgcctctgcctcccgggtgttgggattaaaggtgtgtgccaccacgcccggctaaatatttctaatgctaaacaaaatgacatactggctggcaaggatcacccaaacactctcctccattaaaaggtgggtgatgctgctgctggaaagccaaggtgagaggctactgtgttctgaggaagatgcccgaggcagctctgcctaacactgtttctattaacttttggctcctgagtgtatgagcttgtgttccaaatttatcaccagaagaatacagggacaatcgcttttctttctctcaagctcctttgttttttaactctaacatttattttacttttggtttgtatacgagtatattttattatgtgtatgctcacatgcctgtggggaccaggagaggccaatttcatgcagctggattacaggcagctatgagttgctacccgttatgggtgctgggatctgaactcaagtcctctgcaagagcatcaagtgctcgtgttcggcgagctgagccatcactcagtctagcgtggctcttgctctgcttagcctcacctgcattcccaggttctcccacccagacctagtcatcttcactgctgtcctgtgtcccacttccctacagaaacggggacgccagagacaggctttgatggcatgttgggccccttctgtttatgaattcactcgccaggggcccaaagatcacctgcagctgccagggaccacacagccctttctccatccacactctcagctcagctcagcattcacctgctaaccctttgtgttttcttcagctctcaagaggcctctggggttttttcccccagtttttcatactgggaacaaaatatatgtgatgtgtaattcaccatctcacacatgtgaaatgtgcacacgtcagtggtatgaaatgcttgtgtaacaagctgccatcatcgccacccatctgcagacactcttcatctgggaaaagccaaaactcttgtcacacctacttaacagtaacacttcagttgctctgcttgacctgcagtagttgccactccaacttgtgtcctttttaggtcactagtgtaagaatgtcattgtcctttgtgtatagcttgttgggggctaatataaagttgtcgaatttcacgtatgctgtgaggtacattggcattaccctcgtgactgtgcagtgacagtcagtggtagcagacacctttaatcccagcacttgggaggtgcaggcagatggatctctgtgagttcgaggacagtcttgtctacagagtgagttccaagacagacagggctacacagagaaaccctgtctacgaaaaaaaaatatatgtgtgtgtgtgtgtgtgtgtgtattgtgtgtgcatatgtgtgtgtaaacacatgacagggtgtgcaggtgtggagttcagtagacaacaatgggtttcggtccttgctctccactctgtttgaaatgaagtatcttgttcactcatgtgcatacaagggtagctggcctgtgccctttgggagatccctccgtctgtgcctcccagcttgccgttggggttatagataaatgctgctacacctaactttacacgggtcctggggatctgaactctggtcctcatgcttgcacagtgggtactttatccatcccccagtctgcaatcttcctctttttaaggctggatactatttctttagacacacgcactttggcatgttgcttaatcgttctttgatgaaccctcaggttgcttccaaatgttgactactatgtgtgactaacatagctatgagcaggactgcacaggttcctcctcaggacactgctttcattcctgtctccagccctgggtttaaacctgcctccctgggggtccttttttttttttttttttaaatctgtgaaatgaagacactgaacttctggcttgcagcagtcaaggaaaccaagttttatataaattatgaagtacttcctggtgtccagttttgtggcttgaatgtgaagtaagctgtgctttagttgatccctacctggcaagtgttctgtagtaagcacaagctgacttttgatttccatcatgggatagtacaggaaaggactagaaacctctggctgggtatcctgcagcatgtggcacctctaaatgcaccccttcctctcacatctttcctgcaaggtaattgctctaacgtgcttccccagagtctttgtacacagaggaaaggacttagggaagccaaggtgcaggtgggtactgtactgtacaggccaccaggcatgggggaatgctctccgaggaagaccatcgttagaagatgagaggcctgtggcctgtctcacgtgtggcacagggtggcatgagcacagttgaccttactatgtgacaacagtcataaaaatggttcacagtagagagaagggagtctggggctcagctcctgtacatatcctctggcatcctgggagggaagagccctgtgccatagccaagggcacaagacgtctgaggctctctgagcactgcacacccatctcagttagaggcaaaggatggcactgaatggtagacatgcagtgcagagagagagcccctgcaagtgctcccttaatactgcatgatggcagagagctgccacgcatcagaggctacctggtctaccctgcagtgggcagtagagagcagtggtgccctgtgcagtgagtcttcgtctgagagcatcccacacatagttttgctttgagtttgtatgtgtcattgccctttctccatcctgagactgggtagtgggttgagtggagctgaagtgattgcctgtgtgttcaagcctttataacttactagttttcactgctgttgcaatctggggctgacatctggcagcctcaccatccctgccaggatctcagccaagctcgtcttgacagggcctcaactctacctttagcagcctctttttaaatagtgcaaaaactaatgtaattgaatatgtcatcatagatattgtctttttcacaagtgtcctctaactgtataaataccaacatggatgctatcagaagtgctggtacgtactgagtttagggctgcagccttgccatctcccacagctggataaccatttctgttaactctccaagtgaccttgaatggcctgagccttacttctatgtaaaattgtcaaagggatcagtaagttagagcctgagaattcccttcccttagatttagaaagtgaattgaatttgaatctgccctcaccatctcttttttagtcctaaataattaaatcatgtggaattgatagagtatgaacaaggccttatatttagatgaataatttgaactttgttgagatatagagcataataattgtgcagaatttgcctgaaggccatctcttttcagctccccctcccccgccccgcctccctctctgagcctctgaggagactacctaacaaagcccccttggtgttttaacatggctgctagtgctgaccattcacccttacacttgttaaaggtcacagatttttttctagcagaagaatctcttttctccatggccatgaggattcttcactgtgggccccttgttagttgaagacctgttatggggcctccactgtctcccgaagggtcttagcaaccaggtgagatggtgttttggtgttttgaacagaaatgtcaacttacacatattcggctccttcctttctccctccctttcttcctccctccctcttcccctccctccatccccttccctcttcccccctccctttcttaactctgtcttattgtgtagctctcattgctgctgattttgactgtgtaaatctggctagcctcaagatcacagagatccacactgcttgggttaaaggcttgtgccacaatgcctggcctgtgccaccatgtctagcctgtgccgctatgcctggccatattcttctttcatgatacattggattccctagcctcttgtcatatatcgaagtgactttatttgaaaattgtaatatgttgacaaatagaatgtgcacattacacatgaacacttagaaattgtagtgttttagagacatcttttaacatgccatatttagtataaaagaccagaaacaatcaaggccagatacacatccagtcctcagaatggacaccacagttgccagagcctgtgggttcatgtgtgtagccatgattttcacatgacctcacctagggcccagctggtatgagagccttctctgctgtcccatgtcacagctaaaacgaggactcacacatgcaggctcattggcattctttactgccattaaaaaccaaaaatgttaatttactgatccagtgaggcaacattaatgtcctagagtttgggcatcacgccttgtcagatgtgaaactctgaattgaatgttcacatagttgtaatgtttgcatgcaaagcgtttattatatacgtcagtttttagagagacctattacatttttatgagactgtttcacttttataactgtaaatattttggtttataatatggatggttaagcaaggcaacaccctttcatttggctgccaaggaaacctcttggttaggattgcacttggatccctcagcacagaggagggcagagtgcaaagctgtgggagaagttgggatgctaaagaaaccagtaacgtgagatcacggcattctaagtgtttggtgctttcatacataaaatccagtgcacattcctgggagcacaaggcccacgggtattctgggtaccacactgaacatttaatgtataagcctattgctggaaccaggtcctgtgtcccaacccaggatgtgtatgaaagtaccctggggacatttgttgaacaagtaatttaaaaatttccaacttttactttatacataatttggagatctgtataaacaaatgtgttcacctccagatttatgatgatttgtaaagttgtctttggaaaaaaagtatcaaattcttttcaccactaggggtcaacacagtgcagttaaggttttttgtttttaggaattctttcaaaaatgaagatagtgcttcagctgtatctgagggggctgagttaaattagtgctgcatgagaaatcttagaactgcatcaatgtattttaaacttagcacagggtgagcatgtgtctgagttaaaaatacatccatgaaaatagcctgataatgtatgtaaaaataacacgtcttataaatagacagcaaacaatgagttggccttttatgcaagtgtgtgtgtgtgtgtgtgtgtgtgtgtgtgtgtgttagggatcaagctcacagctctgtgcatactaggcaactgttgcactgaggcctgattaaacagcatatttgctctaaagtcaaaagagaaatagacatgttaaaatagagaaagcactcttacctcctaggaacaggaaaaggtcctgacaaagccccttgttctgtgtagcttgaatatgggacaagggggcatcaccatgttgcagagacagtgtctgtagccacacctccaaccccagtaccaggttccagccttgaatggccaggtgtgtgactagaggctgttgggagcctatcaggaggcctcacatctttggatggagagggtaatgatgtcttcattgttaaggacttcaggaagggatttttctttcacagtgttataatagtaagttagaataaaatcagtaatggttttgtgcataattgttgatggttttatttagtgtgtatagtgtgtatgtggtacatgtctatatacatacagcacatgtacatatatgtgtgcaggcacaaatgaataaacatatgaaggccacaagaggaaatctggtatccactttgactctccacacttcagtctgttcagacaggctttctcactgaatctggagctcactgtttgctgactgacccccagccccatcactgtaatccaaatgatcctcctgcatgagttcttcataccaccagggtttactgtgtatgatttttgacactgggtctgggaacccagttcttatgtttttagcacacttatccactgagccatctagctcattagctctaattttattttgttttatttgctgtgtggaccgaacctggagccttgaagaggctgggcagtgctgtgctactgagttatatatcccattgccattttttttaactttctattttgaaatggagtttcccaggctggtcttgaacttgccctatagccaaatagtccttgcaacccacctcagccccgcaaggggctggaattgaaggaccgtactaccaggccctgctagacatccatgtgttctttgctgctgccgtttcttgagatgctgagctctaatgatggaacttgagtgatggttggatagatgctggtcttactacaagcccagctgactctgaggtatcttgatagacagagcttaggcacaaaatacgaagcagtagataaactctctgtcgttctctgtcacctggttcaagtgcagattaggaatccatcaaagctggcctctgaggaaaaggaggggacactcaaggcttttatgcctgctcatccttgaagaattaactgcttgggactcaggcaatcacagaagccagccaatagtttctaggtgtaaaatgtggatccccagactgtcctctgggaaactagagtccctttttggggttcttcatctcgctaatgagaatttagaaacagattcaaagggaagcctgaggacagttttattagagatagagggggacaaaaaccaacaacaaaaacaaaacaaacaaacaaacaaaagtcccctggacaatcagcttcagtagtttttgggaggagagaaatgcagaggtgaaagaaagctaggggccctttgaggagaagcccaggaaagcagacaggttcagtaatggagttgcatgatgagccaacagacacatggaggaaggtgggctgcagacagagaactttagagaactaacgagaaagttcagtgtgtctgggacagcacatccaggtcttggccagtgtctgagagtgtcttagtcagggtttactgctgtgaacagacaccatgaccaaggcaagtcttataaaaaacaacatttaattggggctggcttacaggttcagaggttcagtccattatcatcaaggtgggagcatggcagtatccaggcaggcatagcgcaggcaaagctgagagtcctacgtcttcatccaaagactgctagtggaagactgacttacaggcaactagggtgaggatcttatacccacacccacagtgacacacctactccaaccaggtcacatctattccaacaaggccacacctccaaacagtgccactccctggcccaataatatacaaaccatcatacagaggaaaggaaactttaccttcaaatgggcagaccatagtgctgcgtgatataagcctgcacacttcagtctggagccttatcactgggataattattcctcccatctccttgactggcttcaagtgaattggtttccctgcggggtgaacccctggctgggtgattggcagacccagctggatttactcttaaggggaggagacaatattttgagtggtttagaatgccaggtctccannnnnnnnnnnnnnnnnnnnagagagagagagagagagagagagagagagagagagagagggaggagggggaagagaaagaaagagttgtgcagagagagaaggagagaggagaaaggagagagaggggagaacaaaatgtctggattgtatggggaggagcctctggggaagggcagcaggccctgggctgtaaagttcaggattgaggacagagtatgccaggtagggactgagggatgctgggagagtctggaggccaggtctgctttagtatataaaatattcataacaattacttgtcccagggtctgaaaccaaacactattgggtcactaagaaattatagaaatgatccgttgtggcaccgtgaaaggcagcctgtgttctggttgagtgaaacttactccagagacccagtagaaaacactacaagggacaaaacagtgatccacattcccagacataggctcctgacaccacgaagcccccagcttcataatcctgtgactatcagtcacttagacaatgtcccaagcttctgatattctgtttagactctacccctactgttaacctggcaatagccacatatgctccttcccacagttacctggcaacaacaacaaggtagcccagcctactataaaaggagctgcctggcccctcctctctctctctcttaagctcttacctctcttattctcatctctagctctccttctccccctcccttctcctctcttcacgtggccatggccagcctactctactctactcctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagttcaatcaacaatccagcttctttctccaaaaatgcacaaatgtattttttgtaagtgttagcttattgtctgcaatgctataaattgttggctgcacctgacccagggaattgtaaagtatgtaggacatgtgtgtatttgccacagtaggttgctactttgatgtcagggaactgcctagagacatgtgcttgctacataagttctaaagatgaaccgtcaaaaggctaggggatgtcagagaaggaactttaaaactccagaccaccttagaacccttacttcaacgattaaagtagaccaactgatagagtctggtctctgctgggaggagtttctatataataatgggtgtcagtgtaacccttttagaggtttttggcaaagggtaaccctttgtctgccaaaggtaggctcctgctttgcctgccagcccagtttgcagggtaaacagtgggtgacctataagccagccagtcaacttgcagatgaccttattaggtagccccaggaggctggtgtctgaagacaggctggcaggcagctgcagtggactcatattctgtgaggagctggagagctcacaccctggagacatggcctagtaccattcagttaattagagcactctataatgacaggggtatgtgggcttcttggcagacatgctctatggtatggttagacaatcagtcggtagtagggacttcttagagggtaaagtggttcactgggggctctttctacggtgtagcttgtactgatttactttaccaacgttatcagaaatctttgtctcccttgggatgcaggagtggaagtgtggctatagaacctagggcctcaaggatgctcggcaaacagtcatgggaaagagcagatgctgatggggagaggaggtgcctcactcccataaaggtgaacggagagaatggatgccataaagttgtcctctgacctctgctcaattcgtcttagtatgtgagctcagacatacacactcatcaatgacagtaacaaaaacaacaacaacaatattaataataatgaattttaatgatggaggaaagttaaaatgaattttaaaagaaaagatttgatgtttagggtaaatttgcagtgttttgcttttttgtcttgttttgtttgctggggaggagagagagagagagagagagagagagagagagagagagagagagagagagacagattttatgtctttctgtctcactgtctgtaggcctgcagccacctaggaagaaatgctgggttacaatgtctccgtgcctagatgttttctctctggctgaaagcacagcacagtctattttagctccgtgtcaatagatgatgagaatccggaccttgttggggtttttcctactgctgcacttcagagctggctctggtgttctcccttcagtggtctgaggagatgcatttacatctttgctccaggctctccttccagctggactcaggtcctctacgctcctgctgctactgcctccctcatagagaagagtgttcaccagcacgtcctccaagaaagcattaccatctaaccccatgtcctgtgaacaccatatagcttttatactgatgttccaattttggatcctactggaatcccactggactgggaaggctttcacgcttagtaagtgtgttacttggagggccactaaacattcttgtttgtgtaaacacgactagccaattcaacccaacaaggagggttgttccattttttctgtgcaatctaaacttaggccagtgtcttagtcagggtttctattcctgcacaaacatcatgaccaagaagcaagttggggaggaaagggtttattcggcttacaatttcatgctgctgtttatcaccaaaggaagtcaggactggaactcaagcaggtcaggaagcaggagctgatgcagaggccatggagggatgttctttactggcttgcttcctctggcttgctcagcctgctctcttatagaaccaagattaccagnnnnnnnnnnnnnnnnnnnnaaatggggccttttcccctttgatactaattgagaaaatgcctcacagttggatctcatgaaggcatttcctcaactgaagctcctttctctgtgataactccagctgtgtcaagttgacacaaaactagccagtacagccagtgttggtaaatgcccttcaagggtcccagggataatcaaagctccttccactcactcttctataggcctcctggtagtttggagtttctttgcatttgcccatgcagaagccatcaagtagtgagtttgaggggtgggggtggggagaacattttccacctctcttggtgatgagatgttgtcagcactcctgctgcatgagagtccttcctcagtgcagctgttgttgcacgtcttaaccacaaatgctggaactttatgccaagtgctgttgcacaacccttacgcattcatgcctcacacaggttacatttgttcttagtgctgctccctggaccttctgggcacacctgggatatcactcctcgtcctggacctctttcctccctgactctgtatttgactcttgtaagagcttatgataaatggagccatgcagtatggattcacccatgtagccagtgtcagaatgccattcctttcgaaggttggataacgctttgtatgcatgcttcagtattcatttaacgtctttacccatctgttcatactgtgatgccagcagtcacgcctcctagggccttgtacattctgggcaggtgcatgccttggtgagctgcacccttatccccagggcgctttttaaacgtgaacctcctgttgctcctctgctcttactctgggaattccttgtccatttgctgaggggcctggacttttcttcccaccaatcattagtaagagaccctaattaatataaatctatataactaattttcatgacaattgttcacacttttcatttgaagttttgtttcaaagaaactaataactctttaagaagatttcagtaagcctttgtctcaaaaacggtattctgctatataagaagtttggcatggttttctttcaacacatctgataaagaggtggctataagttgtaatgtatcttattgttgaaaatatttctgccctttcatccctgaacacacagcctgttttaaattaccttacatcgtgatggaagataaaattttatttttagcttgtacaaaatattagtatggaacagaatccacagagcacttcaggaagcaggcagtggggaaatggaactagaatttggaaagcatgaagaactcaactgtgatagcagggtaatgagggagcctaaatgggctcccactggtgagactccctcaagttaggcctttctacctcagattaagcacataaataaaattcagcaaagaacaggggaataggatttatcattgttctggcgtacaacatactcctttgtgaggcaataaagctcaagtcttcagccttgggacttcaagccagccatcatttttagaagcatatgtttacttttggtaaaatcatttctgtgtcacatcttgattttcaaaattgtctctcattcacagtagtgtgtatctggacagctgcgccacaccattccgtgttgtctatttccattcacttcagctttccagaaggctgaaagtgttttcatcttcagtgggagaaggaaggtggcatcacaaggctgtcacacgagtgcctgatccacgattaatgaatgtacagtggccattctcggtcagtgatacacttgcagctgagggaggccacagacatcctcacccaattctgacttcgctgccacccctctatttctttaggctctccagagagtttggcacttagaaatatgttttcctagcatgcgtgaagctctgggtccaacccccagcgttgcataacctggacatgtgatgcttgcttgtaatctcagcactccaaagccggaggaggaaggcacaggagtttagtttcaaccttgggcttcagagtgagtctgaggctggcctgagattcttgtcacctgtcttggagggtagggaggaaggcagggagagagggaagaagaaggtaaaaacgaagggagaacatttttaagtagtccattcatgggtatttatatattacatctgttatatattacagcaagcattgttagcaagcattgttacccgtctccccagtcccttgtgaatgcttttctgtattcatatttctctgcattagacatgatcactgccattttaaatcaaagcatctatgatcccccacaagagactctttgaataccacgtcggttaacattcccttgtgaggaccctcacaggcccctttctgggttatattatagataaacagttgttaggacaatctttgatagatattgccccatgagttgtccagggaacttccaggtactgaaactgcctttgtgtcaccatgtcctgtgattagcctctcacacctgatccctgtaatggagctctgtcaacttactgctacagtgaggtgaacttggaggaagtcttctctttggtctgcccatgccttcattaactgtggtgaaaagacttcccaggaaatgtccccacgtcatccatcacagctttcttgtcttcagatggggtcataggcctgcctgtacatgtcatagcatgcagaccctccctggaaggctttaggtggacacagtgtgtccaggaggcaagcaccaaggacagaagtgaggatataacaggtgcagatcttcacctcatcacaaacagaacggccatctacaagttggtagtcgctactctcctttctggttcagcttgtttccattccctcctccacaagagagacctctacaaggacagctgtttcttgtattacaggaagctccatactcagagctacagtaatgtactgagctgccctttaccatatatcacaggatggatcctttccatctcccatctccccagtcacttgtggatgcttctatgacaggaagtagaggtttctttgatctcaattggtttcctacagatagaatacttagtagtagattaaattgtatacccattgtttcataaaaaacttccttcctgtctttcttccttgcttgcttgcttccatgaatctgtctgctttctgatgggctaataggtgaggccaacaatattagtaattcttccagttttgttcccaagcatcatttcctacactctgcagagctcatgtgacatccatcccctgcccagagtcagctgtatccacagcttacacaattcccccatgggctttattttctaaactttcatttttaacaaccctatcttctatgtttcttcctgagcttacaagaggtaactgaacatgtagagaaatcaccccaaggcccctgactgttggtggtctacattagcacacactgtcttagttcctcctgtcactgtggtaacatacctgacagaagcaacttaaaggagaaagcgtttatatcagatggcagcttaagagcatacagttcaccttgtcaggagagcagagagggatccatagctgtaggttgtgtagctgaggcttttcacatctcagaggactcttccagccatgcctccttccttttaagcattctataacctctcccaaagagtggcaccaattagcaaccaagtgttttcatgcatgagaatgtagagtgcattttaatatcaaagagtagtacacttgtctgtccatcgtttcatccattcatctatccaccagtggatggacattcattttcagcaggagtctatttgtttctaaggtgatctggtttgacagtaggctctaaagtatctttttaactttcagaaaacactatcccattattccatatggtcattctgcaggtatttactgccaatctactgtgtgctatgtagataaaatgttcaggattcaaaggcagacaaactcagagccaccacataggctaaggacaataatgaccctgacctaccttcccactgatgccatggctccatctctgccaattgtcttctggaagcagattatctcttcagccttgcttccttaccttgtaatggagcttgtttcctgtgagtttctttaatgtccctttgtagggaggaagcaacccatttctacttattgtccattggttttccaaactcattatccagaattgagcccaccagttacaagctgcatttgaaacagggcaggcagcagcttgttgctaaagcctaatagcttctgtctcacattaaaatgtttgactctcctggtaatatctgtcttttcctttctacagttttactcacatgttgcttataaatcttgactcttaagtatgaatttttggctcctggttaagtgaaatattttatttagctcagctaaagccaagcatggggcagcttgggaacagctaggcacctcactgcaccccaacacatctgtggggtttgcttttgggggctatttgtttctaaggaaagtgggagagttcctctccacagtggcatgatcgttaggtctcagccttgtctttctatgcaaagcattctctgactctctgtggcctggctgtggtataatcctcaatgccccttgctggagtgctgtctgcagcagtgtctccccctctaatttctacttgtgatctgatgaaggacttgacctgttgcagccttttgctttgtgttcactgtgagctcaaagccacgtgtgcctggtcgctcacgctagccctgcactctggaaatttgcaacccagttttgcttagatgggctcaaggtcattgctggttgagaattagctgtcagatcaggctggtggtacccagccttctgtgtgcagccatgttcagaagcccagggctttccagctgcctgggagccttcagattctctgagaagcaaggtaagacgaggagggggatacagaacatgcatttcatttctgcatccattttctaatatctttgctgtggaatctagtattctccagcatccgcctagtcctgcagctgtctggaagggtgcgttaactattgtagttcctaattacagcatgtaattgctggaaatgtcttttcatctctctattgctaagccacaaaagcttttatatggcaaatgttgataattagattccaaactttggatcaaattccagatatgccaggttgtacgtaaaatattgtctcaaactacatcttatgtatgaacttatttccagcagacagaggtgggtgagcgttttacttaagtcttgatgtgagacagtttggagagaacactgtctcttcggtggcttccttcccatgcgcttgctggagtgcttttagctattgcagtgtcagaacaacagtgaggtacataaatgcctgcctacatgaaacccagacgttatctacagtgaggtacttaaatgcctgcctgcatgaaacccagacgttatctacccagaatatttcatagcgcaagtattctgtcgggactagactagaacaactcaggcacttccttttataacatttgatcgccctttgaccataattgtctctcttcagattgttctcacagggtacttctgggcttgtaataaaagcctggctgtctaattgactttatacacttcatttccgatgcctcccttttggccagaatttccagtttttaggacttgagatgtgttttaatggataaagaagtgttggcatctgctatagcctgtacattccccaccctcacccccacccccatccccacccccacccccaccctgtgggctatggttctaactagtaaaccataaagtcactttcttgagggaaggagtttttgtcctacttctgcttgtgttggtcactgagaagtggattgctggccgtgttataaaatcccattataaatcctgtctctgcctggttttcattaacatgttcactctgcatgtgtgactttcctgcacggaatcgttctgagttgtctgtacatcatatatcctatcttcaaaataaatgagtctgcccagtggtatggctcagcaggcagcacttgccgccaagttaaatgacttgagttcaattccaaggacacatgtggtagaaagaggggactgactcctgcaggctgcccttcgacttcctcactagaaccttagcacaagcttagcacaagcacacccgcacaccatttactcactagaaccttagcacaagcacacccgcacacccgcacaccatttacttactagaaccttagcacaagcacacccgcacaccatttactcactagaaccttagcacaagcacacccgcacacccgcacaccatttacatgtgttgctgtgtacatttttaacaaaacggaagagacacagcagaggtaccccttgctgctcctacctccccaccttctctgcaggaatcacaaatctaccagcagactacatcatcatctctggttatcttgacctaacttaaacaatcacacacacacacacacacacacacacacacacacacaccatatagagtcgttacttggtatttaattgcttcaagttattcttttgccataaccattgaaatggctttgaaggatgtcagatatttgtttaacccatgtgctctgtccgagcctcttgagaagagacagcttggtgtgcaagatttctagatggagttttctagaagttgttagttttgttatgtggttagtaatgtcctttttcccattggaatgtcttaagccactgtgtgactgttttaacactatgttatttcttttcccctagatttcaacaagaaaaacttaggattccagggattcccacatcaaagaaaagctgcaaggtaatgtggcctatgttcacggccttgtacattttggagacgtgtggtggcttttatgatgttcccttaaatcccttctttccttttgccgactgggaatagaactcggggcctcacacatgcaggcaaatacttcccaatgaactgtgtgtgcagcctcttgggctcttagctgtctatcccactgagtttgtttggcagtatgtttttcctcagggtattacacacacacgcacacacacacacacacacacacgcacacatgtgtactgctatgagctgatgacatgacttaatggtacagtttctacatagcctgtgcaaagtaccaggttcagttccaaagtgtgcatgagtgtgtgtgtgtgagagagagagagagagagagggagggagagacagagaaagagagacagagagacttaacagtattctcaggcactatcgattcttctatacttgaaactgtttctgggaacacattgaggaacagaacgtgtgcttgtgacatttgtaactgattgcctacgcaggcgctactgctctgtttttctctcagcattctctaaacttttgaatctgcccctagggagccttttttgtttttcattttctttccttctctctctctctctctctctctctctctctctctctctctctctctctctctctttctctcttttttgaggaaaaagcttagtctggctcctcctgtcattttctcccacacccatcttccttccttttttccctgactgtctgcattgctcgcctgtccttgtgaattcttctctagtctaaacacctgtctttcaactgcacctgcaattttcttcccctcaggcattgtgggtgctaatctaatctgcttactgtcagaccctgttgcacattgctgatctaagacaagtatcttagtcagggtttctattcctgcacaaacatcagaccaagaagcaagtggggaggaaagggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtcccacccacaaggagcctttcccccttgatcactaattgagaaaatgccttacaattggaggcatttcctcaactgaagctcctttctctgtgataactccagctgtgtcaagttgacacaaaactagccagtacaacaagcaaaagtgaaagactgtgacataggcagctgcatagggcccactgtcacaggccactgctcccagtcagacagtcctaggtgcaggtgcagggccatccctgacgcacgtggggatggggctcaacctgcacatcactgtgctaggaggagccaacccctgtgctagcctccctgcccctcagatgctcttgtccctaatgtattataactttgctacaaaggacacggttccttgacattgtagtaatgatttatctgactctgcatttgaaattggagagtggatcttataaacatactgtgcaggaaagcctctggcgtattccatgtacatctgagtataaagggagctacatggcagttgacagacgtacacatggcagttgacagacgtacagaagtattatttgattcatgaatggttcatgtctctggcctgtcattaatggcaccttgggcgcattccctaacctttccctcgcagattaccttaactacaatgaagttaataaataaggaaaggaaagataaggacaaggagagagggacggattctttattcaaggataagaagagagtaaattggaggccaatgctttggtgactttggctaaatgggacaccaaacttcagaaacctgggctgttatttcatgtaacctgaccataatgacctacctggcagggcaccaagtgtaaaaggtatcattggcttagggtctctgtgcacacaagacatgcagcagcagagaaagcccaagtcatgaggcagaggggttttaccttccctgtcttctaatttacctttggtgattagcatgaagccagccctagtgaaaatattcaaagcacagcaacagctgccaagcgggcaggccaggcaccatgcatttaggtacctccaaatcgtgtgtacatgaagtctggaggaggtaatggggtttgtagctggggttagagtcagtatatatgacgggacacaccccattcttatatcagtctctcgcttcactctcttgtattcatggcaaggcttcctgggcattttctccccatttgcccatgccaatgtttggtggcttgaaggcacgtgtaatatcaatgtaatttaacactgggaaaagcatccagactgcctcaacaagttgctggccttctgaggaagagactgaaggttggatgatttagcctaacatactcagctgttctgggatcaagaaggtgttgcctgtctaaataaaggaagacaattcacaggttcagtggtgttttctccaccacacacaccaagctgttgctcatgccagtgtaattacatagtcgaacacacatacacaaattatcatattcctttaatcccagcactcgggaggcagaggcaggcagatttctgagtttaagaccagcctggtctacaaagtgagttccaggacagccagggctatacagagaaaccctgtctcgaaaaaaacaaaacaaaacaaaacaaaagagagagagagaaatggatgtgtaaataaatggaaaaaaagtcaccagtataaaacacatgcttccgtgggacggcagcctggtttttctgcttagtgttttcttttgctcagtatttagcctccatcttaattaaatatggcattaatggggtaactttcagctttcagaaagagttttcttttgatgataaagaagagcctgccaaccacaggagaggccttgatgtcaagtgcttagctgtgctccctaaaggtaagagcttctctacatggctcggcagggtctgagctcactcctccctgacacttttgtttgtggttcctccatgttccttcgttactcctccaagcacaagattcagtttaggggtctttcctgaattttgcaccccccacccccgtcagctactgctggaggctgagtggagaggagaaagcacacagtccatatcctctcttttgtctttaaccatcctcaggggcctgggaatgtagctcagttggcagagtgcttgcctagtgtgcaggacacctggcttcaccccaacatcacataaaccaggctttgtggctcaagcctataatcccagggtttgtgaggtgggccagagcagaaaaataaaactgtacctcacaaaataaagtcatttaggaatctagagagctggctcaatggcttggcagtggttgagagcacttgctctggcagagggcctgggattggttctcagaacccatgtggtggctcaaagccatctttaactccagttcttggggatctagcaccctcttctgacctctgtgggcatcaggcatcaacatagtgcacacacacatacatacaggcaaaacattcatatgcttaaaaaagaaagagaaaggatataaaattgggtgggtagggaagtgggatctgggaagtgttgggggaggggaaaccatgatcaaattgtactatatgaaaaattaatgaaaaatatgaaataaaattaagataatttttaagaaaaaagttcaaattacatttctctgaaggtagctgttctcttaagttcccattgttctccctctgcacctcccaacccaggactgcttcctttacctctctgcttcctcccaatataggtgatttatgcacaatagctcatagcttctctctctctctctctctctctctctctctctctctctctctctctctctctcacacacacacacacacacacacacacacacacacacacaacagggtctcactgtgtagccctggctgcacctgaacacccaatgatcctctgctcctgccttctaagtactgtgacacagtgtgtcgcaggtctggctttcagcacagagctggtagacacaatatcacagttgtcttttgaattttaaaaaatatttttatcattatttgtttgcattccaaagaacaactctgtgtatgtgaattgattctttcctttcaccatgtgggtcttggagactgaactctcaccctctaagccatctgatcagtctcaacagttagcttttctgagatgcttgtcccaccagcaacaggtgcacgtggagcaggctacctgagtgtgttcagaactggctcccttcgcttctgcctccaacaggatgtacacattgcctggccattatttcccccaacaataacagtagcatgaggaataatcacttggatccaaaatgtcagtatcagagcaatggtgctcttcctttagaaaaagcagattgagggaagggttttatttgttttttggttggttggttggttggttggttttgtttctgctcaaagggaggaaaagtttaaaagaaattagatcagaagacattttcttttaatagaaaccaaatccaatttcaaaggcacgcacagacaacctggaatgtatcctaaggagctaaacagatgatctgcccagatggcctcctgcggtcgggccctcgaaaggcgccgggtattggactgcaaggcaaacctaaacaagggcttcagggctgctgcactcatacactgtcaagtgaaatgcgtgctgcgtcacatgatgagcagagggatggtatacagaaccaaaggctatagatgtcatcggcaagactagaagcttagcacttctcaatatggagtaaatgtgccccaagattccagggggtatctgaaactgggacagtgctgacactgtgtgctactttctttcctgtgtgtatatatgtatgatcagatttataggttaggcaccacaagggatagtcaatttgtcacaatgagaactgtgtgatacagagcataaatggctggttctttgagaatacagctcaattcaagagtctgacactgtagaatgcaggctgtctgctggagagaaaatggcctgctcgcctcgtgtgttcaggaagggaaattgctaaacggtgttgggcgggggcaggactatgctctagcgggtttacacccagatgtctgggttgttgggcatgtgatgaaaagctgttaggagtcactgcagtggacacagacacccagtcacatccatgacaaagctgtgtttaacatctaggattatgatcaaaactaactataaaggggaacaatttggttccattgtagctgacaagaactgcccggcacaagtctatattttcagggtcatccctcctactacccgcccccctcagtggacgcctccttcttctgtcttctcccccagttcctctggataactactgcagtgagcaacgtgtggtcaggagacaggatgtgctgctgcctcctaggacttcacactgcactttcaacaacatagaaaagcagaagcatattgaccagtttaatcacaaaatttatagatggttatgaaaaataagtacagtttttccaagtcgacatggtaattgtatgtactaatcatattcatgtttcaaaactcacaagggtttagctctctacagcaccccaaaatgtttccaagcctcacctcaggccccagacttcttcacaacttagttctgatggtcttgatttttctgcaggtgtgtgaggaaagctggactctcggagggtctgtcagcatcctgtctgtcagctcttctcttagcagtagaatgttgacaaatggcctttgtttctgtgtcacttgctgctaggttgtcctgggccccagacaagcaagcactgaacagctgtatctcagagtcattttctttcagtgacagagtcacacgacctcattcactagcgagaggtttctgtttctgtgaagctgagtattaatatggtcatttttttttcctctcttggactcacagtaacatgtatcaacaagagaagagaataaaagtctttactataaaaaggccattgagatgcttaggccacagtcaccaaacctgcagacccagaaactacatggaggaaagagagaactgactccctaaaactgtcctctgacccccttacacatatgctgtgacacacatgaacccacaaacacacgtgcgcgtgcacacacacaagtaaataaatgtaatatatttttaaaataaaataagtctttggcttataatattataatattaaatagatttttcattttagaattaaatagaagtacattgttgtctttaacactgctattaaaatatagtgcaaagaatatggttcattgactcctgacacgttcaccgaattgtcagaccattaccacaatgtttcccttcttctaaaaggaacctcataccttcgaggcctcatcctcccctgcgattccgtgggggtcactcctaagctgcctgtctttgtattgcctggaagtcaaaccagtgtttagagcgcctctcagcgttcaggcctgttctttccagctgtcatgtgacagggaggagtgaggttttggcagcaccctagcactgatgggtgtttctatccaagctctttttctacttgagttggaagactaagatcaatactgtctttaccagaattccttagtctctcagaagcgtttgaagaactaaccatatttcccaagaaaagcacttgacagaacaaatcattctgaatactggtgttaatagtcttgcaatgaatgtctagcacatcgatgcaagaatgtgagagccccactctctggttcccttcaaggccttacttgaaaactcacccacaaactcttgccagaaatcgtaaaagactcggggatgcagaaggaccactcagaattgctcaaaagctctatggcagcagctggaaaatggatagctaggtttaatcaaaatctcagtgtattgaaaacaaatagaagatttccttctatggaaattagaccatctatggttgctaatatctgccctatatgttgacgactaatacaggcaacacctacaatttaggagcttcagctatggcacaacattctgtcaactcattatggatattgactctaactttatttatagcatgtttgtaaggaattcaaagcgaaggatcttaggataaagaggtatgctgcagcttattcttaagtggtttgagagtataatcaaagtgcccagaaagggaaagagggctaaactgaagcagtgtattgttatcatgtcatgaagggtgcctttgagacttctacttctgaaatcacataaaaactgtttagtgaatttaaagacagggttaggttaagattattttttcctatatgtatgtatatacactatgtatgtgtctagtttttttcatgagtgacatgagtgttttttctgcatgtatgtatgtgcaccatgtgtgtgactcatgcctgcagaggtcagaagagagtatgagagctccaggaactggagtttctgaaggttgtgtgggtgctgggaatagaacctgagtcctggaccaaagcaaccagtacgcttaactgctgagctatgtctctatccccatcaccaaaagttttaagacagatgacacttaaaaataaacactaggcacacttcagtctctaagcacaaaggccattttgaaaaatcacattatctatatgcagctttgagttgttaaaatggccactttaaaagcagcaacagaaattgaagtggtcactttgggctaggcatattagctcagttacagaatttaactaacatgcaggaggctactagttcagttcctagcagagtaacaacagttactagttaattaaatgctgtgtcttttttaaactttattttttacactccatattccattccctccctccccccacccggccaatctaccctctgactgttccacatcccacacctcctccccaccccaccccatctgccatgtggatgctcccaccccccaccccacctgacctttaaactccctggagcctccagtctcttgagggttaggtgcatcatctctgaatgagcacagacccagaagtcctctactgtatgggtgttgggagcctcatatcagctgatgtatgctgtctgtttggtggtccagtgtttgagagatcttgggggtccagattaattgagactgctggtcctcctacaggattgcccttcgccttagcttcttttagccttccctaattcaacaatgggtcatctgcttctgtctattggttaggtgcaaatatctgtatctgattctttcagctgattgctgggtctaaatgccatgtcttaattgcccctttattgcatttctcctgagtcaacctattaaaatgttaaccctaaactttcagtgttcaacttacatgctaccctttccctgacctgatagctcctcccctgtcctgatagctcctcccttgtcctgatagctctgccttgtgaccagacatcccctcctttcttttctgatgccttcaggtgatttttgagaattgatctagcaaagacagggacaggttaaaagccattctctgccatctggctatcacttcaaagaagcaatttcttgtcatctcggtctgccccatagtcagtgtccttctagaatcctcagccacagcaaagctcttttcctgattcttagtgattctagaagaatcacagtatcctcctagattatagtgtggaagcaaatgttaccacttcttccagtgaagccattgctgagactcaggacttgctctcaactgtagttaaagaacagctatgtactgactgatgcttacatataaatgacaggctgacataggagtgactgtgtgttcaagccaggagcttacagacagccctagggagttcacagcacatactttgcaaatgctttccaagctaaaagcttcgatacatcagtaaacataacaagaaaaacaaacaaacacaaaatccagcttatgaaagagatctcacaaataaaaataatttattttgcttgctgttttagcctgtctgagtttacttgctagcagagtggggtgggtgctgcatgcacacattacttgtctagtgtctcccttcctagctgaaaacaaacgagggggtctgagaaccaccatttgagtcctgtctggtgcattgctggagcgaatggaacacacacctaaccactaaacaccacactgtattttgttcttttctgctctgtcgtagttgcagaattaagaaaaatctttgaaccaaagaggaaagactttttagaaatgaaaaggtaaagtattttgtggtgcgcccctggtgggtggagacatttatcatggcattgtggagtctgtccatgggcttctgttcccaccctcactgtgcttttctttgctctactgtgcagaaaagaaagaattgctaggcgcttagaaggaatagaaaatgactcccagcccatcctgttgcagagctgcacagggctagtgactcatcggctgctagaagaagacacacccagatacatgcgtgccacagaccctgcaagccctcatattggtgagtaccagacagtgccaggctgggcccgtctcatgccagaacaaatgagacacctgagacacagttaagaataccaaccaaggcagctaatggaaggaaaagctgatcgtgactcagagtgttggggacacagtatctgacacggaaggcacagtgttggcacggggagggagaggaaactggtcacattcacccacaggcaggatcaggagagatgctgttgctgctcccctggctttctcttattcagtctgggatccagccccttgggtggtaccacttgcatcagggtagatgttcccttcttagtgaagcctctctggaaatgactctaaatccagtcacatcgatgaggaatattaaccaccccatcgaacaatagggaattgtgtgtatatacagttcttaaatattctgaccctcaggcctctctagacaggagcccaccagaggcaggcatggtgtccatctcttcacagtctcattccccaccacagagtctgctgtcaaagattgttgggaaatgactatctgtaaacaaagagtcagtcctgctgtggcctaaagttataccaagtgtccagatgcccaacaaagggacagtttctcgaagcagatgtgcaaagcaaagctggccgtgtatgattgcagccattactctcaggattcatgcaacagaggccttctattttcatgtgtcgaggtagtgcatattgattttcaactgtgtttcagctatgtatgacttggccttgccttgggcatgcctagtcatggacattagttacctaacctgacctcagaggcaacagtatactcacccagggctgagcttcacaggtctgtcccagactcaggctctcaggtgcttcttttagccattgttaaccagtttcctcatcagagggggctcacaatctcacagcacaatgctacagtttgataaagaactgtgtgaagagcaaagaatagataaaactgccagaaacaaacccctgttttcataatgtcttcatccatataacatataacctaaccatcagagatagtgagcaaattcaggcttggtttttagatgtaagttctgtagcccaggctgactcagactcaccgtcctcctgcttcagccacaggctggtgctgtaggcgttcacagccatcctcctgcttcagccacgggctggtgctgtaggcattcacagccatcctcctgcttcagccacgggctggtgctgtaggcgttcacagctgtcctcatttacactagggcttgagctcgtccggagggggaggaaaggacggattcctctttccagttcattccaacctcaaaagtaaattctggttaatcttgttataattcaaaagaagtctttggaaacctgtaaacatagacatgtatttcatacaagtggacttaaatgaaacagctgaagaaatctccaaatgaagaacaagtcagtatttcttagagcagtgtagaaattgattttacagcctagcaagtgacttaagggtctcaaatgttctcaaataatttaacattttttgatgtgtgtgcatgtgtgtgggaaactggtcaaagccacatctgtatgagcaattgccatgttgagcactatgaaaccacagcccatctctctttttaaaaaaaatcacagaagttcccgtatctgctatgttttctagaagaatctgaacttgcccattggccttgtgtaaaatagtaaactcaaaaacaaaacataaaaataaaggggaatagaagctgtgtccggggagtgtggggggcagatgacagcctagttactggggccttcaggctgggccctctgagctgctccgcagtgtggcggactctgcgttggtacacatgactgtgcttggcctcctctgttctatcttgtggtctttttgtagggcgatccaaagaagaggaagacactcctgggtcctccctagaaaagcaaactccttctaaatactgcatagaaacctcaggcatccatagttcgggctccatggacacccacagtctggagtccaaagcggaaaggatcgcaagatacaaagcagagaggaggcggcagctggccgaaaagtacgggctgaccttggacccagaagctgactctgaatacttgtctcgatatgccaagtctcggaaggacccagatgtgactgagagacgaggaaaaagtgacaagcaagaagaacagagcaaggatgccaattcccggcactccaggacagagtcagggcccaggaccagcttggtggcgtcccaggactgtaccccgctgggaagcaatatgtctgaccaggagcagctgctcaatgtggagaaccagagaagagtccaagatcccccactaggagaagatggctcctctgccttcttttctgagcgaagcatttccttccccgaagtgcccaggtctccaaagcagatacccagctcaccactgcaacagccagcctccccaaaccaccccggtgactcaccactgcccacagaggcccgagccaggtaagcattgaacatttgttcttccttggtgatcacaaatgcccctaggtctcctcactgcacagatactttgtagtttctgtagtatccagacagattctgtaagagctagaagcagtcccttcttcctctatcttccccctccctgtcagtgccttcttttcaactaagcacggggatatttacatagaaaccctcgtgcaggattattgctgcatttctgacccaacaagtgtgtgtgtgtgtgggggggggggggtgtctctgtttatagggcagagtctgagtgataaaaatatttttagtaaggcattgctacataaatatgtctgcagtaaggagaaccacaactgacaaaaaggcctggaaaaatggaccagccaaacacaagcccagaaatcaaatgacagaagagactatgtgtttgtttctatatttaagttgaaaaaattcctatccatgttaaaacattgtttacttaaatacctggcttaaaatgtaagactggatgtctgggtagattcctaaagatcctttcaatccaaaaaagcaacagctttgtgggtgaagtgagaagggctgaaaacctagagtcaagtaaatttattctgggggaataattgtatgtgatacacagatatatgtacatatgtatacacacacacacatgtgaacatatactcattgtattcattttaagtacatgttgggagcatctttttattagttttgctggaacatgatggtaaatatctactccattttacatggccacaatgaacccaagggaaacattttaggtactgaagtttaataaaaccaatggctgtctgtcaccatgtcctgtcacctttctactggaggtggactgtacaagtgccctctccccgctgtagggcgtttcatctaaggttcctccctttgggtcctgagagcctcccacctcccagatctctggtacattctagagggtccccccacctcctacctcccaaggttacctatctcctttcatttttctgctcccccagaacttcactgctgttccccccaatacctgatcatgttcctcttttcccttcctctctcccctctcccatctgtgtccctccctgcctttgcccctggtgattgctttcttctccctcccaagtgagattgaagcatcctcacttgtgggttttattactacattttatttatttattttgcatatgcatatatgggacatgtgtgtttggagtgtgatgtatgttgtgcttgtgatggccaaagaacaacttgtagaaatctgttctctccttccagtatctggggcctggcgatcagactcaggtcagcaagtttggtggcaagcacctttacctgttgcacagacacgacagctacccccacccccagatgttttgtatagagagcaaagatacttacttagaaaaagtatatccatctatgaaaatgaaaaatctaatctctgttttcatgtgataactttgatatcacttccttctaccttgaaatattactggtgaaataacagctttagggccacattgacctctgtgatacacttgttttggaattatctagtattccataaaatgatggagaaggcttgtgaatgccatgttggatagagggatagatgctgtagcatgcccaggattgatccacattttattgggaaggaaatgaagagtacacatctaagaaatagggggctgtaagtcaggcccagccatcccgtgcatcatctgaagaaagctgttcctgagatgagctgttgcttgtgaattcagcaagtgtgagtgtggaagcaaaagtgccaatgctttctaaccagcaatactgtattattatcagcatgtgggttattcagccttttaaaactatgaacacctgctcctaccaaggtccagaatcccaaagcctctacaatgctttatccaacttttatttccttattgaaaaataatgttattttatgtgaataaatgcagaaactctctccctggggtccccagctgctgtgtccctgagcatcacctgttaccccattctcaatgtgtcatgtgactaaagggagaagcatgaaattcaacttgacaccctattctgagcagactcgccctagaaaagccttgttcattagctctttctcgctgtactccagctcctctccagctctgcatctccaaaatgctggctcccttagtgcttgaacctgacagtaaagacttgaccttaggagagctgcctttgtggcttatgacccaatcagtgctcgtcttgagcacctgcacacaaataaatcatacccccttccctgagatatggtaacactatgtagccctggctgacctgatactccctatgtagacaaggctggcctgcagaacttgcagaaatctacccatctctgcctctgcagtcctaggattatggacataccctcagtgccagagtttggtagcctgactggtgtctttgttacttctcagaactaatccagctttgaattccatatattctaggagnnnnnnnnnnnnnnnnnnnnnnatatatcagatcacacatgcacagacaggtgcacgcgcgcacacacacacacacacacacacacacacacacacacaccatcagcctgagtgtgagctcgtgtctgccctattggttgccttattcagagatgaaaggacaacataagctggtccagaaaggtagagcagagaccgcacatgggcattcctccctcactgtctgctcatctatttcctcatgagagctttgagtcctgaagcagtctctagaccctcaggtcctcgtggttgtggttgctcctcaactatccatgccctgtggagatgtctgcagcaagctgtactgcctggcattcattctgccttgactcccattagctctaggcagcagctaccatgtcctgtggacaccagggtggagcatggcaaacagatctcagatccattctccaaaaagggatcttctgccattctactgctaataagtggttcactcactgtctttctgattttcatttaattctgtccttactgacaagcaccagttccactgacttcaatatgaatatgttttctgaaatgtcagcctgtaatgtagagtagctggtgtgtgcatgtgtctaggagtgtggccactgctgtagtcacacttgtgtgcacagaaacagtctcccacacaggtaactcatcagttagctaaactagatgagctgagagaaccccgccctcctgtaatcagagctgcacgagactttgctgccacaaggttgtgtttgctttctttttacttttgggacaaggttccactgggtagctcagaccagctacagatggggagggagttctacttcctgggaacacagttctccactggccaatcacacatcaaaagccaatccattcacctggagtttctgcttccttgtttctctcccagggactctgcagtcctctcccagtggaagtgccctccgcacaacagggtcttggctcactcccaacgcctcctaaattaattctaagtctggatagtgtagctcagttgatagagggcttagatagtacacatgaaacccagatttgtgaactaccacttcctgttcgtgcagtgacacttcatacctgtgattctaagacttgggaggctgaggcaggagtaacagccattcaggttcatccacgactattgtgtggattcaggacaggcttcctgtgttttctctgtaaatccttaataagaacatatggtctgtggtagggtagttattcctcctgtagctcctttacctttacaggtttcccttgcctataaattttatcaaaagtatctcagcctttttaatgattgcgagtcattccattttgcactttgtttgactgagttaagagccagatgtcttgggagatgcgaggcttgtacctgtgctgcctctcggagtctttaatgttgtgctttataggaatgagacatttgtctgagggacacaggttacaaactgacatttgtaactgatacaaaaagataaaagggaactgtgtaacagacgaagattcactctggccaagtttctctttatttacttccttcctttggtgtgtattttttatggacactttttacatttgtctctttacctatgtatctcaatgaaacttaaagttaagtttccttctattttaattccaacttcctgtaagtgtaaacagagtatgactataaccactcttatttcagtgactaaagcccattttctctagtggctttagatttatttattttcactacttgctttttgtagtgagccaaatgaccaaaatcttgcagtaagtaaattaaaactctaaacgtaccatgtacttactgtctttccaaaagccagcttgagtatctctttctaaaggcaatctttggggtttgctatggtaagatgatgagggtacaggcatctccatttttatagcaatgtgctaaacttttgcttcttgtgcacagtagtacagggaagcccacacatgagtggtttctgcagagagattctgaaggcgatacaccttcacttatcaactggccttccaggtacatccaggttggacgtgtgtggctgatgctcctccccctcctcccatcacctcctctgctccaccacacttaactaacagtcatgctcccctttgcaacgcctctggaaatcatgtgttcaaaataagccgctcttagtcatgttcccagattgcccttcccacgctgatattctccttcctggttcatttgtctttaacttaacacacttccttgcttgctcactttctcaccaactctctatagaactgccaacagagggcagtaacgagcacctcctctggggccaccctaccctgcccagatcccttttctgcaccagctttaattttcttgtttctaacccagtgctaagttccaatagttaaatctagggcatgtgacctaatagcagacaagaactccaatcatttcatgatggaggaaggaggaagaactaagaatgagcaagtcactcaccagactcggtcccgtgtaccgagtttctgacactgactttgttctcttgagatctcctcagatgaggaccacacattccatgggggtgggcgcgggcttaactgcagctctgtcttctgaaggcgccctccagtgctgcctagtctcagaaagccacagcctagagtgcttttttccaaacactcacactaactacctttatgtgtgtctttggtgtttcctcaaggaagtctactgacactgctctctgtatttgaaagcagagcgtgttttatgaatttgataggtcaaaggaggcctaagcaagacaatttaaaatgtgtacattataaacagtcacttttgctcactcacctaagtgaaacgaaagttttacattttcccgtaaatctcttgttctatcccaagagctctgtgtactttttgaaagttgtacccggtcagcaaccacctcaggtcagatggttttccctttcataaagcacagagtgagtagcatctcatgggtgctaatactgatgactgtgtctcctttgctaagtaggaacacatatgttctgccaaagccgcgttactttgtgataccggtcctttctgtatggtggggaccaaatacaagacctcgcacatgctgggcagcacggtcccccaagcccattgtttcctctaacagtgaagccctgggctgggaaggcaggtagggccccagcaatgcctctgggcttctgtgaacatgggaaggagccgcagcttttgacttctttttcagttttgctctcaaatacttaaaattagaaacaacagctaacagttcctccttaggttgctttttaattaggatgcggcagcagtgagggtcgggggaggatgggggtggggggataagggctcacaattctcttaacaaatacttcttcctaacactctcatggtggtgtggctttgattaaagacatccaagctagttctgttttgggatcagatgatgtagtcagctgagcgtctaaagcctgtgtgtgttcagtgctttataaaggtgatgctagctcaagagaaagcataaatgaccacaaatgtctgcatatttgatggccagtgacatggcagcatccttcaccctgatgctcacagtggtatttatgaatgaagcttcctgggcctgctaggtgtttcactgggaaaagcccgttctccctcaggacagcatgttaactctcaggtttccaggggatggaacttttggaccacgttagaatatggatgcaaatttggcaggtactaggtgtctgtgttctgtgcccaagtgtgttttctcacgtgcgctctgcattgattccaatgctatctgtgatctatgcatgcttactttcctccagtgattactgcaactcgcaacataaatcccatttctttcttaagagttaaagttagagaaaaattggtgaaagaggagagtgctcgcagcagccctgaactcacctcagagtccttaactcagaggagacagcagccggcaccagcacatttcctgcctatccagtcagaaagttccacctttgatagggtcaccagcaaagcagtgagctcattgcagccaagccagagtggtgttctgccaactgaccctgttcatgccatcaagctggtgaccatggataccccagaaagcacatctgaattcagctgggtggggtcagccaccccaaaagttataaaatctaccaccttgaagattctagaaggtggttcaagggatgctccagtactccatatttgtgagtcaaaagcagaagattggctctccccagaacctctggagaggagccccaagtcacttttgacctcagaagatgacaggctcgtgagaggccacaaagatccctctggtaataaagacttggacaaggccatcatttgctccatcgatgtagaatctgagagggagcggcaagttcaacacctgcccactcagagaactggccggagtgaaatgctcctgtatgttcagagtggtcctgtgtcccaagatgccacattgaccagtcacacaaaggaggcatctccaaagaagcgcaaggttctggcccgctctctgtcagattacacaggtccccctcagctccaggtccccagacacaaggatgaagccccaagccaggagctggagctgcagagttccagggcagaagggcctggtgcagaagccagcgtgctggacaccagagtctccgtcgcccagctccgaaacatatttatggagtcaacccgagccagcaagaaacctgaactgtaggtgatgttcccagcgtccttttgatatgtcacttgcacgcccttggcagacaattcacatctccaccttggtgtgtcctgtaggcttagctcacaagtgtgtgcagggcagagtgaacaggaaatggctcacatactaccattctgcttctgcctactaatggggatctggaggagtgggtctctagaatgttccacatgcagatggtgcatggtagcagcatgtagaaccgatcactgtcttgactcactgaggatacataaacctttcctctctctctctctctctctctctgtctctctctctctccgtctctctctctccctccctcccctccgcnnnnnnnnnnnnnnnnnnnnnnnnnnnnnnnnnnnnnnnnnnnnnnnnnnnnnnnnnnnnnnncaccactctctctcccattcctccttttattctccccctccctttccttgtattgcactcgatgccttgtggtcttaaaagccaatcccgggttgagaggtcagctgaaggaattggcttgcccatggaacgagagagagggtctcggaaaccaagacgctatctttctcctggtgaaagtagaaaaacttctgagcgatttagaactcaacctataacctcagcagagcgaaaggagtcggataggtaggcatgtgtgtgtctacttttagctgtccaaacacaggagttctcactaccctggagggcctgatggtatttgcataggattctagaattactccatctcagctacaaggataacttcttttactaataaaatgtatttccaacgaatgttgcttttctatctcgtatcgcctactggttttaagctgcccacagatgaggtgagaagaaacacttctcagcgcttttagacctttatgctccccttaaacttctgtctgaatcaagcatctgccactgagcataaggaattttggactcatcttagaaacagcttacttctaaaatttacatttttgtatgacatcatcatatgcaaattatagaaattataacgttctccagcagtctgtccacagtccccatgtaataagttcttgttgatactaccttttttccacaaggtgtgcaccaggctggggttgtgtgtacacgctccacagcgtcagctaactgttgcttggtaattgcagccagagctcacgccagtgtgtctctaaatctttaggctggttctaaatccagccagagctcacaccagtgtgtctctaaatctttaggctggttcacttgcatggtgttttgtgtgtagcttgtatgtccaccactaaccaccgtcattttctgtccctgtctttcctaggtacccttctggttcagaaataccagtggtcgagggcgagtatctccttttctttttttattcttttacattttgtccatattaaatttaatctggacctaagatgtggggctttgtgggcgaggaaacctggagcccatcagtttcttgctttctttcaaattgccttgctgtgaaccctagctgaaatgctcaggtaaggctgcccttagctttgattaaaattaagaggtttgttcagtgaacaacatggaacagctgttttgacttaaaaaaaaaaaagtgttttacgggtgaccactgcgccattcttcagcaaggcggtctgctcctaggacccattcttaaattctcttatacggactattcagtaaacatcactgtctggacagtttggtttgaattgcaatgggaattagtactagtcactgaagagaaggcatgggctcctggaggtgagacatcccaattatgatgtcagttcctctcctcctggattcaagggatgtccaggttagtcttgaaaatcctttcagagatgagcagtgctttccattggagttcagttttatctcatggcttttacagatgaagaaaaggtggatgagcgggccaagctgagcgtggctgccaagaggctgcttttcagggtaagctgtgccaaatggcttagaaaccataactcctactgagaaagacaccccgggctctggtacctcacacacgtgcaggagcctcagggtttcctcaccgacagtgcctcttgctctcttcccaagctgagttaggcagtgtccctttactgtaacagaatacctgagattgtcaccttttttaaaaaattaaaaagtttatcctggcacactacttcagcagttctactgtatgagcatcgagctgggaccaagcaagcctttaccacggaacatcagttggccttctcacaccatgctgcagaatctgtggtgacttggtttggccacccagaagtgttccttctcgtggcctctcactgctgtcccttcctatcaatcctccaggaaagctgtagacactttgttttttctttgaattcatctgatctcacaatgttttctaactgcaggaaatggagaaatcctttgatgaacacactgtcccaaagagacattcgagaaatgcagctgtggagcagaggctgcgtcgcctgcaggaccgttcacacacacagcccatcaccacggaggaagtggtcattgcagctacgtgcgtctcttggggagttcttagcctggcctgtgccctcatttttaaagggagattcaagaattttctataagactgaggcactttagctagaagccatagagaggcgtatatttcatacttacttttagtttggttcggtttcctgccattaaaccatgatgggatgcacctgcttcaggtcctaggcatacatctgaagtgtctttacccctgtgttttatctttcacaatgaaaatatgaaacatgaaagtagagtaacaataatgagcctgagcttcaatggctgtcagtctctaggctgcccttctccacgtgcgttatcttcagccacaccatggccatttcctccttaaatattttagtacatacctctaagagataaccattcatcttgtctttaaatcattgccaaagtgtctaaaaatgaattggcggtttgacactttccagacaacaggaggcctgcactggggcagtgtgctagtgtccgagattcccttgactgggccattcacagttagctgatccagtcaattgagagtgtgtattagtttttaaatcatatctgtggagtggtgacatccctaaggacctctgcctgcaggtttgctgttggagcctgttgtgaggtcattggccttcatggcgttccccgaccctgtgcactctggacaatgctttaccactgagctacatcccagccttaggctcctcgctttcctgatgtgtgtgtagacaagtccatctgtgcatttacccatgactcatagcatagccatttgtttacagaataatgccttgggttggctctgaactgtggatggactcttttggccagctgtggttgatacttgctttttaaatgacttcttaaaatgagattgtctgttctaagccggcttttcttccagcttactcctctgcttgtccgtttactctgggaggcccatgcctcccattccttccatctgtgtcgctttccaacgttcttttgtgattcatttcccctcaaagtgtttagcaaatatttttggtaaaatatttgacttttgcctctccagatttacagctctgccttctttaatgcttcttttcttctctctcctcatgaatgctcctcctttggccattgcttttaaagtgaacctatccctgcttcgtgttctggggtcacccaccctgtaacggcgagacttcctagccccactgtagctagaagcagtgtgcagcctgccaggtactggacacacatagctgcacgtagcgcccagtgccacggtgcaccgggaagccttgaattcatttgtctgacaaacaagtcagtctagtgagtgtgcctggggtgcttgatgttttgtcatagtgcaaggtaacattaacttcatgactgtgtgagaaagatacatccgtctgcctgcttcctgtgttggcactaactaaggttgcactaactcacgtatatatcttttttaacataaaaatggtcatttctcaaagactttatttttcatctaaaacactaacaggcaaagactaattttaaaagggagcattaacataaaattgaaatgttggcaagatctagttacttttaaatatgtatacacacaaatctagagcaaaaccaagtacttgtgtttgctgatttggagagagaaagaagacaatgcctttagattttaggactggctgtagaaatgacaggattcggtgttttaaaattgtgttcataactatataaataccactttgtcttaactgtgataagccaaaacacaagagctaaaaataagacttgagatgttccatgacagagctagagtaaaccagcctcatccagaagaagggctggtttgagaaaggtttgttttttttttttgtcctccctggaagtctcacatcttcaggcgtccatgctttctcacttgtcctcatgatgtcaggacacaaagactgcctgtctgggactgcctgtggaacagtgattaataagaacgaagacagagtatccttcttatacaacaaagttgcccaaggcacagacagtgctgtcttggagaatcatgctgccctcctggcctggagcctcctcctctccctcacagtggaagctattatcattatcattactattactgctgttattattgtctggtgctctgcacatacccacccagagctgtgctaccatggcgcccacagtccctgctgggattggcagatgtttaatcatctgagatcttcttcacctttcaagttacagaggattacatttaagtaactttggaaattggcagaaacctgggagcaaagtgtgtttaaaccacactttgatagagaaaaagctgcttttctgactttgtcactgacaggagaccatattgttcctaactattcaaagcctcccgagcggcatctacagagggtgactgaagcagggaatggccttgtgcctttaccttcagcccctgtgataggaaccatccaggatttctctctaggaaggtagattaggctggccccagttccttcaacaggagattccctttatagatatgatttagagctaaatgtccgcctgtctgatggtgctggtgtcctatgctggctctgctactcactgtcttgtttagtaacttaacagctgcctgcttctcgcccaaatccagtagggaaaatgagccccttacagaatacacaacatttttaagaaagttaatatataaattggcggtaggcatttatttgtttttcttcgtatggttgatttctccttccttgcttctaggttacaagcatctgctcaccaaaaggctttagccagggaccaggcaaatgagggcagagagtctgccgaaccaggcgaacctgattcctccactctgagcttagcagagaaattggccttgtttaacaaattgtcccagccagtctccaaagccatttccacccgaaacagaatagatgtgcggcagaggaggatgaacgcaaggtaccagacgcagccggtcactcttggagaagtggagcaggtgagtgtgtgtgtgtgtgtgtgtgtgtgtgtgtgtgtgtgtgtagggtatgtgtgtagtgtgtgagtgtggtatgtgttgtatatgtgtgtttgctttgtgtgtatgctgtgtgtgtgtgtgtgtgtgtgtgtagttatgtgtgtgtgtgtgtagggtatgtgtgtagtgtgtgagtgtggtatgtgttgtatatgtgtgtttggtttgtgtgtatgctgtgtgtgtgtgtgtgtgtgtgtgtagggtatgtgtgtagtgtgtgagtgtggtatgtgttgtatatgtgtgtttggtttgtgtgtatgctgtgtgtgtgtgtgtgtgtgtgtgtgtgtgtagtgtatgtgtgtgtgtagggtatgtgtgtagtgtgtgagtgtggtatgtgttgtatatgtgtgtttggtttgtgtgtatgctgtgtgtattgtgtgtgtgtgtgtgtgtgtgtgtgtgtgttttctttgaatacagcaatacaagagctgtattgctcttgggttcatggtacaggacagggtcagcaggtgagcctctaagtggcttcatcttcccatctctaaggaagaaccagacccacgtttgctgattcctgttgttcataacctgcttgaaatgagtccactgtggttgattataaaagcaggggcaagctgcctgcccaggtttgtttgtgatgtgttctgtgttttctagtaagacgtgacaggaggccatactgcaggtgcattatccccacccgtgccagtccctcaggtgatgatgcttctaaactgtgtccctccaggtgcagagtgggaaactcatctccttctcccccactgtgaacacctctgtttctattatggcctctgcggttgctcccacatatgcaggggaccttcggaagctatctgttgacaacaacacaagtgccactgactataagtctcctcctgcggaaaactcagactctccagtcagaagcattctgaaaccacaagcttggcggcctttggtagagcacagtgggagcaaaggaatgccgggggagtctggaaagacagaaagcaagaatgctctgactgtggctgcagaagacagtggcgttcaaacacgaggagccttcgaggaggaagaggagccctcctaccccatccttggcagagtcagggagggtgatggccagaaggagcctaagcatgtcgtcctaaggaggggaagcttagagctaggcaatccttctgctgcacaccttggtgatgagctgaaggaagtttccactgctaaaagcagtttgcaagagaatctagacctgaaggataagcaggcctcagaggagaacacagatgtggaaactgtcatgaggaagttctcactgaaaggtaaggtcctgcagctaactcccaggctttctggagtctttctccagtctttctgcagacttcctgcacatgttcttattgtttctggttaactaatctagagacaggttatcactagaatcgatcagaaggtcagtgaaccatagtcctttccccagacctctgttcccctgaatctgacagccagtgaactaatagagtttatgacagcaaaagtgtctgcagttcttaacaccctttgataagggtttcgggtgactggtgacattaactcacacaatagccttctgagctcctgggctgtgttgaccccttttactaaagttgatagcccaaaagtcctgcacccagtaagcgcagagaataaggacttgaacctgtgtggtccccagactcgtcatgtatcctgatcatacagttgatgtactgtctgcattagagactggcctgcttgcattgacacacgttgatcgaatgtcagttgagacgagcttgggttgagttcagctcactagaaatgaagctgtgctatttaagagaagtaagcccactggcagcacagctgactcaggctagctttctctcagtggcttgtgctacagtggcctgggtaaccccccatgtgcacacagcctgactctggggtgcagctgagaagatgcttgcctggggactgatgttcactggctctcattctcagagtttggagaaacgacttctgagcagacagaggtggctgccaggaaggcctcggttcagatggcgaccccaggggcctggaagcagcaggagtcctctgagcaactagcagagaagctcttcaagaacccttgtgccatgtttgcttctggagaggtcaaggtgccagtaggcgacagtttcctggattcacccagcaaaaccatgtcaatcaaagaaaggtaagacctctggtgataggcaggcatattgtggagggatgccaacgtgctgggctatgctgtcatgctaaaacaaccctgggaagccgagcatatgaacacgggatacacctcgtttagcaaagtccaatccagacatagaggaaggataaacagagacacctttttgtctatggtctctgatctaggctctttctcctgcaggaacatgtgattcaaactgcaggtacaattgccttctgatattctggggaaaataaatataggctgaagatagaaaagttcacacagaggatctgtgccttagagattagaatctgtttgccgtatattataggaaataagatgaattgcccttctctaaatttttgttacatttatttatttggatttgtgtgtgtgtgtgtgtgtgcttgtgtgtgtgtgtgtgtgtgtgtgtgtgtgtgtgtgtgtgtgtgtgtgtnnnnnnnnnnnnnnnnnnnnttagagaaaaattggtgaaagaggagagtgctcgcagcagccctgaactcacctcagagtccttaactcagaggagacagcagccggcaccagcacatttcctgcctatccagtcagaaagttccacctttgatagggtcaccagcaaagcagtgagctcattgcagccaagccagagtggtgttctgccaactgaccctgttcatgccatcaagctggtgaccatggataccccagaaagcacatctgaattcagctgggtggggtcagccaccccaaaagttataaaatctaccaccttgaagattctagaaggtggttcaagggatgctccagtactccatatttgtgagtcaaaagcagaagattggctcttccccctccctccctccctgcccatgctggtgagttcacctagaattttgtacctgctagacaagcactttaccactgagctgcagctctggcctgaaattttcattaaacagtagctgtgggatttcatgactcacttgcttgttttcagtaaactctagtgtatctgtatctttctttgagttatatgccctgaggggaaactcttctgttgaaagctggactgctgtggagcacagcttttttgttgttgttgttttgttttttgttggtttttttgtttgtttgttttggttttgtttttggtttttttttttggattttttttttgagacagggtttctctgtgtagccctggctgtcctggaactcactttgtagaccagtctggcctcaaactcagaaatctgcctgcctctgcctcccaagtgctgggattaaacgcatgcaccaccacgcccagcaagcacagcgttttaaacaggctttgtggggacttctgtgaactacctggaagggagtcctgatacagggattcaggcagtatgcacctgttcttacctggagacaaaacctctaagagagattccaaatctactctgaatcctggcaggaatgcttgcaaaagattcagctaccccatttcattgtttttgggctttttaaaaggtcaaggcccctttgttcagcaattatgttggctatcataaagtatgttgataggaaatgggtcacccatgacctccccttgtgccttgatggtacttttgtgtgtatatcactggaaatacatctatctttaccattcatgagagaaggttccttaagtggggactctaatccttctcttcattgaatgtgaagcttgatcgagtgagaggaagggatattattcaaacacttatttaggcttttcttttctttcctagaatggcatataaacttctaagtctttcaaaccatacttagttcagcaattctgactgcctcaatttgccaaagaaggtgccctagtaagagtctctcttgctgtgaagagacactatgaccatggcaactcttaaactcctttaagttgcttctgttgggtaattttgttacagcaatgagaaaaactactacaatatctagagcatctagtttgaactatcaacccgaatgcaaattgggattcttttcctagtggattaacaaagccaccattttatcactctctgaaagatttgagaacacaggaccccccttttaggaacaatttttaaaaggcattaaaattctgtaagttagagatggaagcctgggaagtctattgggcctttccagtcacaatcccatctccactgacttcgactcatctgccccactccactctgggagaagatgaccaaaaagcaagatctgccctttccctgagggctctacagactgagacagctcctgtaaatattggagaatctaccccttatggagagggtggagagaggcagagatctgccttagggattagctagggtccctgtgtacatgccccttcattgctcctctgcaccctacacagcctgtctccacgtctccccagaaaactcctgctctgactttgagctggaagatttcagcttccagtgagttctcagattggcgtaggaatagagagaagtcccacctttatttatctttatttctctgtcgctgattcagcctccccgttctggtgctacaaagagtatctggggttgtgtaatttggaaagcaaaagaatgtactttggttccgagttcttgaaaatgccatctcaggtagagggtctcctgccagtttagaacatggaggaagctcggatcagctcagtcagacctttcctccctttaacagctacctaggaagattgttttgaaggagaagaaatttatgttcgctgtctctgatgcttctgggaacccaggaagtggagagccaaaaggaaagggctagggcttccagtgaccactttctcccagtaggccccacctctagagatgtctaccacctccccaaaatgccattaaaccctgaaccctccagggaattgattcatctactgagggaggctaaccctagtggtcccaccaactctcaaggattgactccaggggaaacatctgttcccaaacaaacaaaccagagtccagaatataaactctttctcaagaaaaaggcattaatccttttaagtatctctttatcccctgaagttctgctcaggacaccatcatgatgacagttaacatgtgtgtgagagaagcatattgtactgatccactcgatagacaggaagggctggggcctgcctcggggtagagttcatgcttagcatttactaggttccagcctcaatcttagcaccagagaaattcaaataaataaaaagcaagtggtcgggtagattgctcagaatgtaagtgcttgctgcccacgcttaaggaactgagttagaatccctggaatgaacatagaagctggcacagggcagacatctgtgaccccagtgtttgtgagtgaaacaagacaggcagatctcagggcatgtgtacatatgcacacacacgtgtacacatacacacatacacacttacacacacacacacactgcataacatcagaagaggagagaaaggagaagaaaaagaaaacataactagaggctagagtcagggcttggcacagaactgatgcttggatgtgcaagtcccaggttcagtctttagcaccaataaaaataaatgcagaggaaaagcttattatcaatatcaactcttctgactctcttgtgagcaagaccataatccaggtagtcaatcaccagtgctgctcagcctaaatccatgggtgtttctgtttctctgaaaagtctaaagaggaaatacaagtacctcagttgatattagaggcacatggtctgcctgtcccttgcttgacccaaccctgactgttacaagcctggaaaaacttgtcctcatccagcaggctctcaagccagaattcctgctgaagatcaggagctgtggcaaagcctgggaagcacatgtggcattggccctgggccaggccagtgtattcgcaggctaatcctgtgccacccactgggtatggagcctccacctaagcagatgctcgagcactcctcgtcctggcccacaaatagcccttagacttggcaaatgttgaaaatcgctggcaattgttggcactgcacgatggcaatttgtgtcatgtgttgaaccagaccttcgccctctgccgtggtggtgaagggctatgagaccaccagagcagagaacaagactcgaaaggtctgctgccctccacagcttgctgggcaccaaacaggaaatcagaacggacaggataatacatccagtcactgtgtgctgttagtgtaaaggagggctggggcaattaccatgtggctcaactgaaaccgtttctcccatatcatttgcttactgtggtgtctttggaagtttctaatgctgaaggaaccaacatattgagaagcaacattttcagggctttagaatggaatagctctgtggacgctatcctggcagggctgggagagcattaccagaaagttggaaagttctgcttttcctgacagaggtgggcactgtgtgtgtgcccagctcagctgctcatgggaggaaaggcctggtactttggaatcacatccccctcccactaacatgctcagtgtgggaccttgaccggtctgcatctgcattcttatctggatgatgagaaagaaacatgcagtttcttagtgaggtctttgcacatcagtggagtgtaaagaagatgacagagtgattctacattccacaacttacttgagcagccccaggggatgccatgtttttgtggagaagcccttgcactgtctgtaacagtctctgcccctgagagtgagggtttgcactctgtaaatccagtctgatggaggtgaaggactcctccatccaaaaatacctgctctgagtcaaaggtaacatgagagagcagctggttttgagggcagtttgcagggcgagtggtagtggcatggctgcctcctactgtttatggcttggacatagcctgttccgatatgaaagcctagcacactcatcagctggaagacatcccctggtcatggttattttgttaaataatttgactttttgagattccttttcttattgcaataaaatgggcacattcaaagtaattacaacataataaataatagttattattatatcaataaaaattgaaattaaaacatgtgaaggaatccagattttgtgttcaaatacatgcagcagccattctagcattggagaactatagaagtcaagattagatggtatctgagctgtgtgaacctgcactagatattagattggtaaggcagcccatacacatttatagaatgagcctttatggtcttatgagctgccacagacatagtactgagaaaacagaaaagaaggtagagagtaaagagaagatagatgccaagtgcaaagttatgcatcgttcaggaagctcttcaaagctgcacattatttgagagtggtgtccaaagtataaaatatgataatgcatgcatacatttgtaaatataatggattcttgtttatcatagaacgtggttccttattttcttaacaaaactcttatcatatggagtccagcagtaggatatgtgccaagaatgattgagaccctggattctatccaagaactactagcaaatgattggataaactattatcacagagtgtaaggcatcctaactccagttcagatattggatagaatcaggaaatctagcactcagggccttgaatagcctcatgttcaggtcatgcatgacaaactaggcaaggaggactggtcagcctgggggatggggccactatggtggagagacagagggaagcaccatctatgacaacaagcgcttctggcatagcaggaccagcctagggccaagtgttcaaacacacgagcctgctggggcattttatgtccaatcacaacagtatccagacccagactgcagctgattggctgcttgtcagtcgctgttttgggtcatgtacgtggtcacaggcatggcctgtcagaaagcacaagggagtggggtttcatgacctcaattctttactccacacaccccccctccagcctttaagttgtttgaacaccagcctcagtgaatctcctaggcctgtccgtttgtctctcccaccctgttgaacttaaatggctgagatgttttcctttatgacagcacactgtctaaaatagcctcttgttctgcaagatgtctgctcacacagaaccaaatgtgcaagcagctttagatgaagtgcagctgtgcctcactaaagtgtgttgctaacactgtcccttaatgagatttcttttttgctatattttttcccttggagaaagttgaactaataatttttcaaagagtgtctttagaaagtagtttttgtgttaggacgcaaggtaaagacaaaaataatctagaaggaaagacagggcttagaagagagcagtgattagtcatcatttacctttacttgaagtagatgccaagatgctgtatctttgtgtttttattagtatgcttactgtatgaagtatcatttcattgtgacatttccacatatgagtaaagtgacctcccctgttactctttcctattcttcaaaggtttttttttattagatattttctttatttacatttcaaatgctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagttcatattgttgttcctcctatggggctacaaaccccttcgactccttgggtactttctctagctccttcattgggaccctgtgctccgtctaatagatgactgtgagcatccacttctgtatttgtcaggcactggcagagcctctcaggagatagctatatcaggctcctgtcagcaagctcttgttggcatccacaatagtgtctgggtttggtggatgtttatgagatagatctccaggtggggcagtctctggatggtccttccttcagtccctactccgaactgtctctgtaactccttccgtgagtattttgttcccctttttaagaaggatcaaagtatccacactttcgtattccttcttcttgagcttcatctgttttgcaaattgtatcttgggtattctgagcttctgggctaatatccacttaccagtgagtacaaatcatgtgtgttcttttgtgattgggttacctcactcaggatgatatcctccaggtccatccatttgtctaagaatttcatgaattcattgtttttaatagctgagtagtactccattgtgtaaaggtaacacattttctgtatccattcctctgttgaaggacatctgtgctctttccagcttctggctattataaataaggctgctatgaacatagtggagcatgtgtccttattacaagttggagcatcttctgggtatttgaccaggagtggtattgctggaacttctggtagaactgtgtccaattttctgaggaactgccaaactgatttccagagtggttgcaccagcttataatcccaccagcaatggaggagtgttcctctttctccacatccagccagcatctgctgtcacctgagtttttgatcttagctattctgactggtgtgaggtagaatctcagggttttgatttgcatttccctcatgactaaggatgttgaatatttctttaggtgcttttcagccattcaatattcctcagttgagaattctttgtttagctctgtaccccattttttaatagggttgtttggttttctggagtccaaattcttgagttctttatatatattggatattagcctcctattggatttaagattggtaatgatcttttcccaaatctgttggttgccattttttcttattgacagtgtcctttgccttatagaagctttgcaattttatgaagttccatttgttgattctggatcttacagcacaagccattgctgttctgttcaggaattttttcccctgtgcccatatcttcaaggcttttcctcactttctcctctgtaagtttcattgtccctggttttatgtggagttccttgatccaattagacttgagctttgtacaaggagataagaatggatcaattcacattcttctacatgataactaccagttgagccagcaccatttgttgaaaatatcttctttccactggatggttttagctcctatgtcaaagatcaagtgaccataggtgtgtgggttcatttctgggtcttcaattctattccattgatctacctgtctgtcgttgtaccagtaccatgaagtttttatcacaattgctctgtagtaaagcttgaggtcggggatggtgattccaccagaggttcttttattgttgagaataatttttgctgtcctttgttttttgttattccaaatgaatttacaaattgccctttctaactctgtgaagaattgagttgaaattttgatggggattgcattgaatctgtagattactttcggcaggatagccattttgactatatgaatcctgccaatccatgagcatgggagatctttccatcttctgagatcttcaatttctttcttcagagacttgaagttcttatcatacagagttttcagttccttagctagagtcacacaaaggtattttgtattatttgtgactattttgaaggatgttgtttccccaattattcttcatgtttttgagacccctgtttagcagtgttttctaactgcctcttccatctttaagtgttatttccccaagtggccagaaggggtctctctcccattgctccagggtatgaggaaggcagagtcccatcccttactgggatcctgccacctatttatctgacaagtcagttccagcttttctttccaaacaactaaaaaatccttgtgactgtcatggaaaggaggctcttgtgagttctgagagtgcggtgctgaattctcggttggcatatcctccttccaggctggcactgttaaagaagagtggcgaggaagactggaagaacaggctgattcggaagcaggaatatggcaaagccactggcggcctgcacacgcaggaggtggagcagtccctgaagaaaaaggtactgtgtccacctcacgaatgcctcactgtgtgtctcaagaatgagtgtgtgtggcttatccacccctgctttagagcactggtgcttccttgcccttaggagacacggtttgtcactgtgctgctaaagctaaccactgggtcaaagctggaggccaagatggtgccagcgccacgcagttgcctcaacaaacatatgcctcagcttccaaatgtgttcactactaaatcttaaataaagtctggtgttagaatgtaattagtctttcaaatgagaaaacaactaaccacaacagtttataagctgcatatcaaacacgggcttaaatttcggtccatgaggactttctgcctaatcgtaggcctgtttcatgatgatgaggtataccttttattgaggacctatatatgaatatcaattaacttaagtcaaatgtgtgagtatttcatatgtaggtgtatcaataaattgttgacttacaaatgtagtgattgtcagccttggccaggtactcactacttcagccatgatgtccttgcccatggtgctgtggatacagatgtgcttgctggctgaggaaagtgattcacttgagccacacccagttatccaacttctggaatcagacagagaacataaactgagtagcagagctgtcaactctgcatggtgtcacttcccagtgcagttgttttgaaagacccatatccctacagtcagatcaaaataaaaatgaagctcaaactgtgatggatttccctcaagtctgcttaggagagcgaggactcatgttatttccagagtgctgagggtagaggatgggtctgaactgctagttacttggctgaggctcttacaggcagtagacttgggctcccctgcattcactctttggatagaaaacccagttctggaagcagcagggctctgggcccagcctgcacctgcatgtgtcacccagggttcgcttggctcccccttctgcagccacagtgaacccagtgttcctagactcttcggtggcctagttcactttggcctagacaataagctctttgaagttaaaataagctgatctattttgggctctgtccctcacgtggggaaatctcaagttctgttaaggccaagtggttttcagatacctctgacaacacgcagcttcatttctttgcaagggctgggcaggtgctgaagcacacacaacttcactgcacctccatgagggaggcagtgccctaaatctgttgtttcttaagatgacacctaggcttgccagaaaagttattccaagcatcttctccagagaagggaagacattggtgacatatgcatgcagaaagagtctggtgcctatgaaaaattgagactttctcatgggtggccatcaggataacaggagggcagggaccacaagtgtcagttttgcccccaaacacaaagaagctggacttatgatcactcacaccccaattctgagtcttccaaatagcatacatctatggttaccaaacattttctagctcatggtatttggtacagacacaggttgcagctgtgggaacatagaagagtaagccatgttcatccctcccatgaaaatccatgcaaccctggctaggaagcatgttgtgtaagctaggtggttaattcaattgttccagcagctaccttaagaaaagaacatacttcagcatggtgacatacacctggaattccagcactcccaaaagagaaagacacccaacattgacctgtggcctctgtatgtgcacacacatgtatatctgcatatacacacatataccacaaaacaaaatcaattcctatttctattaataccatactgaccatttaaaactttgaggatctagtaagatcctagaaaggacactagcaggctggagaggcagcttagtggttaagagcaatggctgatcttccagagaatccagagtcaattcctagcacacacatgggggctcacaacaagtctgtaaccccaattccagggaatctgacaccctcttctggcttctgtggacatcaggcacgtactcagtgtaaaggcatacatgcaagcaaatacctgaatacaagaaaacaatgttattaaataaaaccattaggggatgggatgggatgggaatagcagcacacacccataattccggctctcaggaggctgggacaggggatttctgtatgctcattcctccccagaattcatagtaagtttcaggtcagccaaggctacagaataattcccgtctcaaagcaacaacaacaacaaattaaataaataaatgccttggaaatctgtaactattttctctgtcaaaggtattcccaaagaaaccccgatgtttctactcatgtctcatctgagtccctgtgtgataaaaaggtcttatttgggctcatgagtggctttgaagaaagtaagacttttccttattgttcttagcctccatctccatgcacagttatttgctttttaagatagtcctcaaaatcaagattaaggaaatgacttcagatcactgattaccccagcttccttccttcccatgggaatgatgcttcgtcccctcttctctcactcacagccccgattcctgcctcctgacttgagtgagtgtaggtctggatgagcaggcagacacctgggcttctgaacgtggcacatgcacttggcagtaaggacccaaagccactaagcagtagcacagaccaggtccacacttgcagggacatgtgcatttcagcaggatttgtttccatgtccatcaagagaaggaaaacaaagcaaagtcttccagggtcccctgctaggtgtcttcttcctttctagcaaactataattaaacctcggccctacgtgggcctagtcatcattgcagtgtataaggtgacctatgtctgtttgaagacagtcatccagtgtctgggactttttccaggaaatcaaatcccattgtagaattggctgttttcgggtctgtgcctgtgtgtgaatcttaggcaggaatgggttgccctaactgctgctgcactaataaggtcagttaaggctgggatctcagatagcacaaaaaaaaagacctgaaaactcaaggaagggacctttgccacactcgtgctggaattgtctgtcatggctgaagagtgtcatgccgtggggtgatgtatgctcacgggttgtcattcctcctgtccctgaggaatggttgcttgcccttcatggctctggaatgtgtgcatgtgcatgcttctgcctgactgaacccaggcacagagtgaccggcacagcagactctgctcttcccatcctctacaatgttcctatttattttaacctgtaggaagaaggaggacttacagatgataatgccatttctaatgtgctttgggtaagcttaactctaatgcaggtgtccttctgtaacagaacacagtggaatccgctggtgggtgcaaagcttagacacacagcctggagacggaggtacaaagagagaggtgtctaccttatgaacactacagagaattctcagagccatgcctctgaataaggaagctggggattcttagtggaatcttatatgtatatatgtgtatgtatgtatatgtgtgcatgcatgtgtcagtcctgaggcaggataccaggaaacaggagagtatccatggtttcagctgagtacagtgcattcctgcccaggtcgctattggtgaatattccctcagctctgacccacatcatctgccactacatcagcatacaggatagtgtccctcccctcatatactctgtacttccctgaccattattcttaccttcttgattttgctcagctgatgatcttaatctctgtggagctggaggacactatcactaagccctgggtcttcttgtactttgaaagctcatttctcttcagtcctgggcaatattcacgtgtctgaatggactaagcttatttagccattcaccttctcgatggcatcttggttgttttcaaatttgggtaattgtgggtaaagtagctataaataaaagcccatgtgcaattttttttttgttaaaacacaagtttcaggtgactcaggtgtgaaaggacatgactgagaaagtaagcgtgtgcttagtcataaggggcttccagatgccttgcacagtggctgcatcacgttcacatttctctagtatccagtgaggtgtgtcatgttgctcaaagtctttgaaagctcaaaggtttttaatgtcggtgttttagattttggccataccaaaagatatatcatagggtcatattttaacacgtgagacctcacagtgtgtcgctgctgactatgtcgtcatgtggttcttttctctccacgtgtattctttgtatctacatctacccagatgctttcttcatccacgtcccaggctctgagtttaaagtcctttgtaagtcttgggtaacaatcctcagttaaatacggtcagcaaatatttccttccattctgtggtttgtcttttcattcttctgacagaatcttccacagaacagtttattaatctcactgaagtccagcttggcaactaatcttttcatgaatcatgcctttggtattctacccaaaagatggttatacccaggctggggaaaatagcatgcatgaggccataagtttaatcttagtagggtggtgtgtatacatgtgcgtgcatgtgtgtgcatgtgtgtgcatgtgtgtgattaagttcgtgtctagaatttctcctattatctcttgggagttttatacttttacacttcacagataagactatgagctacttggagttagtttttgtgaattacatatgagctaatctaggttggtttttgttttatatgtaatcaaagtatgtaaatattctaccacatgacttcttaaaaatacttttttctccatagtattaccttattcctgtactcactggggttcagtcagctgtaggtatatgggtctggttctagattttctattctgttctgatgatgtagtcaatgccatactgtcctgggtcctgtagcttcatgaatattccagctgagagttccaccttcatccttcttcagtttctgtgggctgtttcaaggtttctgcttctccatatacattcaagttcaagataagcttatctatttataaaagaaccttgtaggacttctattaggactacataggatctagagaatatcaaattgatgataaacatctctccatgaacactggatatcttccactgaatttttattgttaaaaaaaatagcattcatctttagcaatttatgtttcgtgacctgaaactttagaccattttaagccatgtattatcacctttaaccgttgacccagatatacatgttagcatgctgatggattagtgttctcagggataagtcctttactttgccccagaagtggtggtgtcttgaagtttcaagattcaagagtagagagaaagaaacaatgtgattggacagtgcacaggctctgtgaggcagtgtgcagcctttgcttccttacctgctccaaggctgtgtagagcgaggtgctgttctacccaatattcatcaaatctcacgagatggtgagaggaccaaactaaaatcacttaaaattctgagcacagggcttctacatcattgtctccaatttcacatccctaggcactgatgcaaacatgattcgaaatctttgctcagggaaaggtaaagctgacttcttcaccatcacacggaactttgatgcttggccttatttccattacttagcatatgatcctatcatttctgcaatcacttattcaatggaaggtaaaaacttaacagcaggatcaccagagttcttccttcctcccacttcgtagaggaagtggaggaattttgccttttaatttgctgttaaccttacctgtgctgcactctcctgccatatctcattcctgtgggtaaaaagtgtagattttctgtgacttctcagtaggttaggagaaagtcaagcccgtctgcagcatcctggaaacacctcactggttgtcccaatgtgtctgcttatccccctttcttcccagcctcttctctttctctgtcacgcccccatcctctctctcgttccctctgcttctctctaccatattgatggcatctgcatttgcaagatgtaaagtagaccttctgccagtattctgcttctgctctcgctatctaggctaccaagaacccatttgcaagctacacgacaggacacagaacatatcaaacgagaaaaagatttagtgcaggaaaatcaagacaataatgaagtttcaaactgaaaaatgaaagagacaaatacaggtttgttcatacctggaggagttttcgttcgttggagtggatctcctaggattttcagggaatacacactgttttcctgttatccctgctacagccttagaagaccaaggggtgcaaacttggggttccccaggacaaacatgccaaatagccaagctatctaaatgtttccagagaaagacaaacttctgtgtttaatacttgcacttagaaggaaatgaaaaaacaaagtccttctggaaggtttgggtagagccgctttatcccagggctcagaactttcatcttccataaaaatattttgggtacttccagaagagctaagctggtgattggaggaaaacattttttctcagtcacatgactttactacacccttcactttggagaggctatgagctcaccatagagaaaggagccaattttaatggcattctgtatggtttcaagaaatattttttaggcaactgctctgttggttttaattaaaccttacttggacacttcattttcaagcagacttattctctcaaattttattgtgtctttctgtcaagagaacttcacagtttacttagtaaatttacatagctaaagtgttctttggaattagggtcatggtatcactcctgagtggaaagcttttaaaactgttagtagcattcataggggcaacagtgaaaacttgtagggaagtttccatcccaggcagggtgccctatacccttcccctgacacaatttctgctttccactcttcctgccacttccctctccctctttctagtcccctcctatgtcacatgtgattgtatgtgtctgtgtccctgagactgtccttatgcgtttgactgagtgtgtatgtgtgtgtgtgactgttaatgtgtgtgattgtgtttgtgtttatgtatgtgtactgttagtgtgtgtggttgtgtatgtctatatgtctatgtgtatctatgtgtgtggctgtgtatatgaatgtgtctgactgaatgtgtctaactttatctttccttcctagaccatgagcacaatatttgtgcaatatgacaacctgctccatttagtacttcagtgagtgctgcctaaaatcaaaggtgttttccttcatgcccatgatacagtgatgcaatgatcacgacaggtctcagatttaacccaaccatacctgtgtttgaactgtcggttttccccaataatattcttactaggccgagccctgggcccacaccaggatcatgtgttgcattcagttgtcaaactctgggacaaggttgccactgggtctaaactactaaggtatcagaaccacttctggccatgaagagaatcctgtgcaaggaagattcctgggttagatgatggggacactggcatttgtcacttgaccaagcccgctcagtcagccaacaggttctccagcgcgggagtgaggattaaaaggaaaagagacagttagacaacattgtagcgtgaccccagtcaattctgagactgaaggcaaatttttattttccaatccactttttataccattttaattacatgcaagtattttgggcagcaatacaataaggaacaaagcagcagtaagataaggaactactaacaaagcagcaagaaaagtcctgtgattagtcctatgatagctgttaaaaagggcttatcatagtgaccgaaatacttgagcccacgtcctcgtccatgcccaaaaatcttgcctgagtcctagttccaccctaagactaaaattcctgccttatcctacttccctatcacagcctccagttagattcttgccttatcttgccctaatgtcagattcctgcctgagcctccttccgtgtcctaggccagtgtcagattcctgtctgaagcgcacttctttgtccttagccaatgtcagactcctgccaagcggtaccccaaaaggctttccacagtcactgaagtcacccatgttagtctcaaatgctaagaaccattgttcttggtgtgggttgtgtctgccacaaaaaaatcctaggtgtcagatgtgttatgatctaaagcctcctcctgggttcccttagctggtgacatcactgcagagctggaaggcccacccagtcctggggaatcttgtaattcacattcctcctaaccagctctcctacttccttgagagctgagctgtttgaatgttagtaaactctctctcttcgtgagcccacctgggtaaactctccacatgaactcacccaggttcagaacacaggtaaaacagggcagctttgtctcttaacctgtttgttactgggcaaatgctgccagctgaagcttacacctccatctttcccctctttttttctccttctgtgcatattgtacacagagagtcacagaaagtcgagagagccagatgacgattgaagagaggaagcacctcatcactgtgcgcgaggaagcgtggaagacgaagggcagaggcgctgccaatgactccacacagttcaccgtggcaggaagaatggtgaagaaaggtcaggcctgtgtgtgcatacatctgtgcatgcatgtctgtgtgcacacgcaacaaggcacagctgtccatggagagagaatagtacatgacaactcagcagggaggaggaaggccccagtctttacatctcacattgcactggtgttgagtgagcgagtgggttttgacagttctatagggtgtttctgctgcagacacaatagtacagcgtcttcagtataggaggcctgattcaatctgtcattatttcagaatcatctgtttggaaaacgagtgcaattgtaggattaagatgcaattgcagccctaccaaaaggaaaaaaaaaaaaaggaattttaacaaattacttcccatagttcctttaaattgtttccatcttcttatggactgacatacacacatctagacacaccttcccaccatactaccaccaccaaggaagccttttgtaacaaaggcagtttagcaataaggagtcccttttgttctttgcaagtcagctctcatgtcccttgacagccatgtgtagtggcgcatgcctttaatcccagcacttgggaggcagaggcaggcggatttctgagttcgaggccagcctggtctacaaagtgagttccaggacagccaaggctagacagagaaactctgtctcgaaaaacaaaacaaaaaccaaaaaacaaaacaaaacaaaaataagctgtggctgacagaggtcaatttgcaggcgtgtgtcaaatgtctaaaagacgttctgaattccagagaagagatagggatgccctgcagatcaccaagtgcaccatggaccccagaactgctgtgaaactaaaccgagagataacagaaacagtgttaccttgatcagtggtctccagagagtttgaggatgttcgcggctctaattcatgttctatggcacaaggttaaatgttagggtccctcaatcatccatatgcatggataatagtttctcaaactattatctaaaatcagacttcctagttactggtaatgtcttcacctaaacttagtctttgggttctacaccctcaggacagcagttcttcacctcagaccttccattctgaatagagcctaactctttcatggcattcaagagatgtttgccaaaaggaaggagaaggaaggaaggcaaaccttggagggtaatttccttgaatcttactggaagaagcctttgagacaaaggtgtcaaccttgaaggacagcagaatgccatttgtccccacaggatgaagtgggacctggcttttcttcaggggatcctagacctgtttagtcaggtgtattctggagcccggccctctccccacatctctcgcccctcaccacctaccccccaccaccaaccccttccttactaacaagaggcaggagtctgggctcaaatccattaaagacagctggaactgaacgtgaaccagagctcaaggcttcaactgctggctccaacttgtatcctaatggtgatttgctcagtttttgttttagtttattttgccatctcatctgaagagtcctaatggctccccccatgtaccgcttcccttgtgccctgacgcacagtgccgatttggatatggagtggtctacctcacattgaatgttctgttcctatttccctgtacgcactgtgtattttcccagggttcgtaagtcatgggtctttctgaggggtaataatttccttgcttttaatctgatacaaaagaccacctctatttttgaactattagttctttttgatttgcagttatatggcatctggtttttgttgaccacagatacaacagtcccagaccctcccccactggacatccacaggactctgatctcaccgtcccagtgaagacagttgcccattcaaacagttgcagggtttcattgtttctccccaggaagctctgagctctcctgagtgtctttggacagtctctgtttttgatattctattactctgtgtaacaattaccacattacaagatctcgctaagaactttgagatgggaggaaagccttagaacatggccatcagtaaaagacatgaagatgttcccagagaggaggctcgtgtctgttgcttttagagttcactgaaaagagctgtggggagaactttgattgctttaacacttcgaaacttcaccctatatcccccgttgctttatggggaaacccatactgtctctagctgagaaggcaatgtcccacaggtccaggcattatgacctgactgacagcagggggcactatagcagtaggatttgtcctgagtctgtaaagaagggtagattttcctagttactttgggactatcagcctgctgagctgagtgagtctagttattgcttttaaagccaatggactcctctggtaactcaagcactttttagtaggtaatgagttgatgtctgtcctatttttgtgacacccgattttacttatattactacatttcaagaaattttacttcctcgtggacatgagctttttgctgatctggtaatagaaatgagttttagaatgtgtgcacatatatttgcaagtgtatatgcaaataaatattgagacgtgtttccatccagcctgttgctcagaacttaagtatggagccacttccagtcttgcctttttcctggtgcttcatttacatctctagctcatagaaggaaggagcagaatgctcctctctttctcagaagatgaggtaacatacatctctgctcttgtaggacagcacttacacggctatgtcctcttaacacgcgcacgcgcacaggcacacacaccgcagagggtgcagagagcagcagtaccgcattaattctttacaaacacatttacttccccagtgtcctctacttgggtaggggtggatatctctaaactttttctcttatgttttcatatttcaactgagtgccccctgtgctaaaagtcccctttgcacttttcatatgtccttcagcctctgctcgagtaagcacttcaccctccccatgtcttgggaaacatgtgattatttccagcaaacctgagctgggtgagcgtcatcctcccacaatcccagatcggtctgatgtgtgtttgcctatctttcttctgaatgctcagacctctgggttattctccacacagtcagtgctcataagttcacccttgtcattgcgtcttcacagactggagagagtcctggtgcctgaggctttgctgcctcgggcaaggaaacttactccaaacatccactgtgggagatggtgcacatttgcttttcccctgtggccctcactactccagaaagccttcagaactccttcttgttccagcatattctggaagccatgtacactcttacactgtttataggctatgaatgtgcttccccttgtctttgctgttttttagagtatcagcttgccagctgcatagtacataggaagagaaaaatcctaggtatggctgcatttggtgaccaacctgtgtatacttgtgctgtaagaacatgtaccggttcattgggttctgtaaacttccacaattaatcttgaacatgctaaaccgtcccctttgaattctgcaggtctggcatcacccacatccataactcccatctcatcccctctctgcagtaaatcaaggggcactaccccggtttccaaacccttggaaggtatgtgtctctgtccacagtgacatgagtgtttgaacagggaagctcaggggtgcttgctcacaaatggtttctacttgtttagatattgaagccagaccagatatgcagctggaatcagacctgaagttggacagactggaaaccttcctaaggaggctaaataacaagggtatgtgccagagcccagagtggagcttcagcctgttttactgccccacgcctggtctctgctctctgagaacctctaagtcctagctttcaacttcttaacttttggagttttgttttgtttgacagttttttttttttttattgctgttgatttggggttgtttgtttgtttgaaacaaggtatcacttagatcaggctagctttgaacttacttcatacccaaagataaccttgaagcacaggcatgtaccacaatagcaggctctccaaatcccacttctgattgggttctctcttcagccacgttatctccttaattatctactctcagcaatttatacacacacatgcttaaaatcttttgttattcttcaaaaaatgaacttgtagtcagtactaaccagagttctctgatctacttaatatcctaaatttgggatgcccaatagcacacatgttactgactccaaacccttggaatgccatccaatccaagtatcactcagtgattttgtcttttcactataaagcagttagtgtacaaatagaaaatcaactaattggatgggcattgaactttacacatcattcctgctaaggcaaaaggtatgttttctaataatcccaaataatttctaaaataaaactctagtaaaaatgatgcaataaactattataataattggtgacacaaaaggcaatatgagaaaatagccttttctctcttgataaaacatatctgttcatcaagtaccaggtactaggagtccctacaggctgaaagttgcacaacactgaaaagcagagctataaggtcgtaacagaatagttaatctaactgggtaagatatattaacaatgaaatctattgcactggtgtctttgttagggtttctatggctttgataaataccaggaccaaaagcaacctggaaaggaaagggatttattgattgactgattgattggtcttacaacttgtagctcatcatccaggaacgtcagggccagtactcaagtcaggctggaacctggaggcaaggacaagtgtaaaggccatagacaagcactgcttgctctcctgctccttgtggctttggcctcatttctcacagcgtcaaggaccaccagggtttccaccacccacaatgggctggagccttccacatcaattgcataggtttgcccacaggccaatctggtggggacattttctcaattggtaccctcttttcccaaatgaatctaacctgtagcaagctgacatagaactagcccaatacaatggagttaccgtgatctagtccatggtcacctggcaacagccatgaccactgcagtgttctacctgctctgggaagtaaagttttattgaaacatagctatatcctctcgttgacctgctgtctgtccatagccacttttgcactataacagcagggttgtagaattgcaccagaagctgtgtgctctcctcagagtggtcccaaatgcttcctagtcctttctagaaaatgtttgcagaaatgtttgcagaaagacaaggctaaggttagctccctctagtagaaatgggtcaggttcacaagtgctcatgtgtttgagggcaaggccgtcctgtttcctgtcctgaccatcactatgcaggtgggataccccctgtgagatgcttttatcaaatgctttctcagcttctaatgagatgatcatgtggttgttgtctttgagtttgtttatgtaatggattatattgatggatatccatatattgaaccatccctgcatccctgggatgaattccacttgatcaaaaaggatgactgttttgatgtgttccttggatttggtttgcgagaattttattgagtatttttgtatcaatattcaaagggaaactggnnnnnnnnnnnnnnnnnnnnaaatgtttgcagaaatgtttgcagaaagacaaggctaaggttagctccctctagtagaaatgggtcaggttcacaagtgctcatgtgtttgagggcaaggccgtcctgtttcctgtcctgaccatcactatgcaggtgggataccccctgtgagatgcacagagagctggggtgcaggggtggcaggaaaagggcttcggacctcactgctgtgctttccccactccaggaacttagggaggggacataaagcattgcagggaaaggccccagcaattgtttactgaaatctcatagtgtgtttgctccatcattggtagttgctgggatacaggaaacggttctcacggtcactggcaaatctgtcaaggaggtgatgaagttggatgatgatgaaacatttgccaaattctaccgcagcgtggatcacagtatacccagaagtcctgtggagctggaggaggacttcgatgtcattttcgacccttatgctcccaagtgagtttgagaatggctcctttcacatgctccccctgccgggtcaccagaaacttctgccatgggtatttgctctagaacacgatacacagtgcctcagggtcagcctgctgtccttgcattctgctgcccgtgcccttgaggggtgtgaccggttttcatgtcactcaagcattgttctgcagtgttttataacatcgccactaagagttttccataattctcccactggacaccactgaacttactcataactggatatctgatttacacgagctcagattagcagagtgaattatgaaattaggagccatagttctttgcttccaaaaatgtataaaattgacatatgtccatgggctttctcagaggcacccaaaggtgcccaagcaaattctataaaaagtgattatgtcttaggattccagaaaaatacatgtgttgaactgagatcaacaaaagcaaacaagaaacaaacttgggagacaatttagtttaaactgaagtgtgccttgagcgcacagagacagttgcagtacattctctcttaaggctgtctttccatatgctggcttctctctgggtcaaactacaaccatagggaaagaggtacccgcatccaccaccagatggacaggcaacgcagagtcacttcccactagattctccaagaccaggtttgtggatcattgttccacttgggtccaaagtccatctctaaaccattcatgcagtctagtgaaaagatgatgcccttcaaccagagggataagataaaccccagaggaagccccatatagcattagggggcacttgttctaagcaagctgcacacagcccacactgcacacctctactcttccctatgcagttgtcagagcacccgtgtcttccaggagtgagttcactcggggaaagttctcatcagctcctcctggtgcgatgtgctgcttcgcatgcttctccatccagttcaccttctccccactcaaccatcatggctgaagctgttctatatagttgtgaaatggaataatttaaacaaaagtgtatttgtgctcacatgcatcctggtggtacacaaaggatgctgccaggcacagagacctgagcctcaccacaggagcctgttgggaggtcactgacacactgcttccgcagacttctacccagacttcagtgagacagtctctgggaccagtgatgattctgagggcctcttttattccagtatattcttcacaggcgtggttcctttcctcgggtacctggtagactgagttaataagagctgtgaacagaaaagctatgtttgtagaaaaaatttagtctggggcaaaaaggttcactggcagtgcagttgtcatctgccaagtccaagaaactgttggtgattgtatgcaacagtgggtgtgtgtgtgcaacagtgggtgtgtgtgtgcaacagtgggtgtgtgtgtgcaacagtgggtgtgtgtgtgcaacagtgggtgtgtgtgtgcaacagtgggtgtgtgtgtgcaacagtgggtgtgtgtgtgcaacagtgggtgtgtgtgtgcaacagtgggtgtgtgtgtgcaacagtgggtgtgtgtgtgcaacagtgggtgtgtgtgtgtgcaacagtgggtgtgtgtgtgcaacagtgggtgtgtgtgcaacagtgggtgtgtgtgtgcaacagtgggtgtgtgtgtgcaacagtgggtgtgtgtgtgcaacagtgggtgtgtgtgtgcaacagtgggtgtgtgtgtgcaacagtgggtgtgtgtgtgcaacagtgggtgtgtgtatgcaacagtgggtgtgtgtatgcaacagtgggtgtgtgtatgcacgcgtcccctgagtgtccaggctctctaacccacacagaatcatgaaggaaaaatagtggactctattgccctgggtccaagaccagaaagtaaggtgacatcctgggccacttctactttgcctgcaggttgacatcttctgtggcagagcataagcgccaggtcaggcccaagcgccgggtccaggcttccaagaaccctctcaagctgctggcagcaagagacgacctccttcaggaatacacagagcaaaggctaaatgtggccttcatggagtccaagcggatgaaagtggaaaagagtgagtgtggggctgcagcctgcttcccaggcctgagtgagcactgcctgtgtgttaacctttgatctgccttgcagccacctcagcaggtgttcagagagagctcctttacgaaagtgactacacagacacatgtatgcctgcttcaaatttaaagatttctcactaaattgatgctgaaattatgctgttttgctgagttgggtctcaagatgaaagtgtctctggattttgtaatccctccaattttcagctctggctccaagcacagcagttctccactgaatctaagagggtttgagatctcctgtggatacccaaaggagatgtatatcctcacccagcactttaaaccactgctttcagattgttctgggagaggtcctgggacttcgtggagataggttaggtgggtgttgggtggggacttggaatgaactggaatggttggtctctggctctaccctgaccctgagctatacatctcggctttctctggcctagagtgtgagttccactatgtcaaatagtaatttccatggcagtaatagcatccataatcttgatatttaaatatttttgtggtagtccttatttttccttttagtgtttataaattgatttgacaaaggtttttgttttgagagtatttagtggtgtacatgcctgcaatcctagcactcagtgtttaaacatggtagaaccccaagttctaggatagtctggactacatagtgagaccctatcttcaaaactaagggaaggagggagggagggaatgcaggagggagggagagcgggtgggaaggggagtggagttccttccaggtccctccaccttaaaccatccaacctttctccacgcaatggaaagaagggaatagggaaaatttagaggagacaattgttttcgaattctaactcgttgattgagaaatgcttcccaaaaggcaggagccatctgagttaccaaatagcaccagtgttctggtttcagtaaaatcctgtggggaatatgagccctgcaacaggtggagctgttctcaagcaagagtgaggtcaagacgtccacaacctcaaaaatctcatcttgatagtggctggagtaagggatcattccctccctgcccaggcctgcatgccctggtgcatgtagcctgtgtgaatcccccccccccccacacccacacacccacacacacacacccacacacacacacacacctctgtccttcttgaagtagccatggagccttgtgatcaagttacaggtttaagtacctgggctccctcttcatgcaaatgaaacattcccagcacctcagcgctggccaataatgctctgtctctctctgtctgtctctctgtctctctctctctgtctctctctgtgtctctctctgtgtctctctgtctctctctctctgtctctctctctgtctctctctctgtctctctctgtgtctctgtctctctctctgtctctctctgtgtgtctctttctctctatctctctctctgtctctctgtctctgtctctctctctgtctctctctctctgtctctctctctgtctctctctctctgtctctctctctgtctctctgaaaacccctatactcctcaagatttgtttagctcttaccccaaataaaagagaactgtttcactaaatactgtctagaagagctgcattccgaaggccgacaagttctgtgagactcgccaacattggttgataagtcctgtactgcatttacttctgcacacagtggttaatcattgagcagtgcaacgcctcatacttgagtccggtcagttagcaattatctatgattacaaatactggctttcaactgtgcatccctcctgacctcccttcacagtgtcatccaactccaacttctcagaagtgactctggcaggcctggccagtagggagaacttcagcaacatcaacctgaggagtgtcaatctgatggagcaaaactccaacaacagcgcgatgccctacaagaagctcatgctgttgcagattaaaggtattctttacagtgatctaaagggacttgggcaggctgtggtttccgtcttgtcaccgtaggacaacaaactcctggctgcatccattgttcctatgagggggcaggcaatctatctgagtctccccttctaggtgctacactgtggcatcgctgactccatcgggcctggaatattctgccaactggacctctgagagcttgtgaatgaggagaagggagttgctgagtaggagacctggagttgggctcagtcttttaccctttcagaatctcagcttttggtcctgctgcctctaacccagtagcccataccccaacctgctgtgcactttaccagatacaccctcagtctccagcatggggctgcacaaccctcccagttctccctactggaacaaggcatggcccacaccacccagattaaggaaacacatccctggggaaggaatcatgggaaggcaggagtgagcctcacccatccccaggttccactctcctgcccttttgaaggagcagcaggaagttagggttgtgaggaggtgactgtgttacctctagatccccaggaccatcacccttggcttttcaagtgaaggatggatggagtagcttctgcctccaccaaggattctagggtgttttctacaaacccatttcctttttggtgtatttaaaagattaataaagggtggggagatggctcagtgagtaagactgcttcttctagcagcatgggaaccgtacttgaatccctgatgcccacataaaaaccagacatgggtgtctgtgcccgtgaccccagcattgcagggcagagacagacagacccaggactttactttccagccagtctaggtgaaatggcagacttcagcttcagtccccagggaagaaaacaactggaactctcctctgattgccacatatccatgtgtgggtatgcacacctgcacacacttatgcacaaaagacaagtgaggagttttgatgcagaaatcagactaggtctgcactcacctaatgctctgccttggcgagtcacttgagtcacttagaagggtggtgcaagtggtacaaagcagtacttccctccaagatggccccaactaggtgctcaggagttagtgtctgtgcaaggagattctgaggggaggcacgccttaccctacagcacggctaggtgtgagcacaggacataggctgtgtgaagagaaggtggcatgaatgtgacagagaggtcagggtgtccttgccactcttccaagactggagaaccttggcacatctacaaacacgctaaactccaaggctttgaggacactcctaggaagctcgacaaccttagtgcatgtacactgtgcatgtaccttagggctagcaacaccaacatgtggcccatctcaagttccacgtgtgcctggttctgggaccttacactagtagtcagagtctttagaatgggaggtgtgtagctgggatgtgtccatcatggaagtgtgaatggtggtaaaaggacgctggggcttgcccacaggaagaagacatgtgcagacaaggctggtggagccccgagcctcatcactcaacagtggggactgcttccttctgctgtctcctcagtactgcttcctgtgggtgggagagttctccaatgtcatcgagaaagcaaaggtcagtgtctaaatgacaagatgcttctacccctgtgtcctttgtacaacagtgaaagtctgtggcatgcatctccagtttgaaagccctgggtcttagctgactcctgggtgactaacacgcatctgtgaagagccagtatggctctttcacgggaagccccgggatagtgttcaaagcctacgagttagctgttgaatctgacacactgagcttggttgtagagctacatatatctagaccactgaagaaggagttaacacacgtacacagccccagacaaggaataatgcccgaagtctgtaagttatctgttgagtttcacactcagggttattgctccgaagacttgatatgtctgctcccacagttccatttccttggctgagacagccgacgtcgcacgcctctcctgtacactgacttttctctgatgttagcatgggtggaccacactgatttttcttcccaggtcattgtgtcctattcttttccaggcatctgaacttgcaacgttaattcagacaaagagggagcttggttgtagagctacatacatccagaccatcgaagaaggaattaacacacatactcacgcagccaaagacttctggaagctcttgggtggccagaccagttaccagtgtaagagtttaccatatttaatagtgaagaggctggaatatcctgtgtccccagccccaacccttaactgatgctcttaagtcacctactttctaatgtcctgccttaccccaaagctgccggagacccaaaggaagatgagctgtacgagacagccatcatagagacgaactgtgtctaccgcctgacagatgacaaactcgttcctgatgatgactactgggggaagattcccaagtgttcccttctgcagtccaaagaggtatcagcttcaaggatctagaactgcagagttctaactggatccatgctatcaagcacagcacttgctaaaggatacttatttactgtttcaaaccactccactatctataccatacaaagttcagattattcttcataagtggcatggattattgaaggactttatattttacataaaatataaatattagctctgcatcttgagttctataagattaaatttttgttagtcctgaagtttcaggaataattaatgtgagtgtatgaagttatatataattaaaataatctacagattcgttaagtatttttttcacttggcccagtagctgtatttccagtgtagaagaaaaaggaagccatacaaagcccttacactccactggggagaagcgtattcgaaagaactcagtgccagcacaattggtcagtgtactgccaaccatggagacctgaattcagttcccaggtctcacacggtggacagagagaaccaactcccttgaattattctctgacttccttgtgtgtacacatgaacacacacaaactaattagtgatattctttctaaaagtcatgagattttcttttttaatttttataagtatggttatgttccttgtgtgtatatctctatactatatgcatatactgcccacagagaccagaagaggcatcagatcctctgggattggagttacagaccactgtgagccaccacgtaggtgctgggaatcgaacctgagtcctctggaagggccactgagccacctctccagctccatattttctcttctagcaatactgtcttttgactagagagattgttcatttacattttacctacatacacaacactaatctaattttaaaacttttagtaaatacccctatagcttaccagccaagtgaaataagttggacatgaagagacaaatattctgtggtctcatctatgtgtggaatccccaccccaaggaaataagaaaggcagaaaagaaaatagaaacttccaagggcaggcctgaggacaggcagagggcagaagcagcaggtatggggagcagagcgtgtccaggtatctgtttctcaatgtgcagctacagtcagccaactgttgctgctgtgacccctgcaaaatgtagagattgtagctgtttctgccactaagacaacagcaagcaggagcaagtggcagagtaaggtcactgtgctggtaaggccaccttacccatctctatcccagagcaccctgtttatgcagtgtagatacattcaaatatataataatgtattttaataataaactgagcagagtgtcatcgaaagctataccgagggtatgatgtatatggacacttaaatgggaacaaaagtcacggaagaagaaataattttgagaagagatgaaatggagcctagttgagagttaagacagacttcagagtgggggaaataggcagaacaacagcattccattcattctacagacactcagcactgatcacctaaggtaagaatggcatgatgtctgccccgaagagtcttagaactgcacacaggagggacagtgctggctccttagcacctgctatgtgtgtgataagccgtgagtgttgaatgaatgaatgaatgaatgaatgagtgagtgagagggtatgtgagagtgagtgtaggagggagaagctaggtagagaggagggaaggaagacagggaggtccttacataacttgatttaaagctttgggtggtgccagcgttcagaagatgatgtcatcagctgagctggagccccagagtctgccttgaagttcatgcgtcatttttgtgctgtttccaggtcctggtgtttgactttggtagtgaagtttacgtgtggcatgggaaggaagtcacgttagcacaacggaaaatagcattccagctggctaagcacttatggaacggaacctttgactatgagaactgtgacatcaaccccctggaccccggagagtgcaacccgctcattcccaggtgcccctgctgcccgcctgcccacattggtcttgtgcatgcctgctcttcacacaggcatctaacattgctttccatacagagaccgcagatttaggaaatgcttacgtgctgcggcctaggagggttagctttcacctaactcatgagtctggaggctgtagttttaggaacactcctcaaccccactcactcatccaccccgacgaccccgccacccctgcatgtcatgtcagggtgataagtctgattgtggtaagtcagtatttcccgggtttctgaatgtgtcttcctgccctgagcccctgacactgtggtcttcatgtgtgctggggttgagggaaggaggatctgtactgaaagactgagtgtgatcgtaacattacccatgtactagacttttgaaaaatatttgggtaaatcatcagagtaggtacagaatctagaatgatgatcgtgagtttaaaaagtattcttacactaattttttttaactactagtccctccaaatgttttaaaactgtttctatcatgtaataagaaacaggcatgatgtgagacaactttcaagtttcctgcatagtttctccctttaaaatccagtaactggttttattaatagttagttccaataattaaagccagagctgtaatcccagtactcagaaaactgaggcacaaggtcattcatgagattaaggctgtcctgggctacatgagtaccacaccaactcaagttacagaataagagaccctgtctgaaaaaaaacaaaaaaacaaaaaacaagaaaataacaaaaattaaatatttaatcaatgtattaaaaattaaatctttaagcaaatactgattaatactataagaactaagattttaaagggctgagacaaagcctagagtactttatatagatagactaatgctggttccctagacttgaaggtgcagccaagattgtgcacccagcccctcttgacacacagcagctgacagccttgagttgagataactaggccctgagcagctcataagtcacgagaggaagtagataaagaaggccagatcccactcccagagccatgcccttcaccacaaactactgtgtctcctgctccatttcacagcttgtaaaaagcagattccaaagctgaatctgcatctatagccatctcagcaaggctgcagaggagagctacagagtaactcagctgaggcttggtgatgggtgtgagtgtcttgtgggtgctccaacagctgccttggctgagtctaggcccttttcttatctgctcccatgctgcaggaaaggacaaggacggcctgactgggcaatatttggaagagttacggagcacaatgagactattctgttcaaagagaaattccttgactggacagagctgaagagacccacagagaagaattctggagaagttgtccagcagaaggtacagtccatgagagcaggtcaagcagagaccagcaaaaatggccatggtggcaaaagcttccaggacacactagtgatgacgcaagatgctttccgtgttccagtctcactttcactgtcgggatcctcagatgctaactctacatagccttctaagtgtagtcagataccccgagatgccatgaaagctagatgtcttcactgtctcattagcagctatgatggggctggtgacaacgatggtctggctggcaaccaagccctgggttcctccaacaccacaacaaagagtaaagaaaagcattccaaactgcgctgggtgtaaccaaagatgtctgtctgcagtgaaggggaatctgaacatctctattctctgtaggatgacccgagggccgacgtcaagccttatgatgtgacacggatggtggcgacgccccagattacagctggcaccatcttagatggggtgaacgttggccgtggctatggcctggtggaaggagatgacagaagacagtttgagattgccactgtctctgtggatgtgtggcacattctggaatttgactacagcaggctccccaggcagagcatcgggcagttccacgagggggacgcctatgtggtcaagtggaagtacatggcaagtacagcaggtcagtgggcatgcacacgtgctcttcttgctcagcaggctgggaaggccaccctaggcagggtcccctgcatcaccttgggagacaagaggcgatctagccatatgcaggtaaggaccaggagagaagtacagtgggatgcctggccgcctgtaaaaacaaaacaaactggagtgtgcatgctcttcactcttgtgatacccccaagaggtttccagtcatgatttgcttccacatggtattgacatgtggcctgtgtgctgtaaagaaatcactgagtgcagcgtactagagtcccttaaacagcaactcaacggtgcttcagcgaggtacggaatgcacagttaagatttgtttttaagaagtggaggtgctggggtgcaaaagtggaggtgctggggtgcagctccgtggtaggatagtcaccgtagcatattgaaggttctgtatctcatcttcaatcaagataaactcctgggactggagagataactcaatggggcgagtccttgccatacatgaatgagaatctgagttgggatccccagcttcctcgttaaagctgggtggacatggtaactgtatccacaccactggagaggcaggcacggcagatccccagagctcactggccgctcagtgtatccagtcagtgagctctgggttcagtgagagactctaaaagtaaggtggagaaagaatggcactggactctacttctgacctcttggcatacatattttctctttctcctcccccttctcttcttcttcctcctcctcttccttctcctcctcccctgaagataggaacactaactctttttcatggatctgggataatatatattaagtggactaacttttcagaaattttttttatttatgaggtttgggttttgggactcatcttgattaggtttggtttggttttgaagacaggatctcacttatgtaacccaggctggctcaatcttcctgcctcagcctcctgggtattgaggtcattacaggtgttggtgaagtactctgcagctaagctcgactagatacctcaggcaagatgctggggtctgtccatgcccctcacagcagctgtcattgtcctgacttctcagatgaaggacagggcatccacctggctagtagagagcagagcagcaggcttcagtctgccttccctctttagagccaactatggcatgcccccactgtgcctcatcctgcagaggggttgggcctgaccctgctaaggaatgtagggagcagcagggccgactggctcagggttggtccccattgcactctaaacttctggagtctcctaaacaagcagaagcagaactggggctccagggtgtggcctccttccaggcagtggtgggggtggtacttcttgtcccctccttcctaagagtcatcagatctgtctttcctacagaggctatatcagtgaatgagaccacaggtgtctgaatctacagctggagtaggaagctcagaaccttgcctaccaattaggcatgctgggtaaagctgttcaacctctctggggcctggcttctctcagaaaatggggaaggtgttatggggtctgcatactaggtcaatgcagatggcaaaacttattgtaatcaaactgctactaatagatccgggccacagaataaactggggagctgaacttccatatccaccaccaccaccacacccgagagccaaatgttactgagcttttaagcttggaaaccacaaacatctgtgccaagttaaagttacttttctccaccaatcaagacttaaggataggggacttccttaggcgcatgtctttgtggtacgcttaccctgttcccactgattgggttgttcaactgtagcaggaagatttgcctagcatttatgtcttacttgctgaccagtctggcagttacccagggaggtcttgggaacttaaactttatttgacctatttcaaaatggaagttttattcaaaatagcttcagtttggtttctttcttagaaaggcaatacctgacccagagaacatttgaccagccctgtgcatgctgctttgggggtttaatgcgttactatggtgcctggcacccgtctttattgtagttgcttgggaacccacccccccccccgtggaaattatcaccagacatagcaaaatcactgaacagtttgaaatgacttgtagttgcccaagaggaggggacaaacacgtccatcatgtagaaaggaaactgtaaatttaataggagacaaaggaacagtataatatattgagtcatttttatacctggcttctaagtcatgagaccaaggtagtcgtgagtgagagagggaatgaagtgagttagtactgccaaggatctcgggtgtccacagccttcatagaccagagctcgcccaccccgggaaacagtgatgctggcaagcaatccctccccatactgcatgtcttcctcccaagcctggtggcacattatcaatagctccagtagcgttctaccagcaaaatgacaacttcaccagcctgcttaggtcagtgtcctgcccagtgactgtttgcagggtgcagcgtggtctatgtcctgggggccatgggggcataaactctgtgggtgtggcccccagaggcagattcaggctgctttggagatgatcaggagattggattctggtgccaggcttgatcaggagcagtcctcgtctctcctggctttaactgctaaatagaagctgtaggagcattgctcttgtgtgtgtgtgtgtgtgtgtgtgtgtgtgtgtgtgtgtgtgtgtgtgtgtgagtgtgtgtgtgtgtgcgtgcgtgtgtctctgtgtgagtgtgtgtgtgtgtgtgtgtgtgtgtgtgtgtgtgtgtgtgtgcgtgtgtgtgtgtgtgtacatgtggaggccagagggcagcctcactgctgtcctcagcactatccaccatctctggttttttctgcacagggtccctcactggcctggggctcacaagtgggctaagtggctggccagcaagctccaaggatccacatgtctccatctctccaacattgcacacgaccatacaaggcttcttccccccacttagcatgggttctaaagacggaacctggatccttcaactgagctatctccatagcccagaaaaaacttattcttgaaagttctttgatggtgtcttatcaacactctaatgtagggatctgagttgtaatgactgtagtctggtgtacttactaataaacctttcattactaaagttaaaaatcaaacacattgaaaagaagttattctgtgtagaactaagtctgagtgtactgaggaaactgttcaaaggacactagtcaaaatgtttgctttaggaaatgcagtgtactttaggcactgctcagagcccgtggctacacagcacatcagggcagagaacgtgaggtggtacaacacgcttctacctcacctctgggacctgaagagaggggaatcagactccatcattcctttataatgagccacgttgcttcctttgctcttgaagctcctctagctgttgctagcatcatctctccctcagctgatcctctgacaagagaggtagaatgtagggaagtgagtgtgtgcgagcacagcggggggggggggggtcagagggaacatgcctctgcctgagatgatgtgcattttatcttgggtttcccagaggagccatccgtcagctaagaaaaagatggcaccttactttggttccatcacagattctggggacgaggcccggccatttatctgctgcccctctggtgttccagctcacctcaccctctgccattgtgtctgcagtgggaagccgacaaaagggagagcacctggtgagagtggctggcaaagagaagtgtgtctatttcttctggcaaggccggcactcgaccgtgagtgagaagggaacgtcagctctcatgacagtagaactggatgaagagaggggggcccaggtaagctctggggagccattgcagaccccaaccctgcccccctccacttctccctacctctctgcggtctcctctgcaaagaaatgagcctgcaggtgctgaacccagagaggacaagggcctgtgttctgaaagctctcctcctagccccaaaccaggagtttctcacaaaacaaagagatgcctccctcccttttcaaagggagcaggtccaaagcggccccaaatctcttgtctgggagcagccatgctggaggacagtttgggcctgaggaccttagcagccaatcaagtttctgctcagctgtcaccttcagcctcaggcaaacctcctcccttcccgcagccccctttgtaccttgtttccatagctgaaaatcacactgttgtctacgtatttacatctgttcccagtgagcaagagagaaatcccaactcacttggagcataaagactttatagggtgttttccgagggcttctggcctcagctctggggatcacattcagggcattgtgcgtgctcggcagcacagtcctgttgggctgcatcccaggcatggccccaggatggtttaatgttgaatgatctgtgccctacgttacatccactagtgccactgattgagagctggctccgaagctttggggacatgtgacaccacaggtgggtatttttaccatcctccatgaatcattaattggcagaagcatgaggaaggagagcagaaaaatgctttctagaaatcgagccatgctcactcagctttctgccattctcagaactgattatgtgccctaaaaataattttaagacagaacaaatatttttgcactatagatcatatttttagaagtagaccttagcaacagtggcatttcagcttattccaaacagtggttgatttcagctgcctgtttttatagaagccataagtgaacatgctttaaccctggattcaaagcacacctggagtttggggttaatcattctgctctgagcatttcttatttcaatccaacacatgggaagatcatcatagacacacaatgctgccagtaaacggcacatgccttgtgccaccacgaaactctgcttgtccatgtgaagtcgacctacactgagtaacatagcttacggtggaaaatgcttctacctttttggatgccattccttctgtatgggatggagtctgccaaagagagagcaagtgatgagagaagaacagagtattcagggaggaggatgtcaccccacacgagggtataatgctggttcctgtcgctatgataaacaccccaggtgatctacttaaaaagagaagtgttgcttttggttctctggtacagttgtttggccatgttggctttaggcttgtagggaggcagtaactcatggcggaaatgcatcttaagagtgaaaccgcttggctcgtttccagaaagcaaaagagatggaaaaaaagaggcaagggtctcataacccccttcaaggacatactctcagtgacctaaggactccccacaaggccctacccacctcttggatatcccagcctcctagcgtgcagcctggggaagctgagccttgaggggatggtcctgaaaggcatttaagacctaacctaccacagatgctacagcaagggcttcgctccagactcactaagtcagcagctcttctgagaggtggaccttgttaaacacattcaatcccattatagctgtacataagataccatgaaaatgcagaagttacgtgactctgaagaatattccatgacagaaaaacagtgaaagagggtgcatgaggtgccagagtatagcttctctaccttcatattatgggaaaacacatcttaggaaatactttgaaagaagccctacgcattacacttttaatcctacttagcttcaggaggcagtgggatattctgtgtgtccagacggtggtgcccagattccctgaaacaggcaagtattactctcatgcctttgacagcccctttgtctgacctggttttccatgtttaaatttaaaggtccaggtcctgcagggaaaggagccaccctgcttccttcagtgtttccaagggggtatggtggtgcactccggacggagggaagaggaagaagaaaatgtgcaaagtgagtgactttctagtgctacaagtccctgtttgtctcttttccatggaggtattttggaaggagatctttcagtaagtctaggggttgcagagatggctcaggtggttaagaacacacactgggcttatagagaacccacagtaatcaggcagttcacaactacatagaactccagtttcagggggatctgacgccccctctggcagccacaagtactgcactcatgtgtacacgttcatacatattaattttaaagtatatatttataattaaaatatattttataattacatttatatataattgaaaaccttaaggtaagtctaacctcatatagctgtgcctgtcccactgaaagctgcctgatgctggcccgatatagcaccgtggggactcccaccctgcataccacttatttcctgatctgccctttttttgtgggaggccttgaaatgaattctcagtaactacactgttcatggaaattaaaaaccagtggatttcctataataataatttcactggcaagcaccctatcactaaatccttagtatttttctctttagttttagttatttaatgtaaatcttggaattttttttttcctgccatgtgtacttttggcaacctgtttataactctagaccactgctgtccatgctcagcatgttttcagcctctggtcctgcaatccctacaacatatgtctttgacagcacacagggcacccaaagggccactcctcctgtgcttgctccttcatagctctgtccgctgctgtccctgcaggtgaatggagactgtattgtgtgcgaggagaggtgcccatggaagggaacttgctagaagtggcctgtcattgcagcagtctgaggtccaggacttccatggtcgttctgaatataaacaaggccctcatctacttgtggcatggatgcaaagctcaaggtcatacgaaggaggttggaaggactgcagcaaataagatcaaggaagagtgagtgtcgctctgcaccaagcggatcccagaaggatgcaggcaggcagaggcagggcaggaccccaacaagggggtccccatatatttaaagtgactccagggacctttggagctacagccagggctgacctaagtctagaggatatgcagctccacggaagcctccaatctgcaggtttttccagctttctgagaacatgactgcctctgtaaaaagcatcattgagccaggcactgtggtggatccttgcagccccagcttcccagtaggctaagggaagagggacagactaacccaagagtttaggaccagcctgggttacttagtaaaatttcatatactatatgaaaagacagcaacaataaggcagatgtccccagcaagcatagtcacactttggcttctttctgtaagtgctccttgcttctgagcattctgcttgcagcctatgctgctaaataggcctgtgcaggtgtcttgtaggagtctcagtgtgtgtaatattggaatggcagagagggcaaaagtaaagaaaaaaactgagggccgggtagtgctggcgcatgcctttaatcccagcacttaggaggcagaggcaggcatatttctgagttctacagcctggtctacagagtgagttccaggacagccagtgctacacagnnnnnnnnnnnnnnnnnnnnctgggatagagatgggtaaggtggccttaccagcacagtgaccttactctgccacttgctcctgcttgctgttgtcttagtggcagaaacagctacaatctctacattttgcaggggtcacagcagcaacagttggctgactgtagaggggaaaacttcggagtataacatgtcctatctttagaaagcagggagcccagcttcaggtcagcagatggcagtgagttctcagattccaggccagtcctggggaccatactgcttgggttttctcctggggtcttcctgatgggcaagggcctcaggaggagcagcatagccagagggggggtctgccactgtgtctctgctcttaccagcagcctgggtagcctcaattccttgagaacagctaggttccttccttaaaatggagtgttccatcacataccagcacagggcaacttgagtcagccctttctgtgggcattgaagtggagcagtgggatccgctttcctccctactcctatgaaggacagtgctggtcataagggcaaagagaaggaagagaagtgaccttccagcaggcaggcagatgaaactggactctcagaacatccttctgtggatggtggaagtgagtaaagtttaaaagatgttgcatgagggatccaataggattcatgcccccaaacagctttttacttggtccattaagaaaaaggcaaactgacaatgaattcattcatttattcatttggtaaacacttactgaacaactacttggtgtcaaagaagggaccagacagtcatcagtgaacaaattcatctgtctttctcctcatgcagcttatgttctagcagcagagaacaattaggagagacaccgtgtgttagatatagaagtgaacattgtcttcataacatatatagctctatcttcttccctggagcatactggcccctcttcctccagtacaaatgctgggggaacttttacagaatactgttgttcatcagtgagaattgctttctttagctagagagtgaagtcatccgtggatttagtctggaataagtaagtgccctgcagacactccccaggcgtccataaacctccatcatgtctccccacgcagatgtcccctggaagcaggtttgcacagcagcagcaacgtgacaatacatgagtgtgacgaaggatccgagcccctgggattctgggacgctctggggaggagggacagaaaggcctatgactgcatgcttcaaggtaactaacgccacggccctcagagtccatcctctcagctcactcacggatttgctcacaagacatttattgaggtttgggcatgattccccagcaaacgtttgccatgaaaccaggaagacccaagtcgattccccagagcacgtgtaaaaatgttgggtatggtggttgtcttagttaaggtttctattcctgcacaaacatcatgaccaagaagcaagctggggcggaaagggtttattcagcttacacttccatattgctgttcatcaccaaggaagtcaggactggaactcaagcaggtcaggaagcaggagctgatgcagaagccatggagggatgttctttactggcttgctcagcctgctctcttatagaacccaagacttccagcccagggatggtcccacccacaaggggcctttcccccttgatcactaattgagaaaatgccttacagttggatctcatggaggcacttccccaactgaggctcctttctctgtgataactccagcctatgtcaagttgacacaaaactagccagtacagtggtgcacccttgaaatcttagaacctagagagaagagcaggagagctcctgggactttatccccagtctaactgggtagctctggctcttcacgaatgcattcacacatgcatgtctaccacatacaccctgcctcctgtacatacaactataaaaatttactgagcatatgctgtgtacagcacacagtgaataaagacaagggtaggtctcccggagaacgtcatctaaaaaggaagctaagccacactctgtagacgacttattttcttgtgaataaaaatgctgtgtcatggaagagcgtgagcatggaaaagagaggctcatccccaccaggacagtcatgcacagccctgtgggaagacagggcttgcacagtactcttacacgcattcatgcgaccggccaggaagaacgcaacaaaccggaatcttctgcggcaaaagctttattgcttacatcttcaggagccagagagcaagagcacaagagctctattgcttacatctttaggagcaagaagcaagagccagagcaagagagcaagagagagggcaagagcgcaagagctttattgtttacatctttaggagccagagccagagcgcaagagcgcaagagtgcaagagcaaaagcaagaaggagaatggcgaaaccccgtcccttttaaggagaattattctccgcctaggacgtattactccctgattgactgcagcccatcggccgagttgtcgtcacggggaaggcagagcacatgtagtggaaaactacccttggcacatgcgcagattgtttaccacttagaacacaggatgtcagcgccatcttttaacggcaaatgtgagggcggctccccacagatcccccttttcttttaataagagcaataggccacccacattaatgagagtggagatagaggtcaaatccccagtgtgcaggtaaaggagccgtacacataacctcctcccaggctcatcacccagaggggtcctggtctggtcccgtgtcgttttttctggggagaaggacacttggacactcaaccttcttgaaaaatgacatgtctccctagaataggctcatatatgccgcagagcccttctactgcagtgcttagccgtgcaactctctcgggctgctgaagcatactcactctatcctgtgcaatgagactagcctcgtggggtgcaagagctgaatggccagcgacctattnnnnnnnnnnnnnnnnnnnnctcaattcccgaagggtctgttcaaattcagctatccaattctgtaatatatactgagaaaagactttttgacaaattagctgccctagtaaatttctcatactgaatggaagtaacggacaatcccggaaacttttgttcacatcccagctgagctatttgccataatgcatctagttgtttctggacaagatctatgagttgattaaccagcatgagacctctctgtatcttgacattagctgaggcctgtttatctatgactgtagtcaccgaggctgacaatgtgttaatggtgtcagtcgtctgtctagacagagccaaggctgtctgaatcaaggccaaacccagttccttgttactggtaaaaaagcaggggaatacttgagcattatacatcaccggcattgggagtggaaatgtcgacattatcccccaacgctgctctctctttgttattgttgtcctggacatcaccaagacgagggacatcagtattcccttggtcagtctggatttttcgggtgagtctttctggtatccaaaatgggttgtctccattctgtggaaaaacacaaacagctcccctggatcttatcaaaataggatccgggccataccatttattatcaaggacatttttccatttaaccatctcattgggcctatctggctctgaacaatgacgttcagccgtagtatggccatgagcatcaagatttaaaaaattgagtgtaaagagtgccatagacacagacactcttggtactcggggtagagccttgactcccccttttttaatagataggatttgagggtgcgatgcgcacgctcaacaataccctgtccttgagggttgtatggaagtccagtcaggtgggtcacgtccatctgatggcagaactgctggaatttttgagatgtataagctggtccattatcagtcttaaggagtttgggtttccccccaagcactccatgcctcaaggcaatgttgtatcacatgtgaggctttttctccggttaacggagaggcaaacatgatgccagaacatgtgtcaatgtacatgtaaatattgatttctcccaaaggaggaaatatgcgtgacatccatttgccagacctgtaatggcctgatgccacgagggtttacccctacatgagtagataaaatttgacaacaatctaaaggcattattaagtaatcagaatcattttcagtagaaccgatccctctggcagctcgaggaatactagaggaaggaaaaacagccatgtaggcttggcaaaattattagttgagctattctgtccccttgtgatatagaaaagacaacttgaggacaagaacagagaacctgaagttctcctttataatcctgatctacaactccagggtggacaataagaccttgtaggctgcaagagcctgcctctgtcattctggccacaaaatctgagaaggactcctgaggtccctggacgatctttgttagttgtccagtggcttcacctgctcgggagagcgccttccaggccctaatagccttttcatctgattcagaactactaagaactggctccttgagctcatctagtgatgagtatagactccttctcctagagacctccgctaattgatcttttttcttttcttttttcttttccttccttctaatctctccccaggtattcttacctgacctaaacttttcctcgggttcaagacccgtggaaaggcctgtatacttattttgtgtaccatatttcctctttgctcctactctctctccccgctttacttctgatagattgccctgaatttcatccagaatcttcagccctgccttaaccgcttgataacatgtgaaaaggaacaaaaaggctcctaacactagagaaagttcaaggccaaacataccttgtaaagctatttcccactttacttctgatagactatcttgaatttcgttagaaagttcaagaccagacttaccttgtaaagctatacttacgggtaccctgttccccagctgaagagttctgaatttacgcagttgaatccttctcaacagtctgtgttgcgggaacacttcattaccaccattccccagctgaggagttctgaatccaggctggatccttctcaacagtctgttttatgggaacactttattaccatgacccgcagttctggttccggaatgagggatcttccttgcgccagtgatggtagtttttgtcccgggttttctcgtcccgggttttctcgtcccaggtcttctcgtcccgggtttcagcaccaactcttacacgcattcacgcgaccggccaggaagaacgcaacaaaccggaatcttctgcggcaaaagctttattgcttacatcttcaggagccagagagcaagagcacaagagctctattgcttacatctttaggagcaagaagcaagagccagagcaagagagcaagagagagggcaagagcgcaagagcgcaagagctttattgtttacatctttaggagccagagcgcaagagtgcaagagcaaaagcaagaaggagaatggcgaaaccccgtcccttttaaggagaattattctccgcctaggacgtattactccctgattggctgcagcccatcggccgagttgtcgtcacggggaaggcagagcacatgtagtggaaaactacccttggcacatgcgcagattatttgtttaccacttagaacacaggatgtcagcgccatcttttaacggcaaatgtgagggcggctccccacacagtacctctaggctgggatgacttgacagaaaaaggaaggaaatctgagctgagcaagaacatggcaagctgttgggtttggccattatctacagtaaaggaagtaatgggaaccctaaggagaacatgtgtctccaccagatcaggagggtttggacagcaagctctgagccacatagagacacccagttctcagcagtcagggtgggatggggagacttcgaaggcagtggctgatactcagtgcctactgagagatgtttataagacatgagaatgtgaggagttaccgtcagctgtggtcttggaacctggacctcaaagctgcacagcagaggccattgttgagtggtgtggccatctgctgaaatattctgtgatatattccactctacctacacttcctccacagctggggagcaatggccaatattttctctattatacaatagtgtggttagcataccctcaaaattaattatttgtccataattaaggcggatttctagatgtgagactcctctatcaaccactgtcccccagaacactgggccaactttcttagcagaaattatcaaaagggaacattccccaacactcataaaccgagcacagtaccccaggaaaacactgtctctgattgagctggggtgatcttttatgcttactctgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttagtcactgctcattggtagagtacttgcctagcatggtggaaacctgtgtctgatacccaacactgcaaaaataactaaaacagacttcctataatgaggatatataaaccaaatcctgctgatttccctctatttctttgagttgtttcatgttttaccttcagtccatctggaagttggtccatatggtgtccttagctttgttctcttttctttggaagatcctggaagttttaacttcgcgccccgcctgttcatcctcagcagctcctccggagacttctctgcgacagagtttgtgtaccccgcacaagcgccctctgccgtcagctccatgcctttcctgcaggaggacctgtacagcgcgccgcagccaggtatgccctgcagggggcgtggttgccccggggaagcctttctttctctttcgttgtaagcaattcctatctgccaactacaccactagcagacttgcttagggcatctctttttatccacccaccacaaaagaaaacaagaaaatcagccatgtaactttgtatcaagagctgaactcagttacttcctacatcaaagagccagttgacagcaccacttgatgtccttaccattctccctgccttcccctccaactttttgcttcatggccccttgtgagctgcccttactccagctcgcatgtttatattcaaaactgaggaaacaggaaaggggcagtttttttttttttcaaccttctagcaccagtaaatgtttctgctttatctcattggccagaagatgtcatgtggccactccagctacaaaggatccggaaaggctaaggaaagggacatgcatgggcaagctctcagcagagctaaggttgcagagttggtctcccaattccaagatcagaagtgttcccaccaagccataccttaatactcaaacctatgcaaaggaaatgagttctgtagaccctcccattttcctgccaatcaagtccatgagctcatagttgtccagagcctggagccttattttacactagtcgccctaccactagctcagatcttagcagatgcatacatcatactatgggcacactatgggcaacagcctcgagtatctaaaagaaaaggttactccctgcccttgcatttctggactcattaacaaccactgacttttaaagcaattccaaaatacacatcaagagggaccttggggccactgagatgacaagttggatagcatttgccactcaaagcaagagtcagacggaggcttaaagacaaggaagaagagccaggaagattctgttcaaagttaacgtccctgtaaaaaaccatccctgctcaggccatcgtgagggtggaggccaagccagatgtgagctctttggagaccagaggtggctaacagcagagccctgaacatttgaaaagaccactagcaatctggatgagctgggcaaggaagggaagccaagaggcctttcttgggtcacctcctcacactgctacgggccttcagagtttaagctcggggatgagtgtgcagagacggctgacccatcggtctgaaccttggcgagaggactgtgggcacagctggcagagcagcagggcttctgctgagcagtgaaggcgtccctcatggcctcattctgctcttacctcacagctctcttccttgttgacaaccatcacgaggtgtacctctggcaaggctggtggcccactgaaaacaagataaccggctctgcccgcattcgctgggcctcagaccggaagagtgccatggagacggtcctgcagtactgccgaggtaagggcaggagaaaggggtgggaagtccccacaggcctaaccatgtccttcctgagatgcctgcaaccttgagaaggctccagcactcccccttaaactgctggaggcttgtcaatcttaggatcaatacattctctgctactagaacaaaggagagtccatatttccctttcaaatgacagggccacccacaggtgtactgtggaaccacctgcactgccaccactctggctaagtgacctccatggcaccattctctcttcaggcaatgccggcatcgtgcccaaactggctaaaagccaacgccagtctttcttttggtatcatatccaatgataacaacaaccgaaacagtttcctacctagcatagaatctgaccttttacagaacatggatgcccataactaatgctttgtctacatgctgatagtttactggctctcttaatgccccggtgtgtgtgtagttgactcttgccatggaaagctctttgtgaacagccttccaaatcccaccaaatgctcacggcacctggaagatgctgccatcgcctgtcacctgctctcgaaacttgtcctccaggcaaatgaaagggaagcagacatacctggtgggagtttccagacagccttctgtccccccaaaatgttcagaaacgttttgccaggttcaggaggtggggggtagtaacctttcagataaacagcacctgtgtgttgctttaagtattttgtgatccgagttctaaacatggaagtcaagagttctgaaggaaaatgggaagagcctgagaaaaagcaggacagactctttgggtccactgacatgtgcattctgtgttcccacaggaaagaatctcaaaaggccaccccccaagtcttaccttattcatgctgggctagagcccctgacattcaccaacatgtttcccagctgggaacacagagaagacattgctgaaatcacagaaatggtgagcttggggctccaaggactacaggcattgcagctgccttattcagtctaagcccaagacagaggttgccctggtatctctgcatttattgttgctcatcggcatggcaggagatgggggaacagtgcatgatggtgagcaagctcatcattaaggctcactggcaaggcacagcacatctggtttctcagttaattaccaggacagtacatcagtgttcatcttactattgtctccattgtaccagtgtaggagctgaggcatacaacacttgcctcgaatctctgagccaccaagtgaggtacgattcacaggaacagacccgaatgggctcggcaccacacctgcttctccctgacattcatccccatagcttgaacttgagctcattcacacgccatccaactgcccaaagggaagcagcacttcccagacccaagtataagggataaagatggttttcccagagcatctctccccctactgtgtgcgtgtctgtctgtctgtctgtctgtgattgtgtgtgtgtgcataatccagggccttatgcattctaggcacagactcccctacgcagcttcaccctcacccttaccttgtttgtggattaagaaatgggtcctaggggaaggggagagggcatgatttcttctgaacgtaattactttaaaatatgttcaaacaaattccactatgtgtaagcatctagtgatttgatttcaggtccaataatctttttctgttgtccattcatgggtaatctgagtccctaaacattcattcatttacttctggaagtagttcagaaacaggcttaatttagtacaggagaaaagctatgaagggtaggaggtgattccaggacatccagagcccccactccacaatggagtgacgccttactcagccctccccaggccgtaggcagggcagagctgggagtctgtgtgctccagcgatagcacttgtctgctcaaatgtactctgctccgtctccaggatactgaagtttccaaccagatcaccttggtggaagatgtattagccaagctctgtaaaaccatctatccactggcagatctgcttgccaggccactcccagagggggtcgaccctctaaagcttgagatttatctcacagatgaagactttgaggtgagtgacccttgtgtgggatgctgacaacacactgggagagcatctttttactcagtcactcactgggagtttctccatctcttctagtttgcactcgacatgtccagagatgaattcaatgcactgcccacctggaagcaagtgaacctgaagaagtcaaagggcctattctgagggtgagatgacagggccacagagaagtcgctgccgctagacccgaaaatgaatggagatacatatttggactagtagttttttctgtcaaagaagaaagtatttttgaatcagagtttttcaaaacctacagcttgttctagagttgagcattctgtaaatgtataagagaactcttctgattgttcttttccacagttcaggtgaactgaaaagaaaagtgtcttttccgttcccctcagccaagtgctgcctcagtggccgctgcagccctacccttctggtctggctcagcactgccttttttaaagcaattctctttataaagtgttattttgatagtttgtgaattctaaatatatatatatatatttatataaacacatataaatcaagtatgtatttaacaaagcaatatgtattcattcacttgcaactgttttctttggtgtcaaaacaatattagaggactgtgttgcttctgttgagttaagcctaccaccagtctgtcccgtgctcaggagtgcctccttcagccttaggtctggcttgtgctaagttctgcttccggtgctaaagcaaacaaagactttgtattcttagtgtgaactctgaagaatctatttgaatcaacctttctaccttaatatctccccccagaaatgtatagtgccttgtttatgtacagtttatatacagaaaagtttgctctgcttttttgatgctggtttggaatattatctacagctttattctcagtagaaataaaaacatctcaatttctcatacccattgtaaacattacacatgtcattttgtggcacaggatcccaaaataaaatatcaaagtaatcccaattcattgatcagttcacattgaattccaagcctgttcatggggtggggcactattcctgtaagggggggggggacggacactatgtagctgtccaacaaacactagtgtgctgcattggtgccaactcccgagactctgaacttcaacgcagggcaggacataagattaaatagacctggcagacacttgacccataaatttgctctaaacactgaacatgttcttaacaccacagctgcatcgatactcactttaagatctcagtgccttttctccaagtgtgaattgatgtgtaaggtgttaagatataaactatggagttagggtaaatagctcggtggggagtgcttgcttggcatgtgtgaggcatgggttcaatgcccagcactactagaaactgaaaaaagacaaaaccatgagttgaacctgcactgcagatgcaccgtgagttgttacaactctgcctgtcaccaactgcttagtctagtttaacatgtctgttaacttcctagccctctcccatgccctactgtgtgactataccaagtctggagcctgtcagctgctcctgcacccacagctttataattgtgtgatgctgttcagtcaccaaactttcctgccttcctttcttaagaaaggaatcaaaaactacatctccagcatcacagatccttggtcagggatggaggagatgggctttgaaaattgcccaatgcagtggacctggtgctgatgctgttgtgacggaagctgaaatgggaaagcacagaggtgaagtagcatgatggagtcatgcacccagaaatgatggaaaggggagggctcaaagtgcatcttccaaatagcagcaaaggatggatgtttgcagccattagagcaaccttaagagggtcacagagagacaggtctgccagcatctgcagccagctctggaagtcaacagggatctcagatacagggctacaattgaagttctccagagagaatcaaatatctctgtagaaggtatctggatgattcatgcatggatggaaaataatggactagaccatgggacaggaaagactgagagttccccacaggccatgtgcaacctggagcccctggaaaactagtacttagctgtttgtgcctgagccttcaaaacttgggaaaccagtgcatgtccctctcagcttaaggctagagcccagagagcacagaatctggagttctgctgcctatatagcacaagaccagtgtccctgcagagagagagagagagagagagagagagagagagagagagagagagaagtgtttttctttcaacattccctccccagagcatctccttcagtgctcaggctgatacactttttcctctgaaagttctttatggacacaaagcagcgctcaaccaggttagtactctccatctggtcaagttgacacctggacttggctgtcacagagagtaacagcagtggctagagtgagcgtaattcctaagacacgtctcagtcatcaacacacccctcaaagccaagttgtcccaaactgctctaaactcttgtgccaggacctttactaaatgttacccacagtcatgagctatcatcctgatggtggcctctgaatgaacaccgccctggaccccagctcactgtctctttcctactctcagggttagagccttctgtgtcaaaaatttcaaaatcctctcatagtttcatggactttatctcaagatgactttgaatacctaaggccaagaaggagctgtgtcaatagtcatagcactgggttgtctagggaataacgaccctaacaagcttatacatgttgagttccactaagtcagcatctgttcaagctgtgtggttggatctgaggatgtgaaatatggatacctatacatgtatgtgtaagtgtatgtgtgtatgtgtatatatatacacatatatgtgtgtgtatgtatatgcatatgtatgtatatatgtgtgtatttgcatacatatgtgtatgtatatgcacatgtatatgtatgtatgtatatatgtgtgcatatgcattttatgtatatgcatacgtatatgtatatatgtgtatatatgtgtgtatgtatatgtgtgtatgtatatgcatatgtatatgtatatatgtgtgtatgtgtgtatgtatgtgtacatgtatatgttgtatatgtatataatgtgtgtctgtgtatgcatgcacatatgtggaggtcagaggtggacatcaggtatcttcctcaatcactctgcaccttacttttgagacaggttccctcagcttgggagttcaccaaagaggcctgactgacaatctagtgaactctggggatcctcctgcctcggcctccccagctttgggattacagacatgtgctcacataggtgctaggggtctaaactcaggctgttgccttaagcacctaactgactgacacatctccccatgccaactccatgctttcaaagagtaaatgcacacatgcttggttttgctccatcataggcaggctaccagggtgattcacacctcctgccacagatatgtcaaaggatgaaatcaaaagtcattgggaaaagtgggaaaaaagtgttcctataagcacattacagatccgctgtgcctgttagactggggaacaaccatggtcacatggctcattgctggggacagacagtgaacagcccagtgtcctcacatctagtaatgaacaggtgttctcttgagcttcgccacactgctaggattaaaaagaaatctccaaagccagatttggtggtgcaggtttgtggtgtcagcacacaggaggtggaggcagaaggatcatgagttgaaggccagcctgacatatatggtaagactgtgatttggggaacccagaatgggtgcaatatcaactcacagaaagtagtgtccaacacatctcagccttgatattctctcacagtctcaatcagagttgtgtaaaatgtcctggacattctatgccatagacttctggaagtcccttatggatggtattgtagcaggattttccctgtcctattaatttaaatattaatacaacaagaagcctgtgattggacaggggaagggaggcagagctatgagttgtagagacagggagagacacagggaggagaggaggaagatggaggaagaacaggacgagtcagatttcatgtggctttaaatacaggtagctataatatcatatagagatagaataattggggcaccttgtctaatctaggtgggtagcttgtatcattatcaattggctcagaaattattatgtgggcatcttgtgaattgagaatttattgatatataaatctgactgattaattataagcttctagagttaccaggttactgggaattgtgattgctaatcacacggtgggcatcattgcatgggactggcatggcagtaacctgccaagggaacttggcgaattgggtagagacgtctagggagctctgggccagagagatgagaacacctccctggagccatgtgacccaccagagagatgagaacaccttcctagagccatgtgacccaccagaatgatgagaacacctcctggagccatgtgacccaccagtgcccagtgtagcacaggaacttgccagtctgttttaatatttcccacaacgcagtgttagaactgacttgtacaatctggaaactatcataaaccatctactactaagtctcatggaattagtaaatccatttttgttatctgggtatcaccatagccattacatctctgctcctctgccttagtcacatctacaacacaagctggtaagaactagctcctatactacagaaggatgaaagactgcatattgcagagccttgtgctgacacacagtagctgttcaataatgcaggaaggacacaatcttggaaattctttgtccacttacactggaccatttagtgacttgggtcacaggagaagatggagtgcccactaatggcccagtacccctaaatgttcaacttttccaagggctcaggctcagggctgggcccgtcagcaggcaatatatagaagttgtctgggcaggaactcagctggtgatctgccattgtgtgtgtttctcaacagatgtctaccactgccccacccccacccccaggactctgcacttcactgacacattgccacatcttggctctgcctagagaatgaccaggccatgtgtgaggtggcaggaagtagggggatccttgcacaggactgcagcagcctctggcaactgactgcagagtgaacccccctcccctggaagctgatagtagagcaaggggagactttagctcgcctcagctttagcatccagtgcagaagggttcagccttcctttaaactcccagtgactgaatgtaaagaagctacttagagtatccaaatttctcagtgggcagggagatgaaatgagaaactgggttatgttgcctggacttggctggaaattgtcagcagggaagtagtttagaattcagttctatcatttgagagaacaactgggcacacttccatctctgtttgaaggaggaaatgatactgataagacacttcaccctgtagctgttacagctcgaacatgaaatgtcccaaagaggctcatataccgaggctgttcttagctggtagcactatccctcaccaagacactgagatcaatgggttaacccatggagttcacactgaatgggtaattaagagctggggtctggtgcagaaattgggtcacaggagcaaacctttgaaagatgtcttgttcctgtccctctctcctctcctcctcctgcttcctgcctgctgtggggtgagcagctttcctcagccctgcttttctatcatggcatttctcctcactatgcatgagcccacaagcactaatgccaaatgactgtggacccctaaaaccgtgagccaaaataaatcttcccaaccttgttttctctggtattttgtcagccctagaaggggatacaggatggacagatgtacatagtggctgtgcccaccctgagaggtccaccatcccccttcctttcctcaaccattccaaataagccctggctctgagtgtctgcttgtgcaaacagatatgcccctgccaccaccccaggaagagagctccacagaacgctcgatatagaaactaatctgcttattgtggtgtagacctcttgctcccatgggcagtcaaagattagatctcaatagttctaactttaatccagaggggacaagaatcgaatgacgtgtttgtggaaatagccatctaacagatttatactctttttaaaaaaataactaaataatccatcagctgagggtctagagaagcaagaagtcccaagtggaaacagcaaaagaaaaagaaacactgaagaggcaagatgaaaccactgactttcagcctagagtcactgcactaagcgccgtgaggccagcaggtggagctgtgactggttggcaaaagcccagatgtcactccagcacaagccagagtcaccatttccaaaggaaatgccaggcaatagggtggggtgaggccttcctaagcccctcgtcatcagtgcctctagttgatttatttctagcacggggaacttgaatctcactaaggatttgccaaaggcaaaaaaatcttgcaatctccccttgctgagcctccaaaatcataggagcatagctctggtagaattctcgttcctacctcacttgattaaaagagtctgactgtgcacagagtggaggatttgcctcgtccagctctcagagttcctgcattacttcacacacacacacacacacacacacacacacacacacacacactacaatgtcatccctttggtgactttacatctataagatgttagtctcacttagttaatgtcaggaaatcttaatgcatgaagtccccagatactacttatcaactgtttaattatcctcatttgggagtaacaaagcaaagatactcagtggagtcagatagatgattttaaatgccagcatgttgattctgtgaagactattcgcacattctgtggagcaggctaccttcccagccagcttcccagttccttgtcgctgctgctcttccccagcccccagcctgacctggggaccaaacggaagagcagcagcttccagcaagtgagatcacaggaagaggctgggaagtctgagcttcctctcagcccacacacccttcctctctcatgcttgggctgctcctctcacttcctgtggtgctcactctggctccttctgccctgatagtgaggaataatatgggtattagccagagccctgccattttgcacaagtcttccattctggttaaactaccataatttgatcttcggagttacagtgactggtttctctagatttctgtctgcctgccccagagacacccttaatggctgaccagaaatgatatttatccatcacctaatattatttaactgagcactcacacagccaacgcagaccaaaataaagaaacttccaatctctttcccatctaccaccctgtgaaagctctaaggaacccactttgctgctgtttgtctgtgtttccatgacataaatactcttttaataaatcttttaccctaatagccgcctacctcagtatacccagtgagccccaaacctgaaatacgagcactttccgttcaccttagagtttgaggtgactcccttccatttattctgacccctaagtgtcacaatgggttggcacaccccaggagggcagcattccacctgcacttgggttcaacagcagagagagattgctcttcaccatcatccatcagtactagaatctttgttgatgagactgacacaaatgccatggtagaagtgtatgacaagctggtacagatatgctggcaaagtaaaatattcaaaaagttaaaggcaaatctcactacagacagatctgtgccatttgtggttatctgggaagtggcaccacaggctgggtctgcagaacatccaaggggagcatttactgggaggacctagggagctaaaagacgcagcaagaggctcccgaaggcaggagcctggcctagggcagagggagacgccgctgagaaggctgaggaagcttgactcctaggtgctctaacatgcctaggatcacaggagaggccacaacatctgcctcaacacctggagtaactgggtccccctgggatccagggacacaggacccccaacctggccagtggcgtgggttccttctggtctgaatctgtgccctgagcagaccttgggcactggctctgcacacagtcccacaacaccctgaggaagctcgattccaaagtgcaataacacagccaggataacaagtgaggagcatgagagcactgatcacatgcgcattgggcaggaatgactgagctgtagtacccagctgttctctatctctgccgggttttacctgggcaggagctgctctaggtccagagagcgtcatacctggaaggtgctggttggcccaggccccagactggctctctcctagggttactgagccgcttgctgcctgttgaccatttaacttagatattatgttgctaaggacagaattataggcatgtaaatgttagttcagaaggagccaggagagggaatatacatacaggaataaatatagggaaagagagtggaaaaaaagaaacaatgtaatgaagttacaaaattacactctttaacatcctacaaagtcatagagccatagcatgtgagacctatctgcagacttgacttgcagtattagttactttctcactgctatgaggaaacatcatgaccaaggcaacttacagaaggaagagttgatctgggcttacaaaggaataagggtccatcaccaccacagcaggaaggaatggcagcaggcagacatgctgtctggagcagcaagctgagagctcacatcttgaaccaggagcatggagcagagagaatgaactggaaatggcagaagccttttgactctccaagcctacctccagtgacatacttcctccatgaaggccacagctcctcaacctcccagaaacagtatcaccaatgaggaaccaaatgttcagttacataagctataagggacagtctcattcaaaccagtacactggagtagataaatacctttagaatacgagccgaatcactagcaaactgtaggtcagacatggccacatattttgaaagctatccaaagaacagtgttcttctgatctctgcagagagcttgctccaccacaggtatgtgtggagctgagtgtgctcatggaatagaaagctctagctgtagatttccagcttcagcctcatcttgatctccccaccagcaaattatcccagctgagtgagaaattcctaatggtttcccaaccaaactcattggtcctggttactggtggtagccaggattaggatgaggcaccccagggacaggcttagcctcgggaatgttctgaatccccatcatgtactcactatgtgctttaggaaactcagttactctcttgtgtttcagatttttcatttgcaaagcaaaggtaatcataacactggccagggcatgctaaggagagaaatggggtgtgcttgtaggtgtttggcacacctggtggacaggagaccaagtcataaatgactgggattgggagccatactgaaaatgatgactgaagacaaagatgttggtttgatcattttattaagcatgtttaaaactttgacaactgttaatcaaactagaaagagttccaagggaaggcactattggtaactgcacaaaagaattcctatttttttagagcagttgggctcctttcagtctgaacctacgccctgagcagaccttgggcactggctcctaatccagtcccacaacacccagaggaagcttgactcccagatactctaacatgcctaggatcacaggagaggccacaacatctgcctcaacatctggagtaactgggtccccctgggatccagggacacaggacccccaacctggccagcggcatgggttccttctggtctgaatctgtgccctgagcagaccttgggcactggctctgcacacagtcccacaacacccagaggaagctcaactccaaagtgcaataacacacccaggataacaagtgaggagtcaacatctgcctcaacacctagagtaactgggacccccggggtacctaggaatgcaggaaaccccacctggccagtggcatcagttccttccagtttgaacctgcacccagagcaaacctggggtgctgactctgcacccactcctacaacacccagagggagcctgactaccaggagctctgaaacgcccaggatcacaaaatcacaaagaaagctcaactcccaggagtcccaagtctccgaagaaagaaatcaaagatctcagaagatggaaagacctcccacgctcatagattggcaggattaatttagtaaaaatgaccatcttgctgaaagcaatctacattttcaatgcaaaccccatcaaaattccaactcaattcttcatagagttagaaagaacaatttgcaaattcgtttgaaataacaaaaaacccaggatagtgaaaactattctcaataaaagaacttctgagagaatcaccatccttgacctcaagctgtactacagagcaattgtgattttaaaaaacaaaacaaaacaaccaaccaaccaaacaaacaaacaaacaacaacaacaaaataagctgcatggaattggtacagtgacaggcaggtagatcaatggaatagaattgaagacccagaaatgaagccacacacctacggtcacttgatctttgacaaaggagccaaaaccatccagtggacaaaagacagcattttcaacaaatgatgctggttc

SEQ ID NO: 956 - DNA, 7318 bp, Mus musculus
atgaagacagtgccaagagcagctgctgtggtcattgttaataatgcacccaaaaacctgtttctcttgtttgccacagtctgcggtgtgggagctggacacctgctcatttccttctctgctcgatttcaacaagaaaaacttaggattccagggattcccacatcaaagaaaagctgcaagtatttagcctccatcttaattaaatatggcattaatggggtaactttcagctttcagaaagagttttcttttgatgataaagaagagcctgccaaccacaggagaggccttgatgtcaagtgcttagctgtgctccctaaagttgcagaattaagaaaaatctttgaaccaaagaggaaagactttttagaaatgaaaagaaaagaaagaattgctaggcgcttagaaggaatagaaaatgactcccagcccatcctgttgcagagctgcacagggctagtgactcatcggctgctagaagaagacacacccagatacatgcgtgccacagaccctgcaagccctcatattgggcgatccaaagaagaggaagacactcctgggtcctccctagaaaagcaaactccttctaaatactgcatagaaacctcaggcatccatagttcgggctccatggacacccacagtctggagtccaaagcggaaaggatcgcaagatacaaagcagagaggaggcggcagctggccgaaaagtacgggctgaccttggacccagaagctgactctgaatacttgtctcgatatgccaagtctcggaaggacccagatgtgactgagagacgaggaaaaagtgacaagcaagaagaacagagcaaggatgccaattcccggcactccaggacagagtcagggcccaggaccagcttggtggcgtcccaggactgtaccccgctgggaagcaatatgtctgaccaggagcagctgctcaatgtggagaaccagagaagagtccaagatcccccactaggagaagatggctcctctgccttcttttctgagcgaagcatttccttccccgaagtgcccaggtctccaaagcagatacccagctcaccactgcaacagccagcctccccaaaccaccccggtgactcaccactgcccacagaggcccgagccagagttaaagttagagaaaaattggtgaaagaggagagtgctcgcagcagccctgaactcacctcagagtccttaactcagaggagacagcagccggcaccagcacatttcctgcctatccagtcagaaagttccacctttgatagggtcaccagcaaagcagtgagctcattgcagccaagccagagtggtgttctgccaactgaccctgttcatgccatcaagctggtgaccatggataccccagaaagcacatctgaattcagctgggtggggtcagccaccccaaaagttataaaatctaccaccttgaagattctagaaggtggttcaagggatgctccagtactccatatttgtgagtcaaaagcagaagattggctctccccagaacctctggagaggagccccaagtcacttttgacctcagaagatgacaggctcgtgagaggccacaaagatccctctggtaataaagacttggacaaggccatcatttgctccatcgatgtagaatctgagagggagcggcaagttcaacacctgcccactcagagaactggccggagtgaaatgctcctgtatgttcagagtggtcctgtgtcccaagatgccacattgaccagtcacacaaaggaggcatctccaaagaagcgcaaggttctggcccgctctctgtcagattacacaggtccccctcagctccaggtccccagacacaaggatgaagccccaagccaggagctggagctgcagagttccagggcagaagggcctggtgcagaagccagcgtgctggacaccagagtctccgtcgcccagctccgaaacatatttatggagtcaacccgagccagcaagaaacctgaactccaatcccgggttgagaggtcagctgaaggaattggcttgcccatggaacgagagagagggtctcggaaaccaagacgctatctttctcctgatgaagaaaaggtggatgagcgggccaagctgagcgtggctgccaagaggctgcttttcagggaaatggagaaatcctttgatgaacacactgtcccaaagagacattcgagaaatgcagctgtggagcagaggctgcgtcgcctgcaggaccgttcacacacacagcccatcaccacggaggaagtggtcattgcagctacgttacaagcatctgctcaccaaaaggctttagccagggaccaggcaaatgagggcagagagtctgccgaaccaggcgaacctgattcctccactctgagcttagcagagaaattggccttgtttaacaaattgtcccagccagtctccaaagccatttccacccgaaacagaatagatgtgcggcagaggaggatgaacgcaaggtaccagacgcagccggtgcagagtgggaaactcatctccttctcccccactgtgaacacctctgtttctattatggcctctgcggttgctcccacatatgcaggggaccttcggaagctatctgttgacaacaacacaagtgccactgactataagtctcctcctgcggaaaactcagactctccagtcagaagcattctgaaaccacaagcttggcggcctttggtagagcacagtgggagcaaaggaatgccgggggagtctggaaagacagaaagcaagaatgctctgactgtggctgcagaagacagtggcgttcaaacacgaggagccttcgaggaggaagaggagccctcctaccccatccttggcagagtcagggagggtgatggccagaaggagcctaagcatgtcgtcctaaggaggggaagcttagagctaggcaatccttctgctgcacaccttggtgatgagctgaaggaagtttccactgctaaaagcagtttgcaagagaatctagacctgaaggataagcaggcctcagaggagaacacagatgtggaaactgtcatgaggaagttctcactgaaagagtttggagaaacgacttctgagcagacagaggtggctgccaggaaggcctcggttcagatggcgaccccaggggcctggaagcagcaggagtcctctgagcaactagcagagaagctcttcaagaacccttgtgccatgtttgcttctggagaggtcaaggtgccagtaggcgacagtttcctggattcacccagcaaaaccatgtcaatcaaagaaaggctggcactgttaaagaagagtggcgaggaagactggaagaacaggctgattcggaagcaggaatatggcaaagccactggcggcctgcacacgcaggaggtggagcagtccctgaagaaaaagagagtcacagaaagtcgagagagccagatgacgattgaagagaggaagcacctcatcactgtgcgcgaggaagcgtggaagacgaagggcagaggcgctgccaatgactccacacagttcaccgtggcaggaagaatggtgaagaaagttgctgggatacaggaaacggttctcacggtcactggcaaatctgtcaaggaggtgatgaagttggatgatgatgaaacatttgccaaattctaccgcagcgtggatcacagtatacccagaagtcctgtggagctggaggaggacttcgatgtcattttcgacccttatgctcccaagttgacatcttctgtggcagagcataagcgccaggtcaggcccaagcgccgggtccaggcttccaagaaccctctcaagctgctggcagcaagagacgacctccttcaggaatacacagagcaaaggctaaatgtggccttcatggagtccaagcggatgaaagtggaaaagatgtcatccaactccaacttctcagaagtgactctggcaggcctggccagtagggagaacttcagcaacatcaacctgaggagtgtcaatctgatggagcaaaactccaacaacagcgcgatgccctacaagaagctcatgctgttgcagattaaaggaagaagacatgtgcagacaaggctggtggagccccgagcctcatcactcaacagtggggactgcttccttctgctgtctcctcagtactgcttcctgtgggtgggagagttctccaatgtcatcgagaaagcaaaggcatctgaacttgcaacgttaattcagacaaagagggagcttggttgtagagctacatacatccagaccatcgaagaaggaattaacacacatactcacgcagccaaagacttctggaagctcttgggtggccagaccagttaccagtctgccggagacccaaaggaagatgagctgtacgagacagccatcatagagacgaactgtgtctaccgcctgacagatgacaaactcgttcctgatgatgactactgggggaagattcccaagtgttcccttctgcagtccaaagaggtcctggtgtttgactttggtagtgaagtttacgtgtggcatgggaaggaagtcacgttagcacaacggaaaatagcattccagctggctaagcacttatggaacggaacctttgactatgagaactgtgacatcaaccccctggaccccggagagtgcaacccgctcattcccaggaaaggacaaggacggcctgactgggcaatatttggaagagttacggagcacaatgagactattctgttcaaagagaaattccttgactggacagagctgaagagacccacagagaagaattctggagaagttgtccagcagaaggatgacccgagggccgacgtcaagccttatgatgtgacacggatggtggcgacgccccagattacagctggcaccatcttagatggggtgaacgttggccgtggctatggcctggtggaaggagatgacagaagacagtttgagattgccactgtctctgtggatgtgtggcacattctggaatttgactacagcaggctccccaggcagagcatcgggcagttccacgagggggacgcctatgtggtcaagtggaagtacatggcaagtacagcagtgggaagccgacaaaagggagagcacctggtgagagtggctggcaaagagaagtgtgtctatttcttctggcaaggccggcactcgaccgtgagtgagaagggaacgtcagctctcatgacagtagaactggatgaagagaggggggcccaggtccaggtcctgcagggaaaggagccaccctgcttccttcagtgtttccaagggggtatggtggtgcactccggacggagggaagaggaagaagaaaatgtgcaaagtgaatggagactgtattgtgtgcgaggagaggtgcccatggaagggaacttgctagaagtggcctgtcattgcagcagtctgaggtccaggacttccatggtcgttctgaatataaacaaggccctcatctacttgtggcatggatgcaaagctcaaggtcatacgaaggaggttggaaggactgcagcaaataagatcaaggaagaatgtcccctggaagcaggtttgcacagcagcagcaacgtgacaatacatgagtgtgacgaaggatccgagcccctgggattctgggacgctctggggaggagggacagaaaggcctatgactgcatgcttcaagtccatctggaagttggtccatatggtgtccttagctttgttctcttttctttggaagatcctggaagttttaacttcgcgccccgcctgttcatcctcagcagctcctccggagacttctctgcgacagagtttgtgtaccccgcacaagcgccctctgccgtcagctccatgcctttcctgcaggaggacctgtacagcgcgccgcagccagctctcttccttgttgacaaccatcacgaggtgtacctctggcaaggctggtggcccactgaaaacaagataaccggctctgcccgcattcgctgggcctcagaccggaagagtgccatggagacggtcctgcagtactgccgaggaaagaatctcaaaaggccaccccccaagtcttaccttattcatgctgggctagagcccctgacattcaccaacatgtttcccagctgggaacacagagaagacattgctgaaatcacagaaatggatactgaagtttccaaccagatcaccttggtggaagatgtattagccaagctctgtaaaaccatctatccactggcagatctgcttgccaggccactcccagagggggtcgaccctctaaagcttgagatttatctcacagatgaagactttgagtttgcactcgacatgtccagagatgaattcaatgcactgcccacctggaagcaagtgaacctgaagaagtcaaagggcctattctgagggtgagatgacagggccacagagaagtcgctgccgctagacccgaaaatgaatggagatacatatttggactagtagttttttctgtcaaagaagaaagtatttttgaatcagagtttttcaaaacctacagcttgttctagagttgagcattctgtaaatgtataagagaactcttctgattgttcttttccacagttcaggtgaactgaaaagaaaagtgtcttttccgttcccctcagccaagtgctgcctcagtggccgctgcagccctacccttctggtctggctcagcactgccttttttaaagcaattctctttataaagtgttattttgatagtttgtgaattctaaatatatatatatatatttatataaacacatataaatcaagtatgtatttaacaaagcaatatgtattcattcacttgcaactgttttctttggtgtcaaaacaatattagaggactgtgttgcttctgttgagttaagcctaccaccagtctgtcccgtgctcaggagtgcctccttcagccttaggtctggcttgtgctaagttctgcttccggtgctaaagcaaacaaagactttgtattcttagtgtgaactctgaagaatctatttgaatcaacctttctaccttaatatctccccccagaaatgtatagtgccttgtttatgtacagtttatatacagaaaagtttgctctgcttttttgatgctggtttggaatattatctacagctttattctcagtagaaataaaaacatctcaatttctcatacccattgtaaacattacacatgtcattttgtggcacaggatcccaaaataaaatatcaaagtaatcccaat

SEQ ID NO: 957 - protein, 2152 aa, Mus musculus
MKTVPRAAAVVIVNNAPKNLFLLFATVCGVGAGHLLISFSARFQQEKLRIPGIPTSKKSCKYLASILIKYGINGVTFSFQKEFSFDDKEEPANHRRGLDVKCLAVLPKVAELRKIFEPKRKDFLEMKRKERIARRLEGIENDSQPILLQSCTGLVTHRLLEEDTPRYMRATDPASPHIGRSKEEEDTPGSSLEKQTPSKYCIETSGIHSSGSMDTHSLESKAERIARYKAERRRQLAEKYGLTLDPEADSEYLSRYAKSRKDPDVTERRGKSDKQEEQSKDANSRHSRTESGPRTSLVASQDCTPLGSNMSDQEQLLNVENQRRVQDPPLGEDGSSAFFSERSISFPEVPRSPKQIPSSPLQQPASPNHPGDSPLPTEARARVKVREKLVKEESARSSPELTSESLTQRRQQPAPAHFLPIQSESSTFDRVTSKAVSSLQPSQSGVLPTDPVHAIKLVTMDTPESTSEFSWVGSATPKVIKSTTLKILEGGSRDAPVLHICESKAEDWLSPEPLERSPKSLLTSEDDRLVRGHKDPSGNKDLDKAIICSIDVESERERQVQHLPTQRTGRSEMLLYVQSGPVSQDATLTSHTKEASPKKRKVLARSLSDYTGPPQLQVPRHKDEAPSQELELQSSRAEGPGAEASVLDTRVSVAQLRNIFMESTRASKKPELQSRVERSAEGIGLPMERERGSRKPRRYLSPDEEKVDERAKLSVAAKRLLFREMEKSFDEHTVPKRHSRNAAVEQRLRRLQDRSHTQPITTEEVVIAATLQASAHQKALARDQANEGRESAEPGEPDSSTLSLAEKLALFNKLSQPVSKAISTRNRIDVRQRRMNARYQTQPVQSGKLISFSPTVNTSVSIMASAVAPTYAGDLRKLSVDNNTSATDYKSPPAENSDSPVRSILKPQAWRPLVEHSGSKGMPGESGKTESKNALTVAAEDSGVQTRGAFEEEEEPSYPILGRVREGDGQKEPKHVVLRRGSLELGNPSAAHLGDELKEVSTAKSSLQENLDLKDKQASEENTDVETVMRKFSLKEFGETTSEQTEVAARKASVQMATPGAWKQQESSEQLAEKLFKNPCAMFASGEVKVPVGDSFLDSPSKTMSIKERLALLKKSGEEDWKNRLIRKQEYGKATGGLHTQEVEQSLKKKRVTESRESQMTIEERKHLITVREEAWKTKGRGAANDSTQFTVAGRMVKKVAGIQETVLTVTGKSVKEVMKLDDDETFAKFYRSVDHSIPRSPVELEEDFDVIFDPYAPKLTSSVAEHKRQVRPKRRVQASKNPLKLLAARDDLLQEYTEQRLNVAFMESKRMKVEKMSSNSNFSEVTLAGLASRENFSNINLRSVNLMEQNSNNSAMPYKKLMLLQIKGRRHVQTRLVEPRASSLNSGDCFLLLSPQYCFLWVGEFSNVIEKAKASELATLIQTKRELGCRATYIQTIEEGINTHTHAAKDFWKLLGGQTSYQSAGDPKEDELYETAIIETNCVYRLTDDKLVPDDDYWGKIPKCSLLQSKEVLVFDFGSEVYVWHGKEVTLAQRKIAFQLAKHLWNGTFDYENCDINPLDPGECNPLIPRKGQGRPDWAIFGRVTEHNETILFKEKFLDWTELKRPTEKNSGEVVQQKDDPRADVKPYDVTRMVATPQITAGTILDGVNVGRGYGLVEGDDRRQFEIATVSVDVWHILEFDYSRLPRQSIGQFHEGDAYVVKWKYMASTAVGSRQKGEHLVRVAGKEKCVYFFWQGRHSTVSEKGTSALMTVELDEERGAQVQVLQGKEPPCFLQCFQGGMVVHSGRREEEEENVQSEWRLYCVRGEVPMEGNLLEVACHCSSLRSRTSMVVLNINKALIYLWHGCKAQGHTKEVGRTAANKIKEECPLEAGLHSSSNVTIHECDEGSEPLGFWDALGRRDRKAYDCMLQVHLEVGPYGVLSFVLFSLEDPGSFNFAPRLFILSSSSGDFSATEFVYPAQAPSAVSSMPFLQEDLYSAPQPALFLVDNHHEVYLWQGWWPTENKITGSARIRWASDRKSAMETVLQYCRGKNLKRPPPKSYLIHAGLEPLTFTNMFPSWEHREDIAEITEMDTEVSNQITLVEDVLAKLCKTIYPLADLLARPLPEGVDPLKLEIYLTDEDFEFALDMSRDEFNALPTWKQVNLKKSKGLF

SEQ ID NO: 958 - DNA, 204621 bp, Homo sapiens
  misc_feature (1)...(204621): n = A,T,C or G
ccccagaaatcagtcttcctgatctcagcctcccacctcccaccattctgtccccacaggctgactcctgtcagaccccatcctcccacgccccagttttcagatgggaccctcctcctcagtcttgtagcccctgccctcaatacagaagtcactggctaaaccttagggtaggaagttcccactcgtgctgtcaaggagacatggcccaggatccacagttggagccaaagatacattgtaagatacaacacatagtgtttctggtttctttctttccctctttctttctttctttctttcaggtggaatcttgctctgccgcccaggctggagtgcagtggcatgatctcggctcactgcaagctccgcctcctgggttcaagtggttccgttttatagaattattgggactgtggttccactctattacaagcttatcgggcttctgtgggttggccgagtgcatagccattacgtagagctctgtttctggaggaagatgagaatggaaccttcactgggctacagagtgcttggcccaggggatgtggggtttctcggtccttggggctgggagaacatgctcagagaaggctcctcgctcctgtgtgtctctaaggtatagatgatgctccctgaggagcacagtctcctggagtttttctttcaggaataagaatgatccattccctcttggtatttggaatcagccaaacaaaccacatgtggtgctgagctttgtgatgtcaacaacagcagggaagggaagagcctcccaggtcctcactccactggtcacatcaccgtcagctcatgtccccatttgagcagcagcctccatggttctgttcgtgcagtgagctgctgcttgacagcagacagaaatcccatatttttagatatctagtggcccaaacggagcatgtcacactttgtacatctctgattactctcaagactctgagcctggtgtccaggaacgcgatgttgctccagccgtgtgagaggctgggtctctggagccaggactcataaaccacggtccaggctcacccctggcaagttcacatctcattttgaccacgaggccagcagttctctttgtgttgagctctgctacacacccattgctctgaagctacagcccgggagagaaaagttggctggctcatcagtggttcaagccagtgacttacagatgaccttggagctcaaagattttcagctaaagccagtaaagttctccaaaagctttgagaaaaagcgagaccagacagacagaaagacagactcaattgattgaattattgattgattcagatttccggcaggggtggggggttgttggttgaaaaatattaactgaaaataatatcccctttttgtctttaaaaagaaatttatgcacaaacaaaatgacttgcccatggtacagaaggccacaagctcgattcatacaggtgtatcggtgtacatatcagtagactacagcatgtctctgtcttctcccatagaggtcaaaatcctaagctttttgggaaaaggaaatgattccaagtctggttccatcgtggcagaaaatagggcaaaatacaggtcctggttgcctagccttttcatctcctggaaatgagctgcttaaaaaatacctccagtgattgatcaagttcattgccctgtggaaagcagaacttttcagaaggcagaagcaaggagacagagagtgttgttgtcttactttcctgcactgacagtcctggccaatgctctgacatcatcttgagtccagaaataggagtgagaaatggacagtgaggccactacacagaaacatttgagctggtgatgcatgttttcttttctgcctgtgagctgaggatccaacttgtgactgtttctccagctctggagggatattgcaaattgattaatccaccctgacaaaagggagaatgttgtagctgcattaaaatgagaagagagcggccgggtgcagtggctcacgcctgtaatcccagcattttgagaggctgaggtgggcggatcatttgaggtcaggagttcaagaccagcctggccaacatggtgaaacccagtctctactaaaaatacgaaaacattattcaggcatggtggtatgtgcctgaggtcccagctacttgggaggctgaggcaggagaatggcttgaacccagcaggtggaggctgcagtgagctgagatcatgtcattgcactccagcctgggcgacagagtgagactctgtctccaaaaaaaagagagagagaagagatctaactgcagactattttgatattttcagtccacatcacaaacatttattaaatttactgagtggcacatgttgctaggtcctggtaatatgaaaatgtcatggagtctctgctaacagcctagagattgggaatcagagaccatgtctaggagagatttgtaggggaaatattctcaactaaggcttgaagtatgattaggggtcggtctttctttctttctttctttctttctttctttctttctttctttctttctcactctctctctttctttctgtttttgaggcagagtctcactctgttgtctaggctggagtgcagtggcacaatctcagctcactgcaacctctgcctcccaggttcaagcgcttctcagcctcgggagtagctgggattacaggctcgagccaccatacctgactaatttttgtatttttagtagagacagagtttcactgtgttggccaggctggtcttgaactcctgacctcaggtgagccatctgcctcagcctcccaaagtcctgggattataggcatgagccaccgcacctggccagattaggggttttctaagtgagaagggtggaaaggcattctgagcagagagaacaaactagacaggaataggaaggatggccagggtggctggtgtctcatggttgggcacaggtcacctgctggtgggagggaggataggaggttccagctcagagaagtgggactttggaatgtacccaacaggctggacatccttgagttttttgttttcttttgttttctgttttccaccaacacaagtaatcgcatccctcctgggtttatctaaatgtggtgctggtaatgaagctaaggcatcacagtccttgtaagcctcacagcttgtaggaatacacctgcacaagtaagtcactgcaggtcttagtctgtatgagataacctaagggttaagtgtcatttccaaactatttatttgtaactggataccttttttctcctactgatgagtatctaaatgcaagagagtgacaatgattctaagtatagtcttacatttgtcctttaacaaatttatttttattttttattttttatttatttattttgagatggagtttcgttcttgtcacccaggcaggagtgcagtggcgcgatctcggctcattgaaacctctgcttcctgggttcaagcgattctcttgcctcggcctctgcagtagctgggattacaggctcgcaccaccatgccgctaatttttgtattttcagtagagatgggtttcaccatgttggccaggctggtcacaaactcctgacctcaggtgatcctcccacctccgccttccaaagtgctgggattacaggcgagacctaccacgcccagcctattgttttaaactttattttttattatattcattttactatttttttaaagagatggggtctcactatgttgcccaggctggtctcaaactccttgcttcggtccttccacctcgacctcccaaagtgctaggattacaggcatgagccactgcacccagccccctttaacaaatttaattttataagtttgccatatgggccaggatctgggacgatttgctagattaaaaaataaaaacataaaatataaaaaagacaaaaagtttgccatgtgggcttccatgggtaagaagcaagcgctatccacctgtctgttggaggcagcacctgccaggcctatgcttgagaactgctgggggactctccaggagggtttttattgggagtgagcaggcagggtggggccgtttaaaggccattctggaagtggcggagaggatgggtttagagaggtggaagtgaagtttggaggctccaggcataagcctgactcaggcccatgagaacatcaatggggtggaaggagagaggaaggttaaaggcaggaaccgaggcttagtgactgctgagatctgaatgatcactcaagtgaggcagggccctgatttctggtttgggtggccaagttgccgatggggaggttgcggtcaggtaggaaaccaggtacaagtttcctgatgggagatgggagatgacgggtgtagcttgatttctcttgagttccatgttcccgtgagatgctcctggtttgctgaacttcagggaatcaatcaccagtcttctgacttctgctttaggtgtggcagacggagctcactctgggagaaggtaggatgataccagcaggctcggagtcctgggaaacatatggacatttgagggaggcagaggtggacactcagtgaaacaactgaggagtgatcagaaaggcatgggagagctgaggaaaggagtgttggagacattttacgaagaggacattccatggaggcggaagtggtcagaaagtgccagataccatacaggccacatctagatgaagcctcaggagagtgtgttgttgggagagcagtttctgggttgtaggggagccagaatccaatgacaaaacttgctgggaagcacatggggctgggggagaggagacagtggttctggaacattcagggtgataaaaagaagagaaggtaggcaagagcttgaagacagaggtggggcccaagggactttgggggcagaagatgagtcgctggagcatattctgggcttgtgctgcctcgtcaacgaactgaaaagaagcctcatctcttctgtgcatgacctggcattccccaaagcgccagaaaagtccagcataagttagactggcctccaaagtgggaattcagggagtttggatctaggttttatgttatggaaactgagaagataaagggccctgaaacctccatctgcccattccacttctgggaaggctgaactgttatatcatctatttattttcaagaataaagagttcagctgggtgtggtggctcacgcctgtaatctcagcactttgggaggccaaggcgggcagatcacgcgaggttagaagttcgagaccagcttggccaacatggtgaaaccctgtctactaaaaatacaaaaattagccagatgtggtggcatctgcctgtgatcccagctacttgggaggctgaggtaggagaatcgcttgaacttgggaggtgaaggttgcagtgagccgagatcgtgcattacactccagcctaggcagcaagagtgaaactccatctcaaaaaaaaaaaaaaaaagggccaggcgcagtggctcatgcctgtaatctcatcactttgggaggctgaggtgagcagatcacgaaatcgagagatcgagaccatcctggccaacatggtgaaaccccgtcgtactaaaaatacaaaacttagctgagtgtgctagcgcacacctgtagtcccagctactccggaggctgaggcaggagaatcacttgaactcgggaggaggaaattgcagtgagccaagatcgcgccactgcactccagcctggtgacagagtgagattctgtctcaagaaaaagaaaaacaaaaaagaaaggggaagagttctagagaacagatttcaaaaacttgttttctattatatttatagcagtattcacattggaagaccagtgcagtgacacactttcgttatcccagctactcaggtggctgaggcaggaggatcacataagcccaagagttcaagaccagcctgagccaaatagtgagaacctgtctctaaaaatgaaatataatcaaaaattgagatgacccgatctcctccctttccaaaaagttgttttcttgctatttctccagagttggtcaggttttaaaaattaataatctggggcagtagatgaaatttctgaaaattatgtgcaggtttccttttttatttttggatgggccctaggtattagaggtgctctttttaagtatctacacagcctgctaaataaacacattcaattggaaagcaatgctttccatttcttattctgtatcaaatattttactttcggattaactttcattcttatagggaaaaataaatatttccagtttgaaattcgtaagatggcattgataataagtaaatctctatagatttatgtgaagtacagttacagtaagtcacccatttacaaatggattatatttgaaagtttcatttgaagtaggtttgttttttggggttgggatgctttttccttggaaaaaatacttaattaaactttttttttttttgagacagagtttcacccttgtcacccaggctggagtgcaatggcatgatctcagctcactgcaacctccgcctcccgggttcaagcaattctcctgcctcagcctcccgagaagctgggattacaggcacatgccagccaccatgcctggctaatttttgtatttttagtagagacagggtttcaccacgttggctaggatgttctcaatctcctgacctcaggtaatccatccgccacagcctcccaaagttctgggattacaggtgtgagccaccccgccctgcttaaacttttaattttgagataattatagattcagatgtagttgtaagaaatagtacaaagtgatcatgagggctttttacccagtttctccagtgataacatcttgcaaagctatacaatagtatcacaaccaggatattgacactgatgtggtcaatccaatagaagagttccagaacaggggtctctcatgtggccctgttaaaccacctcatccccatccctaacctctaacaactcccatctcttctccatttctataatgttgtcatctgggaaatgctatgtaagtgtactcgtatagtatctaacattttgggattggctttctgtcactcagcataatttaattccctggattcttatccaggtcgtggaacgtactaataatttgttcctttttattgttgagtagtattccatggtatggatgtaccacaatgaggattgggtagaagctcattgcttttgcctaggggtgtctaattgctctagcactgtttgttgaatggcacagaaatcagtttggcatattcatgtgggcctgtctctgggttctccagtctgttccactgatctatgttatgtgtctctctttttgccaatgctgtgttgtcttgattactgtagttatccagtaggccttaatatgggatagattcattgctctaacttttttcttcttttgagacggagtctcactctgtggcccaggctggagtgcagtggcatgatcttggctcactgcaacctctgcctcccaggattgggttcaagcgatgctcctgccttagcctccctagtaactgggattacaggtgtgcaccaccacgcctggctaatttttctgtatttttgatagagacagtgtttcaccatgttcattaggctggtctcgaactcctgacctcaggtgatccacccgcctcggcctaccaaagtgctgggattacaggcatgagccaccacgcccagactaacttttttcttctttttcaagatggtttttagctattctagggcctgtacctttactataaattttagaatatctgccaaaaatcactgtgaggccaggcagggtggctcacacctgtaatcctagcacttaagaaggccgaagtgggaggacagctggagcccaggagttcaagacaagcctggccaacctaatgagactccatctctacaaaaactaagaaattaaaaaattagcccagtgtggtggtgcacatctgtagccccagatattcaggaggctgaggcaggaggactgcctcctggggaggttgaggctgcagtgagccatgattgcacacctctactccagcctggacaacagagcaagaccatgtctcaaaaaaacaaaacaaaacaaaacaaaacaaaaaaaccttgcaagattttgataggaattttgttaatctgtagatcagtttggggacaattgacatcttttgtgtgttgatttttcttccaattcatgattatcatcattggaaagaagtgagtatgatgagtcttctaagccaggcagatagcaaaaaaattaggaaagtaaatggattgcacaggaagaattaactgggatttaaataatcaaagacagaaaggatatataaaagaagtgacgaaggagatttaccctattagactccagtgtattaatctaggacagtttggttgctatggggaagcagtgtgcaaaaacttaagaggcacacaaaagactgatgtttattttgtgggagtgaatctttttttaggaaggaaatagcactattgtggtaacagtgattcattttctcctcctatcttctctttacagagaagacccaaatagtgaactgtttcatgtaagtttttatttatttttgccctacttttctctagggaggggcttaccacagcttataaaaatacgtaaaacaagatcaaataaactttaaaatgaggaaaaagccaatatggtccaagggaaaagaagatcagggtcaggactgagattaggatgcaaaagccatgctatgaaattttgtttgtttgttatcttgagatgggtaaaaaaaaaaaaaaacagttgactgggacaaatacccctagcacaaaacagtcatgaagccaatgtttaattattatacctgtcatcttttcacctggcctcaggactgtcctcttagggagaggcattgttctgtagggttaattagtaacaggaatttagatcctgctttgagaggcctcctgtgctggccgaagcagctggtggtctgagaaccctgacacccagaggcataccactgggaggccccgcgcagcacacagcttttgctgtactccagcccaagtcttatggggtttgtggtttatactgaagttggtgcagacaattaagactctctgttcttggtaccgacagggacagagacctacaattgtaagtattttgtaaacagggttgtgatatttgtttgagtgtattcaacatgtcagtggccttttaatgtttaaaaaaatgcatatggccatttaagaagtggttgtgcttcatagttaatatttttttcattaggttaggttcatctggtttttcagtgaggtgagctacctgagagccataggaagatagatcttgccagttcagaggactgactttggctttaagagaaaatatttgtgtcattttcgagaaagtacttccagcacaatgctttcttctgatgattcattttctacagttattggaagtgggaagaaatccacagaggttacagaatttgtaaacttgtagagacatgtgccattatatcatgctgtttcatagatgtgtatgtctgttagttacttttcgggcattcattgtatatatgtctgttacttacttttggggtgttcagtgtctgagctttgtcaacgattgtgtgctctttttttagcctaaaaaaactaagttagagaaatgtttgctcatccaaatctgtattgttgtagcttattcagtagactgctgttgtatttttaatttctctatacaacaagctgaaagacagtgtggacaacctaattgcatttgaagtagctgctggccaggcctgctgcaacagctgatgggctcctctgaatttccagggctatttctggtagatgagctggtatcaaggctctcgagttcaggccataaaaggcccgtcccatgtgaagttgcttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaagtaagtgaaaaatcttcctataaatctaaatgcagtaggtttttttttgttgtttttgtttttgcttttttttaagtgccatctgtctgagcatgtttcctgaggatttgttgacttcagtcattggaaaattcctgccagcgtttgccagttactgcagccattcctgtagatacccttgggcatatttcttgggttgagaaggattggacttttttttttttttaaaggatttactttatggtagagaaaggtttaatactaacaatttgattaatataacttagtacattctgtctaaatgttagcacttaaagtcttggaattaaagtatattcacaatgcaacgtactttaataatcgtagcacaagtatgggggtggagttcagaagggcaagttttatttcactgccattataattcatgtaaaaatagaaaatcaccagtgatccttttgcataatctttgttctgagggttctttgccttggtactctcattcttcagggcttgatttctagaacttgcgatgttccagaatttatgagaaaaacctcactgtaggttctagagtttgaactgcattttatttttaaattctccaagaaaaaatactgcatcagccttttaaagccctggagattgctatggtctctttgtaatttagctcagtgatttgtttctgctgaaaaacagcagtgaactctagaacatagaaggcttatttgacgtgttgcttctttgaaaaaaaaaaagattatttctttataccacatcagatggacaagtacgggcagtcattatttttaccaggtaggaaaacagagtatttatagagaagaacttcatcggtgaatactgcgagggttcttcaccggagatagtgtggcaaccctagggggcgtttgaaaatgcatgggggtgtttcaggttttctcaatgactcactggcatttgggaggatgtggttaagaattgtaaatgcccaatttacatggtgtaggggacagtcccatacagcattaccctggccaaactgctggtggtatcccctgttgagtaaaactgcaggatataaattgtaccctctgtctccaaagaagagcagcccagtgccaggcagatgtgtgctgtctcttctcaccaaaaccagtgatgtctttttttttttttttttttttgagatggagtctcgtgctgtcacccaggctggagtgcagtggcacgatctcggctcactgcaacctccacctcccaggttcaagtgactctccttgcctcaacctcccaagtaactgggattacaggcacctggcaccacatccagctaatttttttttgtatttttagtagagacggggtttcactatgttggccaggctgatcttgaactcctgacctcgtgatccgcccaccttgggctcccaaagtgctgggattataggcgtgagcccctgcacccggcacccggtgatgtcttgaggatccagggcatcaagtgtgcactagtgtcagagaatttgtcttacaatggaaactttggagtctatactctgtgtgtgtgtgtgtgtgttaaagataatttatttggtcaccttgatcactggatgaggctgatgttatacaagctattgtagtacattaggtgccttcctgcctacctttatttagtactattggtgcatttaattttgccacatgcatagtcttccaagtgaaatttggttaatgcgctcagcttgcagtggacatcagtcagccattcaacaaacagttctttatctttgcttctactttggagacagactgttttgtgataaacagacttctggaagactttggagttcaattcagagtgaacatctttggcaacacctggggttatatagtattctttttttcttttttcttttttttttttttgagatggagtcttgctctgttgcccaggctggagtgcaatgacacaatctcagctcactgcaacctccacctcttgggctgaagtgattctcctgcctcagcctccctactagctgggattacaggcatatgccactgcgcccagctaatttttgtatttttagtagagacagggtttcatcatgttgcccaggttggtcttgaactcctgacctcaggtgatctaccagcgctcggcctcccaaagttctgggattacaggcatgagccaccacacccggcgagttatttaatattctacagttgaggaattgcatccaaaggaaagggcccttgggatttttataaggatgtctggtgagctccagcatgcagggctctcgggctacatggagcgttatggagagtaagctgctaggagccttgtgattgttagggtacaaaggcagccttggaatcatctcctgaatctgcagctgcctgggattttaggacactcattgcaattttatgttaaagcgctgatctcagggtgccttgctgtgactgggagtatccgtaggtctagaactttccagcagttctgggcttcattgatttgtgactcaactaggaatcttctggtcacccttgactcctctccctttaggtccccgaggcctctgccccaccacctcctcttaagcctcgccatcttttttattttttatttttttgagatggagtctcactctgtcagccaagctggagtgcaatggcacaatctcggctcactgcaatccctgcctcccgggttcaagggattctcctgccacagcctcctgagtagctgggattacaggtgtccgccaccacgcccggctaattcttgtatatttagtaaagatggggtttcaccatgttggtcaggctggtctcgaaatcctgacctcatgatctgcccacctcggcctcccaaagtgctgggattacaggtgtccgccaccacgcccggctaattcttgtatatttagtaaagatggggtttcaccatgttggtcaggctggtctcgaaatcctgacctcatcatgatctgcccacctcggcctcccaaagtgctgggattacaggcatgagccaccgcgcctggcctcgcctcgccatctcttacctgggctactgctttgcccttaatggatcccttggccctcggtttctcctccgtctggtctagccacagaatgaccttcctaaacaaagatctcatcttgcactcggccagggccaaaccctcatcgttcctcactgcttacatgcaaaagcctgggctctgtagcctccccttcagggtctttcatgcccctggagttctgttggcaagtctccccaaaatgttgtcttctcttgcctgccagggaagcaatatcaaaggagatgtgccagaagcttcctctgacatgcctctggcctcctgggcctcgactccagcctgtactctagggctgcagtcactaggtcctggtggccctttccttggcagcagggtacccagtgaggtgcttgggtctcacttctcttaccacccccagggtctagcccagtgggcaatccagaaatgtgagttgtttgaacggattgaattgtaacgacttgtgggttcttcatatcgaaatttggctgtgatccatccagtacttttgccctcatcctatattactcacagtagaagctggtgttctgtgttataagttctccttttttttccttcatctatgacaatgcaagcagaaacgttcgtgttgcggtaacaagtccgatggggtttctgtatatggggtttctgtacacgtgcttttgccaaccgggaaattaaggtgtgccgcatgaagtcagtcacttcattattggaactttgcctaaaatgaagaaactcatctagtggtgcaatttgacctaagtgttttacccatacagtcaacttcaacttgggtcacacatctcaggagcagtttgcactgttgatctcaggggctctttagtattggttcagagagatctctgtccctcttagagacactccctattgtaggaggttttgaaagaggcattctttttcctcctaatgtgcttgtccccttctgaaagttgatcctttaatcccaaacaagtttataacctatgtctaactggtttttgtgtaaatatagtaaaagaaatagttttcatatttgctttgggatcattggtctgcccatgtcacagccctgggtacattcatttcagtccatatttttggggcactttccctgtgcagagctccgggtgggtcctgtgggatgcagaagcctatagcgtattccctctcattggcagcctctttcccagagtgtctcggacagggacgtaatggagctattttaccagtcagagtagaagggatgaacaataataacatgccatccattattactgtgtgccagacttaatgccacactctttacctctacaatatatcacttaattatttttattttttgagacagtcttgcctggtcacccaggttggaatgcaatggtatgaccatggttcactgcagcctcgaactcctgggctcaagcattcctccttcctcagcctcccgagtagctgggactataggcaatcactactatgcccagctaattaaaaaaaaaaattctagaggcaggggtctcactatgttgctcaggctggtcttgagctcctggcctcaagctatcctcccattaaggcctctcaaggcactgggattacaggtgtgagccaccacgcccggactctaatttttacagtagcccccaagaaatattagtgcaattgtcttcattctactgaggaaaaaactgagggttagaaatgcttgcccaagcttgggcacataccatgtgcccaaatccagctggatttgaacccagatctagttgacttcagtgcctgtattcataaccgctgctttagccagtgcagcccaaactttaataggaatcacctgcagtcttgttactgcagcgtctgattcagtaggtctgcactggacttagagattcaacaaacaggatccaggtgatgctaattcctgtctgaggacctgctttgagccgccttaggttaattctttgccacgtgcctgagatggaagcaaccagctggggtgcgggactcgaagggggcttccgaggaggagaaggagtctttcaaggctcctctgttcctctaggcttttcatgccaccccttcccgctctctacctacaccattctctcccgtttgtcttattttccactctgctcttctcctggcttctccttgtgttgaaaacatcctcaggtttcatccattctaaataaagctccccttgacctcaagcgatcacttctttctttcctgcccactcactcctcagcactgatcaggagctcttctgtcttctcctcttggacacctttcaagacctcctggttactttgatgtccccgcagcctccctgggatggaacccctctccgtgagaatcccatctcaggtctagtgagggtgatggggctctgacctccatactcagcatccacaccctgctgtgatcttgaggtctcctggcggccttattttaaaaatcattttctgtctctttgcttgctcagctttccttcttaaggtccatttaagattttttaaaaaatcctggtgttcctctttataaggtgaattgttcaacatgtccatttcaggtggaatgcattcatttggcttttagaactgattttctgtttgtaagtagaaattaactcccaattagctgtgtgagaatttgtatcctctgtatctgctatcaatagaaaagaacaattcggttctgggcgaagacccaaagggctttttattaataatgcacctacgatttgtgaactgtgtttaggttcatcagaggcctctcgtttctttctggactttcaattacgttctgagcatggaaagttggcaaataacttaggcttggatggatagatacagtcattgaatagaaaaaccatattgatatttttaggtttttaagatctcacatactttaaatatttcaaaattttaagtaaatactctttcatacattctgaaacattatatctaatttatctcagccaaaaatttaagacatatacatgttgcagttgcacacctgttactccaaaacaaacaaaccgctccagccaaaacccaaatgggaaagcacttgattttcagtagcttaaaatatgttgaattaagaggtaggttatgaaagtgaaaatgacatctgaatgttttagtggttttggatataaattttcttaggaattttttgtttgagttaagctgatagtttagtttactgtgtgctatgttggttgcaaaattcagctacatttgtttattttgcaattaattcaatttgtttgcaaatattgcatcagacatctaaaccagctaataactctataggtttgagccaggttagaaaaaaaggcttggctgtaccgttaagaagcagctagctctctaaattgtgctgatagtcttaatttcccccggatgttcattttagccacacacacataaccatttggatttatgatttcatacattttttattggaagtgctgaatattttaaaattctgtgattagataaaattggtcattgtgcttcagaatagggtgactcagcttcatgggatgtactttacccaacacaggattctcccatttgagatggaatttattaatttggatttgtatcaggtcttcactccagaggcatcagagagctttcaggcagccaactattcttaaatatttcaaaaggaagttgcagtgggcacgtggcgtggagaacacagcagagcaaagtgatgtaggggccataacagccaacatgctttgtttccttcattcattcacctacctccccaaaagtccaaagaagtgttttccctgctctcggtgcaggaggaagattttatctggaaattgaaggtgtcaatggccagagaaagaaggaggaacattgattttcatgaataaccagctgtgtgaccttgggtaaattcttaacctctctgagcctcagtggcctcattcattcaaacaagggttggactagaggatttttaagaccccttttacgtattgggattctgtaatccaaaggtttcagagatcgagaataatctgtcttccttggaaaggcaacaccttgtatctagttcaaggtgggagagcaggaacaaattagaaatgtgttgagaaagaagatcttttttaaaaagtcctctcactgtccttgcttgtttctgttgaaatacacagactgtttctcccttctctgatggcttcataatcattctttgtctttgattcttattatttattttattttattttattttattttcattttatttttttgagatggagtctcgctcggtctcccaggctggagctcagtggcgcaatctcggctcactgcaagctccgcctcccgggttcacaccattctcctgcctcagcctcctgactagctggaactacaggcgcccgccaccacgcccagctaactttttgtatttttagtagagacggggtttcaccgtattagccaggatggtcttgatctcctgacctcgtgatccacccgcctccgcttcccaacgtgctgggattacaggcctgagccaccgcgcccagcctgattctttattttggaaagtttctgacacctctttaaattaagctctcatagtttcttttgtgttcatttaagtatgtctattttcttttctctaacctaatttatttttatcttcttttggacatttgttttttctcctgatgtgaaaccccaaagtggtcacagcagactcgctcagggatgcctgagaccgtcagaatcttcgtgttcacaacaagatgggatgtgcttggctttcgtttccctttgagtttattagttcactgccaggtattcatttattctcaacagttgttttctgagcacttactgtgtgtcagggactggtataggtgttggggaaagagcggtgggaaacaaaattcctgccctcgtagcgtttaagttccaatggaatggtactaaagtaccctgagcgattctcttgatcttcagccctacatctgttgttcaagtgcttaggttaataacaaaatgtaaaatacctaccatggtttcacatagttatgtgtgtctgatgtaggggccataaccgtgtgtgtgtgccttgagaaaacttaagatctacttcttggcaaattttaaatatataatacattgttagcaactatagtcaccatgctataccttaggtttccagaacttactcgtaactacaagtttgcatcctttgaccaatgtctttccaatttctcctacctccagcccctggttaccacctttccattttgtttctgtgagttcagcttttatatcaaaacatcatgctgcacaccttgagtatatacaatttgcatttgtgaattatacctcaaagctgaaaaaagaccccaaaaaacccggcatggttcctaaccaaaggagacacttgtaaggctttgtatcctcctacagtttgcattttgtatcttctgaaattctctcttcccctagaattcatactgataaagcttatacgcatttcaaaatatatgtttgaggctgggcgtggtggctcatgcctgtagtcccagcactttgggaggccaaggcgggtggatcacgagatcaggagatcgagaccatcctggataacatggtgaaacctcgtctctactaaaaatacaaaaaattatcgggcatggtggtgggcacctgtagtcccagctactcgggaggctgaggcaggagaatggcgtgaacccaggaggcagagcttgcagtgagcagagatcgcgccgctgcactccagcctgggcaacagagtgagactccgtctcaaaaaaaaggaaaaaaaatatatatatatgtatacttgaggcaagtacaagtcaagtacccatctctctctatttttaaaattcatgctttctctgctatcataacattcggtctataaaacgttgatttcattaccaaggcaaaggttgatgttgatatcaagcaggatgttacagaaataaatcattggatccactttacttctttcttactttcagactttgtctcagaactttattaaacttagcaaaagttaaaaagaaaggtagtcttaactgaagactttgagatgattttagaaggagtttagtaacattggatgaactattgtgtgtcactaatcatgtcagagaatgtaacttacaactgaaactttggagtctgtaatctttctgtgtgttttttttttctttttaagacgattcacctggtcacttctatcactgggtgaagctgattgtatataagctagatctgccttctgcctacctttatgttagtactatttttacgtttaattttgcccaagttgaaagagattgcttggttcatggggccttaaacatttcaacatttgtccttcacaagataattatttcattaaaagtaaattacaatttattcagtagctctccacatgaaaataataatcagatggtaaatggatgccctaagatatgtggagaacaaattaccgtggtattttaaaggagagagttttctaagctaacttttatgcatgcagcatctccctggctaacatgagcattgatgataatttctaccattaatgagctcatttttttttttaatgagactttgtttttacttttaaaaaacagtaacctaaggcaggtgaagtcaaattgttattgctgggaagttgtgtttcaaatgagcactgtaaatgattttgttgagcaggcgttttttgttttgttttgtttttgagacgaagtctcactctgtcgcccaggctgacatgatcgatctcagctcactgcaacctctgcctcccacattcaggtgattcttctgcctcagcctcctgagtagctgggattacaggtgtgtgccaccacacccggctaatttttgtatttttagtagagatggggtttcgccatgttggccaggctggtcttgaactcctgacctcaggtgatccacccacctcggcctcccagagggttgggattacatgtgtgagccaagcagatggtttttaaactggggtccaagaacaagctttagaatgttagaatatctccccaaaaccatatggaaaatgctaggggtttttttttttttttttgaaagctcatttaataaaggagagcatccattgttttcattactcttcttaaaggggctgtgactcccaaaaagtgaagaacaaatgcatgtgaggaaaagtcacattctgattagtcatatgttgcttaacaacaggagtacctgctgagaaatatgtccttgggtgatttcgtcattctgcaaccatcatggagtgcatttccacaaacctagatggtacagcccactacatactacggttgatggtgtagccattgtaatcttaagggaccaccatggcaaatgactgtgtttcttttgttgttgttgtttttgagatggagtcttgctctgtggcccgggctggagtgcagtggtgtgatctcggctcactgcaacctccccctcctgggttcaagccattctcctgcctcagcctcccgagtagctggactacaggcgcgtgccaccatgcctggctaattttttttgtatttttagtagagatggggtttccccgtgttagccaggatggtctcaatctcctgacctcatgatccacccgccttggcctcctaaagtgctgggattacaggcgtgagcctccgcgcctgcctggcaaatgactgtgtttctatagaaatgaagagcttagacgtgcctggatggctccagataacacccagctgagccttacggctcctaatgggtcccatcctccactgaaatgagatcagaacaacccatggggcctgacttagtactggccagtagaactggacaatctgttgatgggtgtattctcaaactggtactgttctgttgggtagcccctagccactggtagcaagtgccactgaggaattagaccttaaccttgacttcatgttaattagtcagaattgcagtggccccttttgttggacagcacaggaccagaggaagtggatttgcactttgcatctgctgataggaactgaaaaactgccatgcattgcctattgacctatccatgtaatttgtcatacttggatagcagaggaaaaatctaaaatactgtgtttttcaaaagaaatggaagcttattgtattaggggaaaatttcctggggattccttatttctttcacatatacacacacccagtgcaagcatgcacacacacacactcgcacacacactggatacagttttgtaggttctttgtgtcccgaaaacataaaatgttcatttctgcattttgaattatggatttgaagatccatgctgtgcaatctcagcatcactaataacgcttgagttgaatgctccaagctcacttcacaaggcagctctcgcttagggagcggtttgcatggaggtgctttgaattccgggacagagtggtttggggaactagggggattgcagtctctgttgacaacgtgtcctttggctgcttggttgttctttcctacgtttgtgtttcggtttaaggtcatggtgttgttctgggagacattagcttaaatagcgttttgtttgtttttgctttcgacgtgtttaaacgtatggatggaaactaaagttgtcctctgggaaccagggctgtgatgtgcatgattagatctttctgtgttgatggcttgtgtgagatcttgtgattacccagcgaactgtgccaaagtttcattatttattcattccttccaatgattttggagtacctgctgtggctactaaggatatcatgtattttcctcccaaatgtctgcaactcataaacctctgacagtttagaatgtgtgtggagccgggcgggatgatcataagaagagatggtgcgcttgtcacctgtacaagccacttagattcccaggcagttttctcacctgaaaaacgagagattgaccttcagtgtttccaaggttcttttttttttttttttttttttttttgagacggagtctcactctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagtgtttccaaggttctttgctgctcccaagtcactgatgtttgtgtatgtctacgtgtatgtgtgcttgtgtgtgtgtttctgtatgtatgcatatttgtgtctgtgattgtgtgtgtttgtatgtgtgtgtgcgtgcgcatatatttagcttttcctcataaatctttattattaaaatgagctcacaacagaagaggatgagaactcttgggctatgtaggaaatgcagggccagagggtgtattaggatcaagaagaggccagacccccaggtcgtggacctcctcctgccatgggcccacagcccatgtggttttgtgaggtagcttgaaaacctggttaacctggaatgtaatttttaaacatgattgtactttgaggaaagaggctgttatttcttgttagagggatctggtcatcttttctgctctgttgtctttgtttatgctctcttgagagtcatggttccctctgcaccttgggcttggcccgctgcggggtagcccctgtttcccaagcatggtgggacccctgctgtgcctccacatctgtgttctccatctgctctggaatgccctccctgccaacgcacagagctctccagcctcggggaacttgctgctttggttgggaaattccccttgggattaagcgttcctgccttcccgcagcactttcctagctcagagcaggctcacagaccgtgtgagtgtccttgggtacagaataccacaggcaagtgagatcattctccattgcatttcttttcaactacaatttgagtgatttttcagaagtacaagatttacctgattcttacatggaggtagtgatgtattattaaatacacagaatacaaaggcaaggatgggtggggcgtgcacctgtaatcccagcactttgggaggccaaggtgggagaattgcttgaggccaagagttcgagaccagcctgggaaatatagtgagacgccatatctacaaaaaaaaaaaaaaaattttaagaataaaaaatcaaatttaaaaagtttatttaaaaagtcagggatagcccgggcgtggtggctcacacctgtaatcccagcactttgggaggctgaggtgggtggatcacgaggtcaggagtttgagaccggcctggccaacatggtgaaaccccatctctgctaaaaatacaaaaaatagcttggtgtggtagtgggcgcctgtagtcccagctactcaggaggctgaggcaggagaatcatttgaacccgggaggtggagtttgcagtgagctgagatcgtgccattgtactccagcctgggtgagactccgtctcaaaaaaataaaaataaaaagcagggataatacctcacttcccctgcttaaccctagcatcaagagtagatgaatacacaagttgaattggattaggtgactatatatcaaaaacaattcagctcagctgttgcactgaatgaacgtttttaaaataaccgcacagttgactatccgagttgccacctgcccttatttggtttgtcagagggtgggtgaatatttagggacactataaggggagtcctctcctttctctcccacctctttccttttgctctctctccccctttcccttcctctcttttcccttcttttctttcttttcttttccttccttttccttctcttttcctctcctctttcctcttcatctcttcctatattctcttttctcttattctctttctgtttctcccctttcatcttcaagacataacaacatggctatggatatctgtaagtttgactgattttaatgtgtgcaatgataatttttaaaacatgcatagtatatacataatatgtctccatttacacggttctgatggctttcttaatattgctaatactaaaaaaactttaaaaattattataatttgaaacatgaattctgatttctaggcttcatgataccttgtggaaagaagctgttatttcttcttaggattggtcattttttcttctctgttatctttgtgtatgtatgtattatacatgtatgtgtacctatgtatgcgtaacatccaaaaaaatccacatttaaaaaaaatgtagtttgcaataatctttttaaaaatgtagtttgtcataatattttttaaaatgtagtttgtaatgaggagaaaatgagtacatgacaatcgagtttgattttagtagagcaaaaattaaaatcaaccctcagcttatgctttggtgtttgttaactcaaatttaaaattagaaatgtggtaattatttggcagttgtggctttctcagggaaaccatatcatattgtatgtgtgtgtgctggcctttaaaaatagatattgccacgaagctcatcatctgaattcatggccgactcctggaagtggtgggctttggaaagcagggctgtgagtttggctcttacacttccagggagctctccattccagctttggttcccttcagtccatctgtggtcaaagctcttttgttttcaaagctaactgctgaagagtaaacactcttgaccctgactgtaaatatgtgtcatacgtctggttagttttagttttaactgaacaaaatcattttggcagaagagtcattaaagtttgcacaaaatcctgaccttcacatccctggttttcctcacatacgcatccgcagggagtcacaatccatttgaaaatatttcttctctgggactgaaaatctcctaaaacgtgtattcttcagcaaacaaagtatctcatagaatgtaaacgtggatgactgggggaatacaattttttttgcgcataatgacttctgtcagtcctctaagaaattcaaagaattttcacggcttccagtttaaattctagcgcctctggccatggccatggtttgttctgtgtttgattatctttccgttcaggggttcgattgttactgggctactttagacaaagctacctggatcttgagttgccacttttagcccaaaatccccttcctacctgtttaaggggcagtggagcacttggtggccacactggctctctgtgttaaggtgtttgctgaaaattagctgtctacggtggcctatgcccgtagtcccagctactcaggaggctgagggggcgggaattccctgagtccaggagtttgaggctacagtgagctctgattgcgccaccgcactccagcctggatgacaaagcgacaccttgtctcaaaaaaaaaaaaaaatctgctgcaagagcttatttgtaacctggaaggaaaggagtagtccagggtttggggcagagcctattgcctctgaaaagacccagtaaattctctggggactgcttgtatccttgtaactagatagtcgtcacacatgagtgaaaagaaggcatttgggctttgaaggtggtcaagagcgtccaggctgggccaggcatggtgggtctgtgtgagaagcagagcttaggaaggctggggtctgaacatgctttgacttttgctttgtgcaaccagtaatccagaaaaatcctacctgaagccccagaggctgtgcttcttcagcagggtgtcatattgtcagggagctgcaaacagcctgttgtagtcagaaaagacggtgttttcctttccacagctttatggacataaaataaaacttgaatttgacaaacaatacaataaatcctcctttcccaaaaattacgagttgaggtcatggttcctaatcggaactgtgtgcagctgttggatttttggcgctttctagagctttcactaaaatcaaatgcatttaaacaccctccctcctcaagaggacaggattagcccgcctccccaggagaacagtgctctcctgcctgcgtcagcaagctccttacacagtggtctcctgcctgtgtcagcgagctccttacaacagtctctgtgcacgtcccatcactttatcatggattagaggctgcaggatgttttcatatggcccatgataatgtaatgatggctggtactttaggacttgaaaacctcttaacgtcttggccagactgtggactgttctttcaggcatctgtcttttaaatcagttatctccatttgctgtcaaatttggcctgcattggccggctttattatttctattgttccatagagagccacactgaaactaatttgagaaaagtgtaatctctattgaaaacttggagtccaccagcaagtagactgtatattttggagtgtccaccaaaagctcatagtcactgtcacctcgtaaggatgcttccaatgaatctccaaaaagtagtttacatctgcatccttggtggagattttcttaagtagacagaatttctctttttttttctttctttcttttttttttttagattagttttcctttttcgcccaggctggagtgcagtggcacgatctcggctcaccgcaacctctgccttccgggttcaagcgattctcctgcctcagcctcccaagtagctgggactacaggtgcgcaccaccacgcctggctaattttttgtatttttagtacaaaatacaaaatagagaaatacattagaaatacaagtacgatgctcttgtcagggaagaaaaactctttctttatcctctcttgtgcaatgaccaggggcctgcaaatgtaactgacaaaagtcaggttcacagcagaaaagaatacaaatgttattaataatttatatgtatgggagttcacagaaaagaagtaacactcaacagatcagacttgggagcttatatacctttcttcataaaggaaaagagctttgggcttcaagggatgaacaattgtgcggaagcaactgggaaatacacgggggaaactaggggaagataagcgttattttagtgaggtttgtttgtgcagactcatctccatctctggtgttaagagttgcacttcagccaggtgcggtgtctcatgcctgtaatcccagcactttgggaggctgaggtgggtggttcacctgaggttgggagttcaagactagcttggccaacatggcgaaaccctgtctctactaaaaatataaaaattagccatgcttcgtggcgtgggcctatagtcccagctacccaagaggctgaggcaggagaactacttgaacttgggaggcagaggttgcagtgagcagagatcacgccactgcactccagcatgggtgtgacagagccagactccatctcaaacaaaataaaaaagagttgcacttccccttcctggtacaggagtgggagacacctgaacaaagggaagtttatgcctggcttttaggcagaaaaagtgggcgcagagatcctccgttgccttcaactcagaataatccttatgccagagtggcatattttgaaatggtatattccagaccctgcttcatgctttacataaaaaatatcagtgcagtacaataaatcctaatatcagattactgtgttttcagtgtgacattttgtttattggaatctgtcttgtatgtcagtttattgtatattttacttgattttggactaacttgcatgtattatatatcacaattgcccgaacctcagaacgagtttacacgcttttgtcttaaaaatggaaatacaggctgggtgcgatggcttatgcctgtgatcctaacactttgggaggccgaagtgggtggattgcctgagttcaggagtttaagaccagcccgtgcaacatggtgaaaccctgcctctactaaaatacaaaaattagctgggcaaggtggcacacacctgtagtcccagctacttgggatgctgaggcacgagaatcgcttgaacccaggaggaaaataaaaaggaaatgcaatttctcaaatagtaaaggtttaataagccacccacctatgtgctgaaataaccttgaattgataaagatttaaacaaaaactaaatttggtcatctgtataagcatattatttagatatggggtatcatgccatgtcattgcaaattgtgtaggaaaagcatcaacttctgtttaaatttgcttggctgaaataaatgtgaggaagtcagtgtgggagtttatggcaaactctgaattattctgaaaatagtatatttcaaagaggcagatatctctaaacaaatctgaacaggatttggaaaacatttttgtacttaaatttgatattatgcctgatatttaggacttctaaccattactgcccaatgcttgatatatagcaataaatatttgtgaaatgaagaaattaatgaatggaacacacatacttgaatgagcagaaagactgaaagtacacagagctgaaagcctgtttgatttcttcatctgtcaagctccctagtgaaaatttgctttgtgacacttctgattcattcaaaccttctccagaaggaaagtaattaagtgtttttgttttagatagttccatttttatactgcaggtgacaagcgaggaataaccagctttagcttttaacacaatgagtaattaaacacagaagttactgccaacaaaattgaaatcaaatctgtcatttgatccagtgctgtgttgcatttgctttgtgaattggtggggaaaatatggtaaataataatacaccattgtatgttaagaaacagctgggagaagtaggatcattttaaaaggctaagaaacaaggtggcaaacatctagaaaattctttaattaaagctaaagcaaatgagataagatcaatccttcgattgtgatatgatagttttttaaaaaatagcaattgtttggtctgtttcttaaatagatgctgtcatttaccttaaaagctttgctaacctcaagtctgactgtgggccttctctgtggccgctgaagctactagtgttggttcaaattccaacactttttgttatgatttgtattagcatggggggataacttaacttctgcctcaatttcctcatctgtaaaatgggaatgatagtagtacatatcacatagagttgttatgaggatcagataggtttatgcctgtagaacaccaaaagcgccacttgcagcatgggcatgtttattgaatgatgatgattaatcttcattaggacccaaatgattcgtggatttcattttaaccataagctgcaaggattttttttatactttaagttctgggatacatgtgcagaacatgcaggtttgttacataggtatacatgtgccatgttggtttgctgaacccattaactcatcatttacattaggtatttctcctaatgctgtccctcccctatgcccccatcctctgacaggccccggtgtatgatgtttccctccctgtgtccatgtgttctcattgttcagctcccactttggagtgagaacatgtggtgtttggttttctgttcctgtgttagtttgctgagaatgatggtttccagcttcatccatgtccctgcaaaggacatgaactcatccttttttagggctgcatagtattccatggtgtatatgtgccatattttctttatccagtctatcattgatgggcatttgggttggttccaagtctttgctattgtgaacagtgctgcagtaatcatatgtgtgcatgtgtctttatagtagaatgatttataatcctttgtgtatatatccagtaatgggattgctgggtcaaatggtatttctggtcctagatcatgctgcaattatattttttttaactaaaatgttattgtaattctttttgtaacttcagtgataaaagtaaatgatttgagcctatgatttccacaaaatctagggaaatgatttaatatcctttaattttttaaaaaaaatggctttaaaaggttctgttgtggtatagttagtgataatagaaagctcctatttctggtgcctcagtggccattccagagccagtttcctgaggaggctgagctcagtgcctaagacttagccaggattctgcagctgattcaccgaggaaaccttgaccacagtggtctcatacattccataaggggaaaggaaaactttcttactgatgagttcgttgggcttttggaattcatatgtaaggtgattatctggattttagtacccttaggtcaatcctttaaaaaatacgtaaaagaagagaatattcttccggttgcaatgtcaaattataggtgagtatctgcatatttattcatccagggaaaattctggattcactgaaataaaatatttcaactagaaccatatcaccatgggtttggaacagatcatcattcatcaaggttattgttttccaaattggatgatcattagaactccttgataaatggccaggccccacgcctgtaatcccagcactttgagaggcctacgcaggaggatcacttgagcccaggagttcaagacaagccctggcaacatagtgagacctccatctttacaaaaaaaaatttttttaagtggctgggcatggtaatatgcacttgtaatcccagcactttgcaaggctgaggcagaagcattgcttgagcccaggagttcgaggttgcagtgagccttgattgcgccactgcactccggcctgagcaacagagcaacaccccactctaaataaataaataaataaaatacttgataaagatcttgaaaaatatggctttctggtccccacccagacctatttactcaaaaccagagggtaggtattatcaacctctccactgcaccagagcatcactcattcggcccgcatccctcctccttcttctttttttttttttttttttgagatggagtctctctgtcaccaggctggagggcaatggcacaatctcagctcactgcaacttctgcctcctgggttcaagcaattccccttctcagcctcccgagtagctggtactacaggcacgtgccaccacacccagctagttttttgtatttttagtagagaccaggtttcaccatgttggccgggatggtctcaatctcttgaccttgtgatccgcccacctcagcctcccaaagcgctgggattacaagcgtgaaccaccacgcccagcctcatccctccttctatagcatcttggcccagtgccatccagccatcagcttgagtgaacccaccagcatggggctttgtgaacattgtcctaattgtcctgtacagattggacgtttgtgactaggaaaagcacatttactaaggatctacgttttttaaactttttgaaatcttttttcctttgctatgttttttcttttcttaactgcataacataaatctcttagaaaatcacatttaacatccaagagaactcatgatgtcctcttcttgtgttttctgggtgcagagctccagagctgtttctttgaaatacaagttatctgttgaacttaagcatatttggcagagcaccctgggaggacagcactgcccccaaactctgagtctcacaaggagggaggtcctttatcagcgtgcaagtgattcccctataattccacccaacccaccaaaaagcctcacttccaactccatccctgataccatggatgatgtaaagaatggtcagtcatttcactgcctgatgtcactaccaatacacaagaagctagaaaggagataaacagagagcagggaactctaaaatattttccctgagaatcactggaacaaggggtctgattacttctctgttggctgttgaggatccatagtcaaccgactgtccatgctcctcctattccctgggacccttgctcgaatgacctcaccacctggctggcacatgctaccctggggtggaagcacattctcttatgacttgcaatgggaaaaagggctgaggatcgattttttttttcctgagatagctgaggaggtgagtcctgccaacatctgagctaccccctagggcaggcagaatatttctggagaaaaacgagccagcatattgctaacagattccatggcattccaaaccccaccctcccactgggccatttggtatctcctggagcgtaaagtccatggaatgagagattctccccctggttctggcgtggccccattttctaataatacccatctgcagtcttaagcctttaagctgtcccaagggtagggggtctcagggaaccagttggctccagtcaccttgaaggattcactctgagttctgactggttgagaccagaagttctcgtaagtagcagcttcgcttctgagatgctcctttgcctcacctgcacgattctgcagagctggggtcctgcctaccttttaaccacatctgacaataactatccttaccttttgctaccccttaaattcagacttctttacctttggcattggtttgctcctgattcctctccaaaatattctagaatgctaaaaaatgtcaaatgctctttatcttaaacaagggccagtgtttgaaccatcatatgtcatagtgacacgcctgtcagagctaaaatgagacttattacatgccgtcctgcttgggagtagttggggatgagtaaccacttgacacgttccagcagtccccccacctcggtccctattctagacaggctagagctgtggccataccagcatccagtccttatgtttaaaacagatcaagcctctaaaatgagggactttcaagtgctttttttgaaagtgtgaaggagcagtatactgaagataatgaacaagcttccttctcactaaacaagagttaaccaagaattgcattcacagggatataggcaaggcaggaatagacggcgggactgtagatcatgctccagtgaggatacttgactgaggaaggagggggcgacattcctctcaggcacttagtgagttgggtataagtgttacttattggtatccaaaaaggcaactagaaatcaaggtgattcatgtggaaagagcagaagagtgtccatggtaattatgaagtagctgatggctctgggcacaaaagtgagctgaacacagttacggggccagtgtgctttgggtagcgaagagcctccttcagcagctcagaaatgcatgagcgagagtgcacctaaagaatcacaagtgatgcactgcacaggagttacaggaaatgaggagccaggggctgagggagtctgggaaggtttcataggcccaaagggtgggtgggatttttgattcatgaaaagatggaggttggtgggcaggaggaaaggacacatgaaggtagaatgggcagggtgcagtggctcacgcctgtaatcccaacactttgggaggttgaggcaggaggatcatttgaggccaagagtttgagatcagcctgggcaacatggtgaaacctcgtctctactaaaaatacaaaagttagccaggcatagtggagcatgcctggagaactgcttaaacccaggaagtggaggttgcagtgagctgaggaccatgctactgcactccagcctgggtgacagagcgagaccctgtctcaaaaaaaaaaaaaaatgcagagtgaatggagcttgtttgggcaggggagagccttgattgacaaaacaagtggtgtgtgtttatggacaatggcaaaccttgggagtctggaaggaacagatgctgtggccctatggaggatggagaggaggaggagacaccaccagaggtaattcagaggctgttgtgattgtacaagtctcagattctgcaatgatggcagcgaggagggaaaggaagggacgagggtggggcgtgagggaagaattgcccaggttgaggaactgattggagatagagatctgcaagaactcagagataaaattgggacaaactacccagattggcagggagcccgccacagtgtggaaatgagaaaagggtgaggggttgctctgacttcacggtgatgagcctgtccagtccttaccagtctctcagggggagggaggtcacagtgtcacaggatccttagggtgtcgctttaccagctggaaacctctgttgctggtggcacctctgcctgagttttgctcatgcctgctggacttgttctgtccactcagcccagtaagatgtgctcagcttgtgctaccagcctggatcccatgcctgccaagggcaagccaggcatggagcagcaagtgggtatgtgagtgagtgaacacagggtctggccactgcacagccaggcacgctggctgctgtggcagggtgggaagctccatatgccagctccctttgaggctgtggctggaccagatgtgccacaagtggcttccactgtgggcaccagcgtctggatgaggggaatgtggtggtgcccgaaagctcagagacaccaggaactgcagagtccccaaataggtgttacagcatgtcacagccatggctcagggagcaccaaggtctgggcttccagaagggctgcagctcttctctacttcttgttacctacagtgtggtgagtggggggacatgtttcagcccatttgtgttacagctctttcagtcccaccaccttgctctggcccgtggctcatgggctggaccagccccactgctgtttcccatcatgtggggtggccactcagcaccagcagagggtgggagggctatagtgttaacagcagctccagctctgaggtctgggcccccagaagggttgccatcctttactcccatagcccaggagcatgtcaccacccacagctcagcgagctggtcaagaacatgttacagctcctttcacttccgccattcagcaggtcctgagttcttgtcctgtgtctaggaagaatgaggttatgcagacaactgggtgaacaaggcaggcaggagctttattgagtgacagaacagctgtcaggagacccaaagtgggtagctcctttctacaggtggtccagacaagtgtcttaggctggctgagtctggggtttttatgggctcagaagggaggaagtgcatgctgattggtccataggtggtcataggcaggcctggaaaaagcaccgtctgattggccaaaaggcatcagtgaagttctcactccaggttgcggactccacctggaacggacagctgagcccccaggcttcaggccatccctggcttaaaggtagggtttcactagagacccaccccttcctgcctaggaacctgtctgcctcccactgccatcaacatgccatccatggcacccaggctatctgcactgaggggcacccacatgcccacgctcagctgccctcaatgcccccagcctccctcccacactcatcactgcccgaagtccagaaagggctgaggcagcagggtgctgggtctgccacaactttgcttcgcactggagcgggcacttggagagaggagaggccagagagtgggaacaggcacctctgcctgaaggaatagggggcttcccaggccctggagagtgcagggatgcccaggtccacggctgggcagctgcaactgcctgggagaacaggctcccatcctgccagcttggtagggcgcagggctcctgctgggatcacctattcctggcccctgccagctccacagagtgcacaatcccagccatggcttccccactgcagctggcgtcctcacagcagccaccccagatgggccactgctgctgtcaacagttggcaggaaggcaggctaagcctggtgtctcaaccagaggactttgcagcagaggtaattgccaaccccacttccactgccttgacgtccctcttgcagcagagaagctaatcctgcccagcctggccatgagtgagggcacctgaaggggtgaggaggcgggggtaatgttgtgtaggtgggagggggcagtagagagtcccatactcaaagtgactgccaaatccagggctgtgcatagagtgactgctgacagcgtttgataagctttgctgtgagtccaaaagaatgatcggatagatgcctgtcttgcagcgcatctacattaatctcataacaaattattcgtctcatattagagaaagtttagctttcttagaagcttgatgggaaagagcctcccagctcttagagtttgattttcgcaactcagttcacatcttcttcttactccaggttcccagctccttgagccttgcccgtgaaggggttggagtcaggatgggaagccttgagctgccttgacctgctccatctctgactcagggatgtgccctgcttgtcacagcatgggtgtgctgggccttggggcatcttttcaggcagagagcaagacgttggcattgtggaaagctgtacctccaaacagcagcccattcacagactacagaggaagaaaagaccacacttgctacagtaacaatgcaattcagtaccagggaataacttaacatgaaacatgtcaaatctatgtaaacaactggaaggcactcctaaaaaatacaaaaaagaatttgaaaaaaaaaatcatgttctaaattagggaagtttgaggttctaaatatatcaattcttcctaagttaatttattacattttacacattctcaatttataaaataccaaccattaagaaaaaaaataaactaggcaaggagattccgaagttcacatggacaaataagcaagagctgccagttattgaatgcattacacagcctcagtaattaaaataatgtggtactggcaagtgaataaacaagacagcagaacatattagaaagccagaagtagtcccagatatatatgagaatacataaattttgaaacgtgtcatttaaagtcaacgaagaaaactagattgcccaataaacataatggcaactgggtaaccataaggaagaatgaataaatcatgccccacaccaggataaatttctaatggatcaaatatttaaatagttcaatgtgtaggccaggcatagtggctcatgcctgtaatttcagcactttgggaggtcgaagtggatggatcacctgaggtcaggagtttgaggccagcctggccagcgtggtgaaacctcgtctctactaaaaatacaaaaattagccgggtgtggtggcacgtggctgtaatcccagctgcttgggaggctgaggcaggagaactgcttgaacacaggaggcagaggttgccatgagctgagatcctgccactgcactccagcctgggcgacagaacaagactctgactcaaataaacaaataaaaaaatagttaaatgtttttaaaaatgaaaccacaaatgcattattatttggaaaaaccaaccgtaaaaatacatttttgaggcaactggagaaaatcaattatagatcaagtattagatgataccaaataatattgttaattttgttacatataatagcattatagttatacaaggaaatattcataattttaaaatgcatattgaagtatatagaggtaaaatgagttgatattttgggtgtactttaaaataattttgttgagagacagagtcagagagagagaagagatagaagaaagaagtataacaaaaccttgatagcagttgaatttaggtgggggtatatgccagtttattatagcattgtctctactttgtacaggcttaaattttttcaaaatcaaaaatattggctggttgcagtggccagtgtctgtaatcccagcactttgggaggctgaggcgggaggactgcttgagaccaggagtttaagacaagcctgggcaaaacagcaagactccatctctacagaaatttttaaaaataggccgggagctgtggcgcacgcctgtaatcccagcacttaggggccaaggcaggtggatcacttgagttcaggagtttgagaccagcctggccaacgtgacagaagcccatctctaccaaaaatacaaaaattaactgcgcgtggtggcagatgcctgtaatcccagctactcgggaggctgaggcaggagaactgcttgaacccaggaggcggaggttgcagtgagctgagatggcactactgcactccagcctgggcgacagagcaagactccatctcaaaataaataaaaataaaaactaataagtactagaagaaaacaggagaatttcttcatagctgtggatttggcaaacctttccaactgatttaaaattaagaaaccatgaaagaaaagattgataaaaatcaactatctctctctacacaaacacacacatatacatttatttatataaaatatatattatgtaaataatatatatatatatttgaatatatattttttaaagccacttttccactaaggggaaaaaacccactaaagagaaaaaaaaaactaggaaaactatttgccactcacatcacaaacaaatggctaatatattaatatagacatttctggaaatccttttaaaaagttaaaactatcaaaatagacaaaagatctgaacagacagctcacaaaaaagggaaaaggaatttaaggagtctaaaacatatggaaagatgctcagcctcatttttagtaagaggaaagaaatgtaccatatctgggaaacctcagagcagcaaaactctagagctgctcttgcactctgctgaggctggggggagacgggaaccgtggctgatgggaatgtaaactggtgcgatttgacagtttttgtcagagttctttcagatacacttagattcaaggtgatgtagctttgtttgaaaacagcaaaagaatagaaaccttaaggcccatccgtagaggactaagtaaatcacagaccctgcgtacagtaaaatactatgcacctgtaagaaaatgaggctaatgcctgtgtgcctatatgggaagatctccaaagcacattgctaagagtactttgcacacttctgcttatatatgaaagggaaactaagtgtctatttgtatttgcttgcataaagaaactccataaggacaaacaagaaacaaataacagtattcccgcccttatcctgggggatgcatttgaagaccctcagtggattcctgaaatcgcagatagaacctaatcctgtatatactgttttttccccatactgtacacacataaacctatgataatgtttaatttataaattaggccaggtgcagtggctcggggctataaccccagcattttgggaggcccaggtgggaggatcgtttaatctcaggggttcaagaccagcctgggcaacacagcaagaccctatctttacaaaaatttttttaaaagattagctgggcatagtgacatgcacctgtagacctagctacttcagatgtcaaggcgggaggatcacttgagagcaggagatcgaggctgcagtgacgtatgattgtgccactgcactccagcctgggcaacagagcaggaccctatcaatccatcaatgagtaagtaagtaaataaataaataaaggcacaatgaaagatcaacaatatggccaggcgcaatggctcacgcctgtaatcccaacactttgggaaggccgaggtgggcaggtcacttgagtccaggagtttgagaccagcctggccaacgtggcaaaaccctgtctcttactaaaaataccaaaaaaaaaaaaaaaaaaaaaaaaaaaagccagacatggtggcacatgcctgtaatcccagctacttaggtgtctgaggcatgagaattgcttgaacccgggaggtggaggttgcagtgagccaagatggcaccactgcactccagcctgggtgacagagcaaaactctgtctcaaaaaaaaaaaaaaagaggaacaataataaataataaaatacaattctagtaagatactgtaataaaaggtatgtgaatgtggtgcctctctttctctcaaaatatcttattgtactgcaccatggataactgcaaccttgaaaaaggaagcgatggacatggggcgactactgtaactggcacctcagaaatggggaagggggcggaaatatttcactgtgaaatattcttctgccactttttaactttattcaatcacatgagtcaaaaaattacaaatgtaaattggatttttaaagactgtactgtgggcttattacatagtcacctttgcggatcaagtcctgactttatgtatgacatctattagcagcctaattttatatgaattgaatgcaattccaaaaataacagttaggtcatttgaaaacatatgccttaggtgcccattaaatgctcttttcaatatctgttttgttcagaatgtagtctggccggccctgggtgagtagttccatgaagtaagatactgtgatcactttgagagggcagggtccctttgctcattcctatatcatttcatcaccttcctcatgatccagccagctgctctattaaatttgaaaaccaagtatgctttcaacctacaggtgaagaaattagatgaactgtctggccataaattataattcttgggagccagagctgtttcactgtggttgagaccaaatttcaagcatctgctcactgaatgcttttccatttttgctttaaaagcttcatatgagtacatacagcattttatttgcttcacagcatgccccacagaactctttcttggaaatacagagattcctatttttagtctttcaggaaacaaaattactaacttctccccctgcttctctttttcttctttataaagaagaaagggttggaaatcttatttgcattttcattctctgtgatacgaggatgaggggggagggcagggtttgtgggggatctttcacatcgtttctcccagctgggactaaataccatgcatggccacagccttgtcctgttctgcacttgcttttatttatttacctccaaagcaaaacacatccagcaaggggaaggagtgctcgagtttcagtcgtcaggatggtaagaagtccttcattatcatcttcctgggcatgaaacgattttaaaacaactgatatacctctccctttctttttttgagatggagtttctctcttgttgcccaggctggaatgcaatggtgtgatcatggctcactgaaacctctgcctcccaggttcaagcaattctcctgcctcagcctcccaagtagctggaattacaggtgcctgccaccacgcctggctgatttttgtatttttagtagagacagggtttcaccatgttgaccaggctggtctcaaactcctgacctcaggtgatccaactgcctcggccccccgaagtgctgggattacaggcgtgagccacagcgcccggcctctccctttcttttttaaaaaaattatatttagtcttctttcaggcttgaccatttgcatctttaaacattatattgcaaagccacttgaaagctgcagtttacaaatgtacatgattgataggtctatagattttcatagaaggcctgacttcataagaatttataatcatgaataaaaacatttgcattctctttcttcccccaaatcattctggcagtgaacacttcacctgcccaggccttttatggaagagtgtatgtaatacctctgagcctttggggcctgggatccaggttgtcccacagcagagaagggagggtgagacaaggcaggttaagcaggtacggcatgttggaaggtgtaccatgtgcccttaaaggtgaacccagtgcaccttcatgaaccgtggtacacctttaagaacttggtatgccttcatgaacacttaaagtaccagggggcacttcatgaaacatcattaagtttctcctaagtcattgcaaaatgatcagaactcttttgtcgtggacagcatttcttttgtaggtgtttagagttgccaatagctccataaattgttaaaagcaaaatattgaaatataacctaataatccagggccccatgttttgaaagatcactgccaaatctttcacgtagataccaaatactgtgtcaacatttagctaaatcgaactggtggtgatcccaacaagcaatgaactggtacaaagagaaacaattaggagaataaaggactcagccatcaacaaactgaataatgatcaaatggacaaaagtacagataatgaggaagagaagaaagagagagggagaggaaagaggtaaccggtgctgagcaggagatgatgccacctggtagcagaatcagaagcctgcatggtgcggagtgcactattacaaatgtgaatgtcatcaatccttagaacaaccttaaagtcattgtcattagaagaggagataattagcctgagtcacatggctaaaaagcactagagctgggctttgaactcatgtctgatgagcccaggctcttactctccaggctgttctttgcatttatggtaggccgtcagtcacctgtttctctctgcatcagagctgaaagccacaggttcaatcctgaaatgcgcctatggcaagaacctcattctatatagtagttgcaaattgtgcctcaggcttaaacctctcctagaactggggacaaaagtggctagatgctatggtgaaagaatatggatagttcagtttaaacacatttctacttttaaagaaagaatgcattaatgcattattctccctaataacgatttagaagcatcttgttgatagatacagaggagcacattttaagctttataattttcagtttcagctctggaattgggtaaaactgatgtgtacattggttttaggttaaaatgtggcatgtagcattttggaaagcaaagtgaataaataaaaatccagggggaaattttttttcaatgcttttgctctaggaacttatttatgctggtatcattagctgtttttcttggatgaccaatgtctataattgtagtcacatatttctgagataggatgaaaaccacaacaaaatacaaacctttcaagtcagcacataagttatgtatattaatgacagggagaaatggagccaggaaaagtggttttaaaaccgcgcggacaccagggagtgtctatgtatgtggttttattaaatctgacttctagaagcgagttgttcaccactgagtgtgagaaagaacccggaacttcataatcatatgtattgactatacttcagatcagataagtggtcccatagcacgggtcccttgaagagagatgccattgtggggttttagttagaacagtctttcggtccttctcctggttcacaggatttgtttgaatgttgttctcatcacaattctaccccttcgtttttgcatagggtccttttgtgccccaatatttcatgttctgggactaagaaaatgttaattgcctattctctaataatatgtgtataaaatgcatccccaagtgacaaactttactatgtaaatgatgctgctgtttataaaagaaaatggtgagttcttacagtcctgattttgccactgacagcaccttagccaacctgtgtgtttctccatctgatgtggaggtgcaacaggcctgggctgcacgctgattcacctggggaactttaaaaaaattcccatgcctgggtcccacccagagattctggtgccgtatgtctgggtgtggtgaggggcatgggaaggttaagactccttaggagggtctaacaatgctcagctccagttggcaatgactaaaccagaggacttctaaagacacctccaaccttcccctttgtgatttctagtctgtgtcatacataactaatggccaaaattcagagtaaaaatttttcagtgattcatgtaacgagctcatccagccagacatggtggctcatacctgtagcccaagctattgggaggttgaagtggggaaattggttgagcccaggagtttgaagctgcagtgagtcatgactgcaccattgtactccagcctgggcaacagagtgagaccctatctcttaagaaaaaaaaagaatcaaaaaaatctcatccagcccaaagcactcaatagtagagtacctcttttgccacatgtagtggattttattggttcttttgtgggatgcatttaccagattaccctactcctacctctaactcttccattaggatagcaaaccaaacagaagagggctgtcattaataacgttctacttaataggcacttgatgaacatcttccacatttggtgtaaattccattcaccctgcgagccacccatatcctgtctatctgaccgttgggaaattgattttgttatttttgcttctccctggaggactgcacaaagttttaagacaggcttggcatggtggctcatgcctgtaatcccagcacttggggaggccaaggtgggcggatcatctgaggtcaggagttcgagaccagcctggctaacatggcgaaaccccgtctctactaaaaatacaaaagattagctggctgtggtggcacatacccgtagtcccagctactcaggaggctgaggcacaagaaccacttgaacccgggaagcagaggttgcagtgagctgagatcatgcctctgcactccagcctgggcgagagagcgagactctgtctcaaaaaaaaaaagttttaaaacaaaaaggcaagactgaacaaaaaaaaatggagggcaaataaaagaaagaaaacaacattctcacgatgttgaatgtgttctaaattttccaggcaagagaaaagaacagctgtgattctgcgagtttgcctgagtgtcaaggtcagacttaggagttgagtgttgtcctgcgtgtcaggctgaggttcctcgctctcatctcttacttgcccagactcgtgattgcagggatgagatagtcctgctataggaaacatttttttttctttgccagatcagcatgatcaaatgtttctaaagctaaaccaaatgacatattggcttgcaaggattacccacacccttgcatcagtaaaaaaagaaacaaactgaactgcctggagggagtggagagaggctattttgtgctctgaaagatgcccaaggcagctgtagatagcattgttttcatgaaacgttggctgggctggcctgtgcattagctcatgttccaaatctgtcaccagaagaatgtagtgagaatcttgtttcaatcttcttttctttctcgcttcactctttcctcaaccagagtccagcatctacacagccgctgtggccaaggtttgaaaacagcagttttgaataaaacctaacaggcttttcacattattctaaaaaggaatggaggccctttgatgcccatttccaggccttatttccccactcaccccagagacagttgctgctgagttttcaaacatatggattatcctttctctgaggaatctccactgaaactagagatggcagagggaaaactgggggcagccgtaactgcatgctggcatttgcagctcaggttggtcatttctgtccacaggggcacaggcagcaatccagggattttgtacaaccttcagggaccaaacaaccttttggtcctcagtcccacacccacaggttcagaacccacctgttaacccttcatgttttcctctcactagccctatggggctttttccctcaaattttttttattgtggtaaaatacacacaccataaaatgtactatcttaaccatttgaagtgtacagtttggtggtattaaatatcagtatatccacattgtcgtgcaaccatccccatccatctcccaaattcttctcatcttggaaaactgaaactctatacgtattaaacttcccattcccccagcccctgacaatcaccattctaccttctagctctgtgaatgtcacaagtacatcattatgtgggatcatacagtatttttttgtgactggcttattatacttagcatgatctacgttgtagcaggtgtcagaatttccttcctttgaaaggctgaataatattccactgggtttagatacaccacgttttgttgacccattcacccatcaagggacccaagttgcttccacattttagctacagtgaataatgctactagaaacataagggcacaaagctgggtctgtgacaccctgcttttaattcttttgtcacaagccctgttgttttaaccttgctgtgtgagcggtggcagagatgtgagttaccctgagttaccggctgtgaatctgtaagggtccacagcaacttcagtccttgcctcctaaaaagaaataattcaactgaggggcatcaagcagaaagagactaaggcaaggttcagagcaggagtggaagtgtattttaaaaggttttaggcctggcgtggtggttcacgcctgtaatcccagcactttgggaggccgcggctggtggatcacttgaggtcaggagttcgagaccagcctggccaacatggcaaaaacccgtctctactaaaaatacaaaaattagccaggcgtggtggtgggcacctgtaatcccagctactcgtgaggctgaacccaggaggtggaggttgcagtgagccaagattgccactgctctccagcctgtgcaacagagcaagactccctctcaaaaataaaaataaaaggatttagaacaggaaagaactcttagaagagatccaggtgggcgcctgaaggcccaagagaaaaaaaaaggaggcatttacccttgatcctgggactttataggctgccctctctcccatgattcttccctcagggcgggctttctgcatgctcagtgccctctttcccctttggaagtgagcagtgcagcccgtttaaggagttatgcacatgcccacaatatcatacttcgccattttgtctcttaacgcgtatgcccaagaggttgcttctccctggggtctgcattcagttaacacttttaatgttaacaggtgtgcaacctcaggagccggtctctccctggctgccgaattaccgtttttagagaggcaatgcgatagttgctggaccatcaccagacattcctggtaggggggcgggagagccctctcctgccctgcccatgtctaactacctgtagcagctggagatcagtctcctcatcgtagcaatggagacagcatacacttaacttcatgctagcgggatcacacgaagctgccttgattaaagccctttgtgaattctcaaacactttaccattgtccatttatgcggtgtgaagatgaaacgagatatggaaagcattctgcatgcagtgaaatgctgtacaaatggacagtatagtgtgactcatttatgctaccatgggatgggttctgtacttggcccttggtgggaacttggtttccatacatgagaaagtaacaaaagggaggtgcaggaggggatgggggtcctccctctagcccaatgcccagtggccctgaaactccctgagttgtggcatcatcccccacccccacattttccaaacctcttaattcctctattgctggatggcttactgaaatgctcttcccatgatctctgtgggcaaaggcaaataatttttttttcttttacagacagggcctcgctctgttgcccaagctggagtgcagtagcacaatcacagctcactgcagccttgaactcctgggcttaagtgatcttcctgccacagcctcctaagtagctgggactgtaggtgcatgccaccatgcccagctcatttgtttttagtctttatagagacggggtctcactatcttgcttacactggtctcaaactcctggcctcaagcaatcctcccacctcggcctcccaaagggctgggaatacaggcaagagccactgcgcccatccaggaagggaatttttaaaggacaaattatggtggtgcatagctacagagcccactagacacagctctccctgaagaaggaatcctcgtgaaggagaaggggtgtgtggtgcttctgtgctctcatatgtgacacctgctcacatgcacacaggctggcctcatcatgcatgactgtaaagacattttgggtcacactgcagaaaagaaagtgttgggactggtctctaagctcgccctgcagaaacagcgagctgtcctagctgtcctgggaatgatggggccacagactacatggccaagagcaggcagagcagctactgtttccctagggccacgtgtggaatgagtcacttcatcagctcaccacaactgctggcctggcacctgggtcctacggagagggcaatggcaggtaaagtgccatcacagaaccaccaggcaccgaagaccgcgttgcctgcttggacgatatgggcctggctcactgcagaagagaggcactgatgctagagactttcccctgggccatatgtatttttgtcttgaaagaggagtcgtaagggtttgcctacccaaaagctattttgtttcatatttacatttttagttctttctccattaagaaaacgattagtgaaatgaatggaattcgccttctttgctgctattgcttatgtgttcctatttcaccatcttttgtaaataacagtgttgttgctgtcagggcacttctccctcactgggcacgtgcctttctgtgctgtggccagcccaccatcgcctgtcctcacctgccatccataccctagcagagccgtgctgctctgagggtgccgggtggggctccattcttaccctagcaaactcaccagaacaaagcccacctgcccaaccctgtccttgtctcatttctcagcttcccgaggctcccttccatacccacagaggcaggactgctagagccccactcatgagaatcacagtcatttcccagcttcctggggcttccttccatgcccgcagaacagaggcgggactgctagagccccactcatgagaatcacagtttccacagagaagaccagtctagcttggactgtgggttcctggttttgcagatgtagagtggtgaaggcctaaccgaggagaggaaacaggagtgtaacagagtctccattccaggaccagcatctcttccctccccttcaggggtttaccttcctgaacttctcagtgtatgaaacacagcaggggctggggaactatacaacccagaggtgtgtttgtttcaagtattttttagagcagtttcaggttcaaaattgagcagaggctgggcgcagtggcttacgcctgtaatcccaatgctttggaaggctgaggcaggctgactgcttgagcccaggagttcaagactggcctaggcaatatggcgaaaccctgtctctactaaaaatacaaaaattatctgggtgtggtggcacacacctgtagtcccagctactcgggaggctgaggtgggagggtcacctgagcccaggaggcaaagattgcgatgagcccagactgcaccactggacttcagcctgggtgacagagtgagaccatgtttcaaaaaaaaaaaaaaagaaaaaaaattaagaaggtacagagatttcccataaactcctcgcctcccacttgcacagcctcccctactatcaacatcccccactagagtggtacatacgctacaattgatgagcctacactgacacatcattatcacccagagtccacagtttaattagggtttactcttggtgtatagcctgtgggtttgaacaaatatataatgataatatgtattattatacaggttgagtatctctcatccgaaatggttgggacctaggagtgtttcagatcttagaatttttttttattttggaatatttgcatgtacataatgagatatcttggggacaggactgatgtctaaacaccaaattcttttatgtttcatgtataccttatatacatggccttaagtttattttacataacattttaaatagttttgtgtatgaaacagagtttgtgtccattgaacaatcagaaatcaaaagtgtcattgtctcatgtcgaagctcaaaaaccttgtgattttggagctgaaccaattttggattttctgattagggatgctcaacctgtagtacactacggggtattttcaccgccttgaaaactccactgtgctccacctatgtattcctccctcccctcccaaccccagagaaccactgatctgcttactgtctccatagttttgccaagtttcttagaactgggtataaattaagaataaaagggcatttctcagtctctaaggataagggcttgggcgcagtccatttaatgacattattttccttatgaaaaattataggattgatttattgactatttcttaacatgtgtatggtgttaaatattcttaataagttttggcacattgtccaaaatattacattgtaaatttgggaagttccatagttcttttacttagaaggtttgaattagaggtgaattgcccgagatttgagaaggaggccgggaggcagagagtggaaggcatttgatgtatctgggttttgataaccaccctgttcatgttttagtgaagaccatctttggcttctaaggacttgagtctgacagataggcaactggggggcccatgtgtggatttcccttggtctggaatcttcctgatgggcagatggggagtgagaaatgctctcgagtccacagttgaaatatttggggatctttagtgacaccagcctatatcctttatgtgaaggtccaggagtgagtttcaggcacttaacagttaacatccaactgtccgctactgtcagagcctgcagaggactgtgggacaggctgtgtcttgtgtgtacttttataatagtgtaaaatgttaatgaagtattgcgttataatatgattttactataaaatgacagaatatctctttttttttcaacaagtattctctaactctacaaatatcaatgtggctgctatcaaaaaattttaaacatagcgcagattagggccacagtcttcaaggtaatatttaaacctggatcaccatatttgatagctttcaatgtgaccttgaatatccaaagtcctgcttctgtttaaaacttccctacaacaatttaataaattagaattttagagactttttttcctttaaatttagaaagtgagttgaaattcaacctatttccaccacccttttgctagccctaaagaatgagatagaacattagtcattagaatgaactttaatctaggccttgatcatgaaggaaatatttagatgaatgatttgaattttgtttagactcagtgtaattttagtcacacagattttgcttgaaaatcagctaggcttcttttaccccaagagaagatttttacctaacgaagttcaccttgcatgttttaacattgattttttatgcttactttactgttaatttggatcaaatattgggtctggaaaatgctcctccccttcctacgtaactgtcagagtccatgcaacgatggacaccttgacattgaaacctccattacggaggtctcactgttaactggaagaatcgcagctgcaagaaactgaacagcacctggcgacttaggtagaatttgaaacagaaatgagaaaccaacatgtattcagcttttgtgaaattgtgtgcttctagaagcttcttcttgccccttgccttgtgaaatatcgaagaggctttattttcttattcggaaataggtaacatgttggaaaatagaatatgcaaatattacacttagatgcttaaaagcagtgacattgtttcagagaaatccccttttttctttctttctatttttgagaaagagtctcactctgttgcccaggctggagtgcagtggcaccatcttgcctcactgcaacctccgcctcccaggttcaagcaattctcccacctcagcctcccaagcagctgggattataggcatataccaccattcctggctaattgtttgtattcttagtagagatgtggttttcctatgttggccaggctggtctcgaactcctgacctcaagtgatccatctgcctcagcctcccaaagtgctgggattacaggcatgagccacagcacccagcccagagaaacctctttatgtcccatgagcattagagcagtacccagaaccatgtaaggtactagcagtggtaaatgcctggcaggctctttgctcatcttcctcctaagccaggaacaggcatcagccctcacccagagcacttggatctccccacgtgtgctaagatcccttcgcagcatggagcttcatgcagcaaggccgatgacataagctggcatgagttctgtctgctgccctggtatatcctatagcacctaatgtgctggaaggactcacgtatttaggaacatgatagttctcaggctgtcagttttttaaaaaggtgcagggtgcaggggaggagaatctggaagttactattgctttgtcagaggtgagattctgagtaaaatgttcgcacagtagcaatgcttatgtacaaaatttttactatggcacaggattgcatcaggttttatagagagagctattacttttttataagactgcctcacttttataactgtcagtatattagcttataatacagacaattgaaaatagcaaaagcacttttatatagctgacaataaagcctcttagtttggattccctgggtttcaatgccatggcccacagtcattttactcaacaggttcttcttgagggcatggggtagaaagttctggacctgcctgggaggtcaaggtgagaatgacagccaaggagctgaagagagaaaccagcaatgcagaagcacaggtgttcccagagtatttgagatttcatgcatgtaaacacatttcacttcacatatattaaaaaagaaggccaataagtgtgtgaaacattaatctttatttggttattactagaacataagtttgtgtgggcagggagtttgtctcactgtatccacagccccagaaccgggcttggcctcttgggtgctccataaatatttgttcagtggatgaatgaaataatttgctaacatttaatttcttgcatgtcttggagatattaaaactactttaaacaaagatgtccttgcttcagggtttctatttggagtgttttgtaaaattggctttgggagatgcattgattcttttctgccaccagggggaggtatagtgcagttcaggaatcaagtttttaagttttttcaaagaggggttagtacttcaactgatactcttagatgtggataactgtgactaagttaaatcagcactgcaggatgaggtttaaaggtatttcagcatatttcaagcttaacacaagcatgtgtccgggttaaaaataatatccataaatacagcctgataatgtgcttaaatataaaacatataaataggttgcaaaagatgactgaatctttcatcattttatgatcactttctgccacccaaccagatggcatatgtgatctactagccagaaggtgtaaagtacatgttaaagtgaacaaatactctttttttcttcagaacaggaaaagatctgataaaaatctatcattctgtccatgcggttggcaccgttttaatgtcgggggaaaatgcagtggttctagttctgcttcgtagacagtgactaaatatataccgtcaaggctgagtgtcaggggctggctcagtacaatcaagcatgtgaatagctcttttgtgctgggaacctgttgggcagccttacttaattggggagccacgggacaggaggtctggtaatatctttattattaaggagagagtcccaggggctggaagggaggaattttcctttacaacttttttttttttttttttttttttttttttgagacggagtcttgctctgttgccaaggctggagagcagtggcgcaatcttggctcactgcaacctccgcctcccaggttcaagcaattctctgcctcagcctcctgagtagctgggattacaggcacatgccaccacacctggctaattttttgcatttttagtagagacggggtttcaccatcttggccaggctggtcttcactcctgacctcgtgatccacccacctcagcctcccaaagtgctgggattacaggcgtgagccaccacgcctggccaacaacattatttttagtgagaacaaacttaattttagttcagtagacattgcctattatgtgggaaattaatgtattcttttattactatcttcagtttgcagttcctgaggtcttgaggtttggccatataagaacatccaggtagatcaaggtctctcggcaactccagaccccctgttccaggagtcttgattgacagagcttgctgcaagtcagtagccagcagctaaattgtctcacctcgttttcttttcttgcctggtctctgggtggaagttccaattagggctcaaacagcccccaaagccggcagctgaagaggaaagggggaatacggtggtgcttcagtgccatctaatttggccttaaacagtaggaaattagctgcttgtcattaaaataaacaaatgccagcctgttccgtgctgcatgctgcaggggacttgcaaggggactggtgaagtccccacagtttctggggtttacagggggcccagagccgctctcctcccctccagattcccaccacactgttggccagctgtggatcctctcctcctttgcctaagttagaggagacaaaggtgagtgtgagctgagtgcttcagtgtcgaggccgtgcgggcgatgatgtgatagggcggcatggggttggtgttacttaaaactccgtttcccaacgctgctttccacagagctggaggacaggcttttggtgtcgagtgtctcacatccttgttttttttccctttggcatgaatatctagacaggaatttctgataaactcctgtgaaccgaaaagtcaccgaggcatctcaatccacttaaaggtttattttgccaacattcaggatgctcctggggaaaaagggacacaagtcccagtgggatgaatgtcctgtgctttttccaaactgggtttgggtttgaggacttcagtattttaaggacaaggaataaaagggggggtgggggaggtaggaagtgaggcaagtggtcacattcttgtgaggctctgatgagcattctgtgaatctacattttacatgtgaaaacaaaggagggggaagtcagttacgcatttatctcttgcacagtaaatctacattttacataaggtaccctaagcctgtgaggtcacagctatctttctggggacaaaaggcaggcagcttttgtgtgactcggttcctaagcttcactttccgtttggcatagtgagtttggggttcccaaggttctattttcctttcacgctctgtcagagaatttcctagggactattttggtttggtaaatgctgaattagtgtaaattaaaaatcaatcgctatttacatccccaacataatggcccttaataggcaaccatttttcatgagtcttgtttcagacatcccagactccatttcccagagaagcagagaatgaatgggtgctgtatgttcactgctgggtgtccaagaaactgcacaggaagtgtcttaacgtgaagagagtccgcactggacaccggcacaaagggcagagtgaagggacgaagtgtcagatgcgtctctgccaccagcacacgtttcagcggtgctagatttgactaggcacaggactctaaactggtggtttgctgactattaacctccacggtattgctatctcatgctccttgaccccttcctaattttgctgtggttcggcagctccagtccactgttgaaatgctggtagatttcaaaactccgttgggacatattaaattctggtgagccagtgggtgggatgccttctgaatgacaaaggggccccgtggctaaaagctgaaggaaattcatgcaatgatgaatgtgctgcaattaatcaccagagatctgttcttttccttatatgcgtagtatagtgcaggggccagggtgggggagagtctctgagtccagatcttcatagaattaaaaataatgaatatttgtaatcaggcatcgcttgaccaacaactccgcctccttagctggaaatacagacgtccacttttcgctggtgtgtaatcattttctggaatgctaagaattgttcccctgacctatggctttctttttaagcatccgggatatgcagtcaatttgcaggttgctgttttgaagtcagggagtctcggagattgaatatatgccacctaagttcctgcaagatggactttctgggagtcctctgatgaggttgggagaaggcaaagaggagacgtttccatgtaaaggctgagcaagctccaggccactgcagaagttcagctttcttcagctctgtaagctggaccctgtggctggagtctggccaactgcagggacaagtttctattattatgtaaatggagtcccagtgcggccttggaagagtttttggcacagggtaaccctttgtctgccaaaaggtagcctctccctttgcttcaagcccagagcgtgcattgtgcagtggtgacctgtaagccacccgtcaacctgcagattgccttattaggcagactgcggaggctggtggctggggactggctggcagaggcggtggcagtgagcttgtgtcctgtacgaagccggagaacccgagccccggagacgtggcctagtactgttctattaatgatagtgctctgtgatgacaggaatatgcactctccttggcaggcatactttatgggttggttggagaacaggaggtttgcagggggaggtgactgtccgaaggacagaatggtacgaggctttcttcactgcgtagcttgtgtgttcagttctgtatcagggcttattctacggagtatggactttatcgggaaaatttgtttttaacttttaagttcaagagtacatgtgcagatttgttatataggtaaacatgtgttatgggggtttgttgtagagattatttcatcacccaggtactaagcttagtacccattagttatttttcataatcttctccctcctcccaccctccaccctgcgaaaggccccagtgtgtgttgttcccttctatgtgtccatgtgttctcatcatttagcttccacttataagtgagaacaagtagtatttggtttttctgttcctacgttagttttccaaggatggtagcctcctgcttcatccatgtccctgcagaggacatagtttcgttcttttttatggctgcgtagtattccatattaggaaatgtggaatgttttccttttaatgcaagatgttttgtggactctcagaatcttgtttatgttttatagtaaacttttttgaatggtgaggtcatgtgtatagtagggaggaaatataactagatagtcaggtggtacaatggaaatggcagagttttaggagccaagggacctgcgttccacggctgccacaagtgagctaagtggaataagtcacttgcattagggaggtgatttccccaaggacagaatggtatagctcatgtatctagggcttagtgggcaatcactagtgatcactagtgaatctgtgatcactatacattatacatatccaaacatcactccgtaccccataaatatgtacatttattatttgtcaattaaaaactaaaataaaaatgtagagtagactgaatgcactcaataacctctccatcgtacatttctctcctcaaattgcattaaccagcctcccctctcctttttgttctcttcagtaaagctgtttaatgagtgtgtgtggttaatagccacagccgagcatccacggggaccgttttcccaacggaacctgtaaggctgaatccatcttttctcgtttgagtttcttccaaacttgctgcagtagctgaaagttagtgaagacggcactttcctgcactgaaatgctcgttcagatgcctcaggttctatgggttatggctcatggaccaaagctgcacatgaggcaaacgaacacctggaggagcctgcgttcaggatggggcagtgaccgcgctcagagcgctctggctcacatcccttgtctaagcggcttctcattcattgagctgaggcgtcggacacctgccgggaagacagacgcgaaccgcggctcactctgactcctgactgctccggactccggcttcagttctcccctccctccagagatcttggggcaccagggctcataagctgctgcatgagaacagggacgctcttactgctggagtcagattcagagtgtgtgtgtgtgtgtatttttagcacagttgggagatgacatcttagatgctgctggctcagctctgctggtgtctcttttgagcatggagcagtgtcctcgttgtcttcttttcattgcttatatctgctgcttgctgttcagggaaagcacaaattcactttctcctcttgttaaaaaaatagtttggcgggcgtggtggctcatgcctataatcccagcatgttaggagaatgaggtggaaggattcttgaggccaggaattcaaggccagcctgggcaacatagtgaggccactgtctctataaggaataggctgggcatggtgacacactcctgtaatatctgcactttgtggggccaaggcaggtagatcacttgagcccaggaattcaagaccaacctgggcaacatggcaaaactctgtctctacaaaaattagccaggtgtggtggcacacacctgtggtcccagctgaggtgggagggtcactggagctcaggagatcaaagttgcaatgtgccatgatcatgccattgcactccagcctggccaacagagggagaacctgtctcaaaaaaaaaaaaaaggaagaagaataaaaatattagctgagcatggtgatgtgcacctatagtcccagctacttgggaggctgaggtgggagaggactgctcaaacccgaagtcgaggcttcagtgagctgtgattgcagcactgcactctctagcctgggtgatggagcaagaccctgtctatttctttaatgtattttctcaccacctgaagaccaagcagcatgatgtatcccagcttgatgtctgggtgtgacaagtatctgaattttctttttccacttgggctacagggatggctctgatgcttcttcacgggctgtccacggcctcccttcccacctcagaatgccctggctgggcccacagcacgttccgtctgaatgtgggtggctgtcttgccgaacccgtgtcgactccatgggaaggccgcaggttaaagaggccgaagaggagacccagagccagtgaacgaggcacggggttctgttgtgggcttgcatacaggggagagagtccagtggcagcgggctgagtgggagaaccacagccgctttcaaaaggcatgcagtttatatagcaatagcatgtccacttggcacctccccgacaatctccacctggcagccttcacataccccaaaacaaacagtccagaccccctgtgcatgcagtggtggcagcagggcagggaagctgctcagatgttcctcatagataaggaacgaatctccagttggcctctcctggattccttagcttggaaccctgaaccccatgcaggtgccgctgccatacagggccattctcagggtgtgcctaagtgattgctgtcaggcgcatttaccatgcagagggatgggaccatttaagcccacgccccggttaggcctcttcccagttccagctcccacactgtccgctcttcttcctggcacggaggtgagggcccatggcctccctgttcacctattgccatcatctcctccacaagtaagctctccagtctcgtcctccaggaagccttccttcgtcacactcaccccatctgattatgctgtttccctgtttcttcccaggctttatatcatcggtggcttgtattcatggttttctaattctgtgggcgtatcctaatcacctgtggtgggaggactttcattttaaacaaataccgcaagtggtctgagggccacccaagtttgatatcctttgcttaatcagatgttacacccacgcataaacgtgtcttgagtcatttcaacagacagtgtggaatgtgcctttgatttattttgtgtcatgacctccccaaggcacctgcactgtgagcacgggatctgctttcctggtgcaataatatgaccatgaagaaagccaatcatgaaagtgtgaaatatcacaaacacgccctcccctaccccgcatcaatcagcaaggggctggggacctgttctgaaagactggtaggtcttgggtaccagttaatacaacccatggaggccgggtgcagtggttcacacctgtaattccagcactctaggaggccgaggtgggaggattgcttgagcccaggagtttgagacctgcctgggcaacatgttgagatcccatctctacaacaaatacaaaagttagctaggcgtggtggtgggcccctgtagtcccagctactcaggaggcagaggtgggaggaattggcttgagcttaggaggtcgaggctgcagtgagctgtgattgtgccactgcactgcagcttgggcaacagagccagaccctgtctcaaaaaataaaaaataacccatggaaaacaagggtgacactggagatcacaggttgatgagcttttcttgcattttcatactgattattattgctgagattgtcattgttgttactttattaagatgcccttctgagaacaaggagagccagaaattactttatttgaaactttccttcaaattattggagtctagctctagaacagctatgatctatctggtaccaacagacattttatatatgtgcttgtctgctatctggacttttagactcacaggaaattctcctctgtgacgactcagtgtttccctgctttctgttcatgtgaaaaccatcaagtagtgagcactgaatgactggatttggcagagccttctccgctctccctggacgattgtaatcaagtcagccccttcccctctgcatgaggtcttcttctcacgagaggagaggcatgggcccccgcagctctgaaggtgtggcatgctgcaccttatgtcctgggatgcagccacagaccccatacagtgaacacctaggtttactattattattattattattattattattattattattagagacagggtctcactctgtcacccaggctggagtgtagtagcatgatcaaagctcaccacagcctcaaatttctgggcttaagtaatcctcacttctcagccttctgagtggctggaactacaccatcattcctggctaattttaaaatgtttttggtaaagatgggggtctcactatgttgcccaggctggtctctaactcctggtctcaagcagtcctcctgcctcagcctcccaaagtgctgggattacaggtgtgagccaccgttcctgggaacagctagttttatgtttattcgtcacatcattgtttaagagccctttgtgggttggggctttgaacaggtcagaatcgtccttggcgtctcctggcctctggcaagtggtgggccggccatgtgcccctcacaagagctgttctccaggtgctcagcatgtgcctgcattgtatgtcagctgtgatttgccctcagtgtacattttattgtagattgcactgaaatatacacaccatgacatttaccatttcaaccacgtttaagtgaacagttcggtggcatttaggtgcattcgctcacagtgtgcagccatcaccaccatccctctccagaactttttcatcattccaaatggaaactctacctattcaacaactccccaattttccttctgcccagcccctgataaactcccttctactatcggtctctgaatgtgaccattctagaaacctcatataagtgggattgtacagtatttgtcctttggtgactggcttatttcacttagcataatgtcttcaaggttcctctacattgtagcaagcatcagaatttccttcctttttaaggccgaataatattccatcatatgtatattcagtgtgtaatttaaacacagaactgacctatgtctttcttttctgacaatcagctgaccattctctcttcctctgagatacctgaatttttctctccaagcagtcattagccatagatttggaatgaaccagaaactaaaacgattggagataatttcattacaaatgttaacattactcttttgaacattaactttaaagacactaataagtcttttaggtgattgcaataagccttttctttaaaaaagaattctgaagtttagaaaggctggcatggttttctttcaacacatccgataaagaaaaaatagctgtgacttgcaacatttcttattgaacgtactttgccttttcatctccacctatgtggtctgtttcaaattaccttatgcagtgatgtaatgcaacattttatttgcacgcttgtccaaaatattaccactaaccaaaattcacagagcatctcacagtgcacgcaggaggagaattagactaaaatgaggaatctggaaagtctgactgaccagtgagatgtgatcaaggggaaatgaaagggcctaagtgggctttccctaggggcaattttctcaggtcaggcagttctgcctcagattaaggatctgcacacataaagaaaatccaccaaagaaaatgagaataccatttatggctgttgctagcatacaaaatgctcctttactgggctatgaaaatatgttcttcactttggaatttcactccagccatcatcattagtagcttatagtagatttcattaaaatcatttccatagcacttcttgattttggaaatgtattgataagtcatgtcagtatgtattcagacaactgctagtcataatatcacactcccctatactgtacatttaaattccagctcatggttggtttgatggctcacgcctgtaatcccagcacttcgggaggccaaggtggaagaatcacttcaggccaggagtttgagaccagcctgggcacatggcaagatcccatgtctacaaatttcaaaaaatagccaggcgtggtcccagctactcgtgaggctgaggtagaaggatggcttaagcccaggaggttgaggctgcaatgagccgtgtttgtaccactgcactccagcctgggcaacagagccagaccctgtctcaaataaatacatacatacatacatacattaattagttaattcattcattccagctcattttcctgtagactgggagtgctttcattgatgttcactgagcacaacaaggtgacatgaggtgacatcgtacggacctctggaggagcatgtagtgcacctgaatcccttttcaatacggagttccttgtgtggattaaataatgcagtccatttttggagtgcttctatacgtgttctctcattttatcctgacctcaccatcctatttccctctttgattttgttgtggctggccagggaatggctgttttgcctttattaaaacaatttttttagagacagggtttaatctgttgcccacactggatgagtgcagtggcgtgatcatagctcactgcagccttggcctccagggttcaaacgctcctcccacttcagcctcacaagcagctgattacaagtagggattgcaggcatgtgccaccatgcccagctaaattttttttttttaaattttttgtagagacagagtctaactttgttgcccaggctgctctcgaactcctggcttcaagcaatcctcctgacttggcctctcaaagtgctgggattacaggcataagccaccaccaggccctgttttgccttcagagatgtattttaagttgttggtctacgcttgatgtatctatcctaggtcaggcactatcctggttttctcatctgcatatgaggataagtcaccgagaagactaaaggaattaaatactccaggaccctcagccttgcatccgccccccagtgatgagccaggggaggtcacaggcaccatcctgttcggccctggtgggaaatggctggctgcagtggaagtgctggctacttccctttcccttggctttgccctcgttttctcccccaggatgatggcccccaaaggagagttgcctcaaaggacagcgttgcaggggtgcttgtgtgtcatcagccagaacaagtgacagcgtctgactccccaaatagcctccctgtaagtctgagctgccgctgtgacctgcgctacacagtccctgaaggtttaataccgtgactgtcatctaacgccttagcttttgaccttgtcaatttgggaggtgacacgtctcacctggactcatactgagacattgtcaatagttggactgcaggaatcattgtccccgtttttgttttttgttttttgttttgtttgtttgttttgtttttttgagacggagtcttgctctatcacccaggctggagtgcagtgacgcaatctctgctcactgcaacctccacctctggggttcatgccattctcctgtctcagcctcccgagtagctgggactacaggcgcccgccaccacacccagctaatttttttgtatttttagtagagagggggtttcaccgcgttagccaggatagtctcgatctcctgacctcatgatccgcccgcctcggcctcccaaagtgctgggattacaggcgtgagccactgtgcctggcccattgtccccgtttttacctttgcctagctcagaaatcctgttagatgcccaggaactcagatgaacacattgttctgaagaaaactaggaatacacatagtaacgaagtaggtgaaatagagcataataagatacttccagtttccccagcgaatctttagcatgttcttcctgattctccctacatgcaaatatttctgtttcacatcatggcttcagattttaggaaagacaagaagactttaagtaatagtctcaggctgaggaaagagaagtaatacttttcctctctgcaaactattcaagaaatgtggttggctaagaatgggagaaatttaaggatagaagtgatttcagtgcttgcctgcccatttgattgattgatccattcaagcagtattgatagtttacttgttctgagccaggctctgtgctagaaatgcacccggaagtgtgcatcacgtgctgtctctccagtttttataatcctttagctaggagacaataaaggcttttgagcaggaaaggtgtgattggtaataaagaagaacatttaggaaggggatttaacaggtgaattcaatgttggtaggcagggcaaggttcttctgtgcgcacctggtgtcaaggttaagcaacactggtgcctgttatcaaggatcttggtgaccatctagaccaactcctcaatttacagccaagaaaatgcatctgctggaagaagtgagcaggctgattttgagccataggcgccattcattcatgccaggattttctcctggatttttagcctatgtctaagctttggggatttaagaggtcttattgccttcatcttcatttgtatttaattgttttgcaattacagaaggaaatcgtgcatatggtggatactttggaaaatagagaagttactttggaaaacacatgaacagagttatctctgagttgtgagagaattaatgtcttggtttatttcctgtcattctgattaggtgtgtgtgcatctctaatataatatttaaaatttttcaaatcagtaatggagtttcaaccctggtttgctcgtgtaattgatttacccagtcttctatatgcaccccaggtagactaattcccattttatacatttataaatgtatacacaaatacacatttataaatgtatacgcaactgggtccattaactttaacaatattaattattccaattcacggacccatttatttgagtcatctataatttctttcatcgatgttttatagttttcagtatacagatctttcatctaattggttaaatttacaactattttattttttgatacaattatgaatgggattgatttcttaatttctttattatatagtttgttgttggtgtaaagaaatgttattggcattccttaaggaaccaaaagtagaactaccatttaatccagcaatcccactactgggtatctacccaaaggaaaagaagtcattatataaaaaagacacatgcacccgcatatttatagcagcacaattcacaattgcaaagacatggaaccaacctaagtgcccacagaccaacaagtggataaagaaaatgtggtatatatacactgtggaatacttctcagccgtaaaaaaagaatgagataatgtctgttgcaagaacctggatggagctggagaccattattctaagtgaagtaactcaggaatggaaaaccaaatatcatatgttttcatgtataagtgggagctaagctatgaggactcaaaggcgtaagagttgtataatagactttggggactctaaggggaaggttgggagaggagtgagggataaaagactacatattaggtacactgtacactgctcaggtaagggtgcactaaaatctcagaaatcaccactgaagaacttatctgtttaatccaaaaccacctgtacccaaaaaactattaaaatttaaaaaatcatttgcagtcaggtgcggtggctcacacctgtaatcccagcactttgggaaaccgaggcaggtggatcatgaggtcaggagatcgagaccctcctggtcaacatggtgaaaacccgtctctactaaaaatacaaaaattaactgggcatggtggagcgtgcctataatcccagctactcgggaggctgaggcaggggaatcgcttgaatccaggaggcagaggttgcagtgagcctagctcgcgccactgcattccagcctggtgacagagcaagacttcgtctaaaaaaacaaaaaaaaatcatttgcattgttaaaaagaataaaagaaatactactagcagggagcggtggctcatgcctgtaatcctagcattttgtgaagccaaggcaggaggattacttgaggccaggagctggagatcagcctgggaaacatagtaagacccaatctctaccaaaaaattcaaaaattaaccaggcatgttggcacatgcctgtagttctggagactcaggaggatgaggtgggagaatttcttgagcccaggagttcaaggcaacagtgaactatggtcacaccactgcacttcagcctgggtgacagaaaaagatatactactcataattttatttaatttaataaatgatggggtatgtatatatcagaattagaacatgtcgccataatgccatagtctttatgttctgagtcatcatcaataaaccacaaacattgtaaaaacatagcaacctgacatataaattagaagttaataggttaacttctatatgtagaccaaatgaatatcacctcttagagatgataccaataatcacaagccttgtcaacattatatcaatgcaattttagtaaaaagtaaattttccctcttgcagatcccatcaagtatgctagtcactcattgagaagaagagtgcacaagggtaatcatgttgcctgaaggaaaggccctgattgtcattcttatgagtgtccataaaggtcttatttaccattggcatcgttcacagcgtacactttcatcataacgaaaatgaagccaaacgtattcgggagagaaaagtcaggtaccagattgctcatcaatttatccaatttcaagtttcatgggaaaacacatattattgtaactcacatttataccccaattgcaagggtacttcagtcataaagattcatcagtgatcaaaacatatcctagcactgttagaatactatactaatattatagaaaatttagtctgtatttagacctcaatgactataatgcattgagcaaaattccaatgtgtcatatttctcaacccttaaaaaaatcaatcctaggtaaaaagtaaggattttctcatgaggattccatcacatgtgtctgtcagttattgagaaaaccgtgtcatgatattcttgttgtctgaatgaataattgtaattattatagagctcagtcttcactagttcaattatctatttggaatttttcagccggcaaaggtagccgctcacttccactcaatagaatagcaccagtagggcttactaaatcatccagtgagagaaagagagcaagggtcttagtgccaaatacccaagaaaattaggaattataggaaacttaaacacttaaagaatcagaatttatagtttacttagaagcacacagatagaagtgtgcaaaacaagtttcacagaaatatttcattgccagaatcctgaaataaagtctccacagaaggaaactaagaaatccaaacttcttgtctcacaattgttacctaggctgggcctcagtgtaatcctactaagcttaatttttacgtcatcatttctcgtcaagataataattcagcattggcctagcccatggcactcatatgcatatgcacacttagatcaaatatgcttaagagagatggtttccttaaacactggtgggaaagtggactggacaccacatcttcagtgccagacaattgggtggtatcagtatacaaatggtaaacacccttgagttcattcacagtaatttcgtgtgcatttttagaaatagaattaatgagtcattgcttcctacacacttcaaagtagccacatccatatcttattcctctccagtaaggtgggagaattaggaagaaaaggaaaaataataatcaattgcttctttttatacacaacacccacaccccaccagggacactgacttctctctgagccttatggccttagctatgccctagttactcatatctgggggtagccctggtttcgagcaaggtctgtgggatcaaaactagacctagaaatcataaggtttatgaaagacaactgcagctggcctgatgtctccttctggggtcaggctggcccctttaccagcgacatccatgtgggccagggctgggaggccctatgacctcaatccaggacaagtttacaacagtggccccggttctcttgtgctcaggctgatcaggaatgtgggagttgtcctggggagagtcagagcatgtggattttcagcctggcacttccacgccacaagctttgtgaccttgagtattctacaggagtcatctaacatttcattacatgaagaccaggtgatcagaaaggccccttcgtctccagtcttaccagggtccaccagggcctgattcatttgttccagtgatatcactgtggggtgtcagcatcccaatggttcactcatagatccttcaggtctcctccagccaccgcccgtgtaccatgacatgacatggcatgtaccatggcccgatgtcatatgtaccatggtgtggtgtgatgtgtaccatgacatgaccatgttacatgacatgctatgacagtgacctccctcagcctctcccaggcacacagttttaccccttctcctaaagcaggttcgcacgcccatctaaaggcaacttcagtatttgcttttacttctctttaaagattacagccttaaaaatattcagtaaaatattgtacttccataaagcattgcccctgagtaagattagtgcttctcagtggacacagcagcagggaactttgtgcgttcatgctgagctggtggctgtgtgatgctattgaaaagggaatacaccaccatcagcgctcggttaaaacgtcttctccctgaaatttaagaaagtcacaggctgggcgcggtggctcacacctgtaatcccagcactttgggaggccaaggtgggcggatcacctgaggtccggagttcgagagcagcctggccaacatggcgaaaccccgtctctattaaaaatacaaaaattagttgggcatggtggcgcgcgcctgtaatcccagctactcaggaggctgaggcaggagaatcgcttgaacccgggaggtggaggttgtagtgacccaagagacatgccattgcactccagcctgggtgacagagcgggaaaaaaaaaaaagtcacaatcacaacttagaatttctctgcaaataaatatgttaacctacagaatgacgtgaggaaatgtttgggtattttgtagctcccctgtgtgaataagctagcctaaaacaataatgataataatagtagtaataattcttgaatgtcaagtggaaaaattaaaaataataattcattataattattggagagtaaatgaaaatttttcaaagatactttctatgaacataaaatagagatttttcttcacagtcttatttggtttcctatggataggatacctaaataatagattaaattttatatccataatttcataaagaatgttgtgcctttttcctttcaacaactatgtcatatttaaatcagtttgctttgtaccgtaatccatgggtgaggcaaagaattctggtaagactccgttaccaacttaaagataatacccaacaattaaaaaaaatgtgtactggaattttattttcaaatttcgaatacgggaaggggacaagagctgaaaaacaaatgattgggtactatgctcagtaccagggtgatgggacccatataccccaaacctcagcatcactgaatgtacccatgtaacaaacctgcacacataccccttaatctaaaataaatgttgaaaaaaaaggagaaaaggaaaagcaagcgacaggaaaatttgaaaaaaaattagaatagacttattccttaataataattcaaaataaacatttagattcttttagataactgtaattgagtattctacaggaagagtaattttcaggcacaaaaagggtgatgagcagtgatactgtgttccataaactgttacattctttataaaggattatttatcaacatgtcaacatgtatattatttcatcctatctctctattctttttttctttttctttttcttttttttttttttttttgagataggatctcactctgttgcctaggcaggagtgcagtggtgcaaccatggctcactgcagcctcgacctcccaggctcaagcaatcctcccacctcagcctcccaagtagctgggactataggtgtgtaccaccacatccagctcattttttattttttgtagagacagggcctcaccatgttgcccagaccagtcttgaactcctggcctcaagtgatcctcctgccttggcctcccaaagttttgagattataggcatcagccaccatgcctggttcatctctttatttccagaatcagttgcttttactatttcctctccttcctcttctcctcccaacactcccgtttttctttttgttgctaattatctatgaccttaccatcaagtttctaatttagttatccaaggtactgacgttgttcctcgctgagttttttttaactatcctatttgccatagtttttcctgattttatgactataatgtaatgagtttagagaaaaatggcaaaaatgccaccactgacccctctagtacccagggttgatgtaccttgtgtttatgtgcctttattaattcagcatataattcttcattttcaccttaagtgtgtttgtattttacaaattagtctaagtccacctggtttgaacacaggatactaactccacacacccattttagaaggagatctctagcttttagaagagattatcttgtgatttcctatggtcattcagcaaacatttcctgcagccctactgtgcaccaggtacagtgtccagaactaaagatacaaagagtaactcagagtccctgctcctaggtggggtgtggtgaatcacaattttgatcccgcctccccaagatcccatagctccatcaccaaacagttgtctatccaggagcaagctactcgtctagccctatttccttagcttgcaaatgagaccatttctcctggttctcttgaatgttccgtttttctgtacaatcagtctgtaattattgcgaatttttcttggaattgcatgagcattgcttgagctcatcaactacatattgtggttaaaattaagcgggggcaatctaataggcaaagcttaacttaatagcttctacctcaaattaaaattttgaatctctagtaatatctgccctttcttttcccacagtttcactcatatgttgttcataaatcttaagtatgggtttttggctctctgttaggtaaaatacttcacttaacttagccaaagccagacttgcagcagcctggaaatactcaagcgtcccttcttcccaatacacgagggtctctgtaggtttttctttgtatgtgtgtccgtagggagaggaagttgtatctgactcctccgaggatggttaggttgcagcactgtctccttaaccagagcaaatgctgggatgctccatggctttgccttggtcatctacatcacccacgtcccatcactgggctccagtctgttgcagcgcctccaggcttaatttctgttcataatctgattatggggtctgagctattccagccagtggcctcttgcttctcctgtaccataggcacaaagatacaagtgcctggtcgctctagtcctgcactgtgaaaaatctcaacccagttttgcttagaccagacgaaggtggttgctggctgagaattagctgtagagcaggctgtgtgaccgagccgtctgtgtgcagccatgttcagaagcccagggttttccagctatttgggagctttcaaattctctgagaaacaaggtaaggcaagataaatatgaaatgcacttatgtatggattttataacacgatgaatgcctggggtcctctattttgccctgtgtattctcctgtgttcagttacttatacacgtttctcaaaagacactttaaatatctaactgagcttatttgtgattgttgataatgtgaatttttttcctttagtaagttaaagttactactaaaccactgaaacctttttgtaggaaaaattgcaaatgcagttggaatgcccacactttggatcaaattctagttgtgctgcactttagctaaaatagttttctaaatcaaatgctatacatactaaattatttccagtaggcagtggtgagtagcgtctttttattaattcttcatgtgagacagtttggaacaagatactgtcttttcagtggctttcttccagcacagaggaaaatacatgctttcaatgtaactactgaagtggtgtggcatgttcagttcactgattgaacaaaactgaaacgctaaggttattttgagtatcatatttgaaactcagccattatacatcagaactgctttccagctcaaatgcactattgggaagtgacttgaacaattcagacctcagattcaggaattttctcctacagcacttgaaagctttctgaattgatttctctttggttaattacataacaagatacttgcatagttaagagaaaagcttagatgttttactggcattatacctttcattttattgtatttctttagttggccacagttccaaattccaggactgaggatgtattttgatggataatgaagtgtcaacatctgatatattttgtacttatttttccttgggcttctgcccctaaatattaaagagcaaaaggcacttccttaggggaagaagtttctgtaaatggtctatttgtggttttcttagtggacaaatgctgtaagccaaaggctgtaaaacagattacatgccattagactggttataaattttgtctgtgcctggttttgattaacctgttcctttgggatgtttttcctgtatagaattgttaccagctgtctttacataatacctatcttgtcttcaaaatacaaataaatagttatttttattggttgttattgtgtagattttaatgagagcaaaagacacagctgagttgtcctttgctcttcagaccccacccccattctttaaaggcatctcaaacatttctagttgcctggaccaaaattgcttagtttctcctctattcctgagtatatagctgccttatttagcatttaattgctttgagttattcttgttgccataacaaatttaaatggtaacattgaactgtgttagaagtattattgttattattgttgttattattttcatttacccatggagtatgttggctactttccggaagagaaaagcaaaacttgcctatgtaaatttccatgtggaatttgattcttagaaggtgtcatttttgtatttctattttttgtctggttaatggttttctttttcttaaattatatgttcaaaagcagtttggagagttttttctcaccggatttttaacaatttgcataactatttcaatgttacattatttcttttcccttagatttcaacaagaaaaacttaagcttccttggattcccacgtcaaaggaaagtttcaaggtaaagtggccttgtctcaacaactgtgaaattttgaagatttgttgtagcttttaaaattattctcttgaatgtctaactcatgagtttaaatgtttggcaatatgttttctctctagaatttgatttattaaaatgtatgaagcagaggaatctttgtatttaattctgcttatggaaactatttggagaacagaatcttgctgtctcttgtcattgcaaacttttaaaggactattatcttttctttctcacacctgcctctaagcaggcactgtccttttgcaatctgtccatcaaagaagggagctagattctttttagaaatggtttaaacttgtttctcttccttctcccttcctccttccttcctctgctccctccctccctttttccatagacacacacacatacacaaacacacacacacacacatccatccatccatccatccatccatccatccacccatccacccatccatgtgagttattcttccctggtcttctcaactctctctcttaacctttctgaacttccagtccccttggccacagaatattatgggtgctaatttgattgacctaatgtgctaaaactccatgacacatcatcatggatgtaagagaagtggaaatgaatgcctgtgccatacacagtagctgtatctcaggtgctttttagtagattgttgtctatattaatagagtttgatattttcagatggaggcacaaagttgtcccctacgcagtcaggcaaagatctcaatctgtgcttcattatagcggaaggacccagcccccatttccacacagttgctcttgtgcctaaggtattatgacattgttccttgaccaaaaagggtttgcatttcaacaacattaggatagacaggggtctaactcctgtcctcctcaggctgagcctgctctgcatttgaaaatggcagttgatcttgtaaacaccctggatgggacaaatccttggtgtatttcctccacatcttttaagtgtttatgctttaatttttacacacaatatcatcaagcggcacatctaagtacaaggttaattagagcaatgatgatccagggtcatcagtgaggttgtcttaactgactcacgaaacgtcacttttttaatgggatgcatccgtatttctcatcttggccatgttttaataggatctgaggcttggtttctttctgtttttgtttttttttttgtttttttttttgagacggagtctctctctgtcacccaggctggagtgcagtgacgcgatctcagctcactgcaagctccgcctcctgggttcacgccattctcctgcctcagcctcccgagtggctgggactacaggcacccgccaccaggcccagctaatttttttgtatttttagtagagacggggtttcaccgtgttagccaggatggtctcgatctcctgaccttgtgatccacccacctcggcctcccaaagtgctgggattacaggcgtgagtcactgcgcctggcctcggcttggtctctaatatgtccctagcaggttggtttaactgtcatggagctaataagtgactaaggaaaaaagagacaggaaggcattccttattcaaggataggaaaagcatgcaatatgaaagtcacacacgtcagtggacagagactcaaagagacacagctattctcaaatcatggacattatgtcatgcatacctattaaaatgacagcctgtgtgccatggtgctaagtgtgaaatgggctggaggtacaagagcctgcttccttagaagaaatctggtcaaccagacaccagctaaaagagacgaaaatatgagctcatggggcttcgtctcccatatcttgtaatttaaacttcagtaatggaatgaacagattgtggaggagacttacaccgcatgggtgctggacagtcattgtaatagtagcatattccacgttgtgaaaaacagagatgataacagcggagcatcctgctctccctttaataaaattcccccgtgctgctatgggcaggcatttaagtaggttaacgggacacgtttaaaagaaaaattgtcacagaagcagggggcattctcttcttagaagcagaggaaggggggtggcggcacaaacaatcagtcctaaagaacgagcactgtttcaggggagacaaagagagttggaaaaaaatccaaaaggtgtttctcactgttagaaagttaaaatcaaaatgcagaaaatgaagtggacagcactaactttagtatctatggagagatgcttccctactgaaacacaggctcttacttttggttgagctctagtgagacaccaaggcctgcagaggttgaccctgcagacacccctttgtccctggggaagttggggttgaggggtgactgaggaggaagggcaggatccagcatccgagagctccatgcttttggggtcactggtcatgtgcattagtaatgggccctaccagtctcccgctggggggcctctgagtcagaagaagcagagaggagagaagagtctggaccctcacaggtgcttgtgtttcatcagcgtcagatgagccaaaaaaggtgctcactgatgaaccgtcctgaattttacaagcatgtcttacctgtgttttcattgatgatcggtgccctcgggtagagaaagttcagggaagaaacatgattttttttaaagaaagaaactcgatttcacatgttgatttgaggggtcttgcattaatcacagcttgtggcactgccttgagccagagccacactttccagcccagtctgcctgctcctgctcctcctgtctgctcatctgatttctcagaagcccccagtcatttagcgggagcaggggagagaggcagcggagacaggaccagagggtgatgacagccgtgtggactcagtaataaatgtttacctggaagctgcagattctaaaatcaatactttataaacacgtgcaattacgccagtttttcacacatgtatgcaaggtgagcaaaggtactaaagaatgatgtgttccaaattatgccctgtccaaagatgaaagaaggaaagaaaggaagaaaggaaaggagggagggtgataaggaagggagggaggaggggcttatgactgatgttattgaccgtatgctcttatagttattctcaatgtttgtaatgatgttacctctggccatcacatcaactttgcataaaaggtacacaaaaaatacttcagcgtgaattgtagtattcatttgaagtgttttgtagtaatcattcattcattcgacatattttaattttttaaaatatttttaattcaatcatttaatttttttaacagacagggtctcactctgtctcccaggctggagtacagtgaaatgatcatagctcactgcaacctcaaactcctaggctcaatggatcctgccacctcagcctcctgagtggctgggactacaggcttgtgccactgtgcctggctaattttcctatttttttttttagagatgggatcttgctatgttgcccaagctggtctcaaactcctgggttcaaacaatcctcctgcctcagcccccacaaagtgctggggttaacgaggtgtgtaatatactttgggtgatggtcacaataggcagtgggtttaggtgctttgccctgaggacatgaccagtcaactgaggcccagaccagaagcgaaatgaagccacacgatggcaggaggctggagaggagagagctcagggggaggaaacagcatgtcaagtgaaccacgttaagaagcatcagagactttcctcttagacctttggttttctttggtttctgacctgccatcaaaaggctgcacttcacatgggtgctggcactatttgtagcgtgtttcgagaaaataagtgcctgtgaagccagggagtgtccggtgatgactcgtaaagctcactctgtaaattcagcggagtatttaactcagggacactttcttgctttttattagtggctctattgagctttctgagaaacagaaagaaagaggaaaataacggcatacagatgtttatttttgaaaataagatatagcatttgtaccgcaaggtaagtggcctgaaaagctgaatatttcaaggattgcattatttcacttcaatgtagaattttttttcctgaaaagattttagtttcctaaagaaagtatagagctttgtcaagcaagatgtttaaattagcaattaaataatcaattaaaataacacgccattccttaagtcgggtacatttctgccattatttaatttttttaggtttctacactgaaaggagtagttactgccttacaattcagtgtttagaagtcggtgctaattctaagtttctgactaggcaggtgtcctaggctcttccagccaatctggagtgtggcttatgaagcataattattctcaagacttttcattaaataatgtgaacacacttacctatggaatgtaagctttgctacattgtatatggaaagatgaagatttcagatgggcttggttctaggagggcaggatggtggctgtgctttggactgtggaagttctttccctgtagtttttacagggggtagaggttatcaattgtcccacttacacagtatgcgcagtggcttcctcggtctcttccttggcctctatggaaatgcacccgaacagggggaaggtcagcttcacagtgagtcttttccaagcccatcttttccccctctggaggtcacactgaccttgaggaactgcagttccctctttccacaggtttgttttcttccttcgaggcagcagcaccctctgccctgcccgctccgaccacatcaaagaccatggagttgggtacacagcagtcttggggtgactgtggctagtatgaaactaggagatggatttgaatctcatctcctcttcttgtcaaatacgagtctttgggcaaatcatgtaacaatttccggatctgtaaactgaggatggtactagttccagtgttgtgctgcggccagacatgtgtgcctctctcccaactttgagttcagtgagtcctgtgggagcctgagatccgccatggtgggagtgttgacaccaccagtcaatattacaaagcaggtgctttttgcagggccgtgtggagggcctgggtgggcggggcaagagggcagggccattcgtacctttatcagcacctcgctgagtagttcgtacctcttagggtcttggagagataattaaggagatacctgggggatacatggggagataaggagatacatgggggaaagcagatacatgggggagatgtattaagatgtattaagatgcattaaggagatacatgggggaaagtccacagtaagggctcacttcctttattattctcctctttcatttcctcttttattccaacacgagtcttcatgaggctttccaaacttttgaccatgctttgatgccttggttgtttgaaggcatctgttactttaacataattttaacactggaagacagagtgtagatcacctagacaagttactgattttctgaagaagaaattgtagcacagagaggttgagtaattaatgcaagcttgcacagctattcttaggtcaagaagaggtggtcagtctgagttaaagctcacgactcccagttcagcaatgttttcacacatcacaccacgccacccgccaatcctgctgtaattagttgcacaaaaaatcaaatatttacagaaatataaataaatgaaaaaagttaccaatttactccccaatataaaacattttacctgcgatctatgtgtacatattgaatgatgtgtaacaatatcataatttttatgttctgcattttttcacttatatatctttatttaaatggacttaactttattaatggagtaatttttagctttcagaaggagttctcactcgaagataaagaacagctcgctaaccacgaaagaggaatcgatgctcagcttttagttgcacttcctaaaggtaaggctgttcctaagtgaccaaccatgtctgggtagatgcgtattgtgttgtccgaatttccttgagcagaactctctccctaacctccagcttacagtctcctttcggcccttcctgcctcctcccagaattagcttcaattcccttccccctctctccatgcatccatgcatttttaatcctcacctttctactccttcttgccctttaattttaggcatcctcaggttttcgccagaggctgggtgtggcgggtgagacagggaacataaaatcgccctgccctcatctctttctccgtttaaccttctccaagggcagtgagttctgaccatacccccatttcttctctgtccacccactcctgctgcctctggaggctgccccaggccttacggctcttttttttttttttttttttttttttcttttttttgagacggagtctcgctctgtcgcccaggctggagtgcaatggcacaatgtcggctcaccgcaacttccgcctcccaggttcaagtgattctccttcctcagcctcccgaatagctgggactacaggcgcccaccaccacgcccggctaattttttgtatttttagtagagacagggtttcgctatgttggccaggctggtttcgactcccgatcttaggtgatccgcccgcctccgccttgcaaagtgctgcgattacaggcgtgagccaccgcgcccagccagggcttttacatttaacatcttgtagcttcctgctgagcggcgaacagcccgtgcagactttatcatgagcatctttcttcttccccaaggaggcactcacacgtgtttggtgaattactatttccactggtcaaggcgcacatgcggtaaaatgtctgcaccaactataaaccaattccccctagtgttaccagtgaaatgatgtaaacattgattggtctttgtaactgtaacactagcacaaggaatgatcattagtctcagctcacaaaatgtcttcatcctgactgagctgtggaaaccttccagtggaagaaacagatttgatggaagggcagattttttctactctgaaagaaaaagcaaaaatcatgccccaaagaaattagaacaaaaaacgtattcttttaatagaaagtaaatccagtaaaaaaaagtcccactgacgaattggaatatatcctgaggaactgaacgggtgataggccgagacacagtctgatgagggtgaatgtctgaaagactcaggggatttggcctggtgaaggaaacccagacagagacatgtggcaattttcaagaactgacaacgctgtcagccggaatacaggtttattctatgttgctccagaggccaaaagtaagaataacgtgtagaattacaaggaggcagatgagatttcatatcaaaaagaaaattaatcgttcacggtacctggaaatgaggtggtccacgctgtgctcgcatcggctctcccccagagttttcaagggcaagccagtggcctcgtgtccagttaggacgggtgcagatggggcatggaacggctgtcagatggaatggctctgccaatgtttaggactctctgtgaaagacaaaaaaaaaaaaaaatttcctctgagccaaactaaagtgcttaatacctatgcagatgatcaaaacaaagtataagaatgaacaaatccatattagcaatagctgagaaaagtttattaggcaaagttctacatagcagaggttgtttccaccagtcagaagcatccctctttcccttcctctatcccagttcctttatttgatgcataataccgcagacaatattatgagcagaaaaatcaaaaacaggatgaaatgctgggttccttaaggttcaacaaatggtaacttcatctgtaataaacttttagaacacctaagcttattagccagttgtattaaaaaatttgtcataaatgattataaaaaataatttttacaaatcaaagatgacgattttatgtgttcaccagattggtgtttctaaattaacatggtccctaaatctttaaaacatgctttaaaagtgccagtgccccggctgggcatggtggctcgcatctgtaatcccagcactttgggaggccaaggcaggtggattacgaggtcaggagatcgagaccatcctggctaacgtggtgaaaccccgtctctactaaaaatacaaaaaattagctgggcaagtcccagctactcgggaggctgaggcaggagaatcgcttgaacccgggaggcggaggttgccgtgagccaagatcatgccactgcactccagcctgggtgacagagcgagactctgtctaaaaaaaaaaaaaagtgccagtgccccatgtcccctgaatttcacctaaattctctacagtcttatttcacatatctttgctttttatgaaaaaaataggcagatttggaaagaccagcaatttcattgtttctctgatttaacacatgtatcaatgattttgtgtgtcagctcttagcaatattatgttaaaaaaagatttggttataattttattttaatgacatcaagttttatgtgtgagaagtttatggaagtctctttctgttcatttcctgtgaaaatgggcattaaagtggttgttactttttctctacgggacttcctctgtgtatcacaaacaagtaatcaagggattaaaaatctttacctatgtaacgtttataatatttaaaaagattttttatttaggaattatgaagtggaccaaacgtattactccactttctttagcaggtttattaagatacaacacacatccatgcaatcctatcatttaaagtatgcgattacgttggttctggcaattcagagttctgcctccatcggcacagccagttttagaacatgttcatgactgcaaaaagaaacctacacccttcagctgtcacctctcccccttattcctctagtttgtaattgcttggtttatgagctgcttgtctttatattagtggctgccatccaagagtaaaagttaaagggctttactcctgtgggaagtaagatcagaatattccaaatctggcctgggctcttgagctgtcgtgtgaaggagagaagtgttcttggcagtacccctgccacttatatttctttggaagattctactgtactcaagtttggaggactgaactcaacaatgtcttaaccagaaaccttctgtttcttagagctaatggaagaaactatgtttcccaagaaaagcaccctgcagaccaaattgtctagaatattggtgttatatagtcttattgcaaagcctattaggtggttgtaaataactttatgaagtattatagctctgctatcaaatttccttaaatcgccttacttgaaaactaacctccagctcccatcagaaataactaaagaaatagactcacagagtccagattgccacagtagtaccactccgaattactcaaagaagagtaacagaccaacatagcaggtaaaataagggacaggtggatatgtttggaagtcctaatgtatttgaaagcaaaatagaaaatgtctcattaaaatggaaattagaccatcgatgtttatttatatctggattacataataactactattactaaacatgaaccatatatgaattataattatgacacagcatataatcaattgaattgtagctggtgaacctaattttgaaaagcattcttattcttttttgttaagaaatacacactgaagaatttagagatgaaggggcctcatgctgcaattgactcaaatggttcagaaaaaatactatgtaaatatgtatgtgtatgtatgtacatagacacatatgcacatgtaaatatacttaagagaaagaagaataaaaataaacccaatatagtaaaatgttaacatattgtgaaggatatctcttacattttctgtacgtctgatattacaaaaaatttttttgaagttttaaaagaacacaaaccttcaagattttcaaccagaaggcaactttggtagaactgtaggtaggctttataaataaaacaacagcgttacaacatagatttccacagcaatggtgactttcatgcatgatgtttttagtattggctttatgctattaatagtacaaaaacatgttttatatgattaataatataaaataatataaaacatggtttatataataatataaaatatataatataaaccatattttttatatatatatatatatttcgaggcagaatcacactctgtcactcaggctggagtgtagtggcacagccttggctcactgcaacctctgtctcccgggttcaagcaattctcctgcctcagcctcccgtgtagctgggattacagatacatgctaccaggcctggctaattttttgtatttttagttgagacggggtttcatcatgttagccacactagtctcaaactcctgacctcaagtgatccacacacctcagcttcctaaagtgctgggattacaggcaggagccaccatgcctggctattattattaataataatataaaacagatatgtaatataatacacattaattatattacatgttagtacagacatggggaaaagaggcaaaactcaaaatgtctctctgttgcttctttttgtcttgtacatcatttcttataatcccgtttctgtaggaatgaggcatatcttggtaattaaaaatatatttgctagaaagaatagactgagaggtcatcatttgtttgctggggagacttttttattttccttttaaaattcactatagattttcactaggaattaataagctcaccaatacatttaaaggacaatttaatttataagctcatttaattcctcagtgaaatgatcagagaggaccctaaggtgtcccttcaagtacccactatgttgatggattctagcttccaggagcaataggcttggcatagctttgcgttgaatctaggcttgactgaaaagagtgcagtgctgggctagtggcgtctgtactgtgtaacctagggcctgggtgtctaaggcacaggctgtgtatttgaaattctagtactggggaatcagtgattctcaatggttctcaatttagggcagtccctaaggggctttagaaatatatgaggatatttttgtgtcacagcaaatgggggtgatttagcatcactataagaacctgggacattcaacatcctgcggcagagctcacagcaaagccacttcccattcagaagccattagcgcccccatagtgatctgggagctctccagagccagcctcctgagcccatgaccctgatgaggtccatctgtgtgtctgctagatcctatcctgagaatttctcgttttatgcccagaagtggatggctatcagagggcagtgttcactggaagggcagtaggaaagtctacctttcctgtggacaggaggcttgcacagtctcccaactagatctttctttctggaatatgggaaatagaaaatagcaggaagcaacatgttgctttgcttttccatgcactgttgtaatctttttttaaaatgcctttagttgcatttctatagaaaaattttaaaattaattaaaatttggatgaaatgaaagtgattttcagcagtctctaattagaaccaagaaaagtctatcttaactttttccagtggaagttacatgatactcggtttattaacggttttgatacttatccagttgaaataatgtggggcaagaaaagggacatgttaggccaggcgcggtggctcacacctgcaatcccagcactttgggaggccaaggcaagcagatcccttgagcctaggagttcaagaccatcctggataacatagcgaaaccccgtctccacaaaagacaaccaaaagctagccaggcgtggtggcacatgcctgtaatctcacctactcgcgaggctgagttgggaggatcacttgagtctgggaagttgaggctgcagtgagtcgagatcgtgcctctacactccagcctgggtgacagaatgagaccctgtctcaaaaagaaagggaggggggagaaaagaaaagaaagggaaggggaaggcaggggaggggaggggatgtgattatgctactcaggaccctattaatattttctatttctcagttagggtttgaggcatgggttcaagtcgtaccttttaggcacccttggaatttggttttgatagcttcttgagtggtcttttgaaaaatagggctccactttcctctttggggtttaaataattaaaaccctttggtttttgtcatccttgaaaatattttcaaaatatgtcctaccagccattaaagttgtatcaccataatcccactagggctaatttgttgacagggaagctgttgttattgaccaagcctcctctcccaaggccgcatggcggggtgcaccattctcattatacccctgtcttctaaataggaacatgattagaacaaggacttctctgcctccagctactctgattcctggggaggccaactgggagacctttttgaagtcagagggagagaggttttgtttttttgaagccggctatctcaacaaaagccaattcaactgaagttttaaggtggctatcacttaaaaataaatgaagaaaaacaaggcttctatccctgaacacaaagggcaatataaaactttgtgtgtgtgtatgcgtgcatgtgtgtgtgtgtagttttgactcattactaaaaattaccacttagagaaaagaaaatggaaattgaagcagtcaaacatcaaattcctttgagtttctcctgtgactcagcctttcaaaacttttcattggccctggccccaggctgtccagccacccctctctctttctcccaccccattctgagtccttcataggagtcactcagatgcgcccttatgaatttaagctattgaggaggaggcaaaaagagagacctttattctccatgaactttggccatttctccaaagaaacagttgtctggcatctcagtaatatccttgtagtcagtatcatgtgagaatctcccaacctcagcacagcgtttgttctgtttctccagtgctgccagaaacattggggtaattaccttacccatcatccacctaaattatagcaaggaaaccattgttaacatttgcttccagtgaaagcctgtgcagggaggcggaggacctgtgttcatctaaactgtagctaattgaagcggccactttaggcactgctggaaacacaatcagatagttacagccattgacaaattccgtgacagggtggaggagaagcggctgtgagttcatgcttgtagcttgccgatggccctgtggggttcacactcctagtctatacttctgtaaatgatttccataatagaagcttagaatactttgttaaatcaaacaaaagttagaaacagttgctgagatttctgcctaaaatactttcctagagaaagcttgctcgtcaggtctcccttgattcccctagatgaaataaaaccttctgccttaccctgtaggattttacttcttagccaacctatatatgtgacatatacgtgagtcacatagctaggtgttacaatatatatacaacaaaacattctatttaaattattttaatgtatgtgattttaaatatattacatatatatttcatattaaacagtatgttgagtgagcatgtcttagctttgccttgataactctgtcatttttatgggcatcaaatattcagcttgaccttagaagaggatgatgcgtcctagggtgtgtccatgtgtgtgtgtgtgtgtgtgtgtgtgtgtgtctgcacactcttattcatttggcatctgcctcccctactaggaaacagtttccaagaaagcaggaacttggtcagttttgcatgtcactgtgacataggaatcaagaactgaaatttgcagttcaataaacacgttgcatgagtgaataaaatgagcgcacgactactaaatactatattttgttcttttttggttttcttccagttgcagaattaagacaaatctttgaaccaaagaagaaagaattcttagaaatgaaaaggtaagatctttatagtgggagttaggaagtagaagagagcttggcaaagcagtattccattttcctttagattcgatcgctgttgctcactctgcctcttgtggtgtatttcacagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggtgagcgtggagctgggtggcccattttccagcaggctgcctggctggttacgagttgccctttccacccagtggtatcagaacatgagatattccacagaagtgaattgtgtggatataatttttttagcacaaggtttcactctgtcacacaggctggaatgcaggagtatgatcatagctcgctgcagccttaactcctgggctcaagctcaagggttctcccgccccagcctcctgagttgctgggactacaggcttacaccaccacaccaggctaatttttttttttaaacatttttgtagagacagagtctcactgttgcccaggctggtctcgaacttctggcttttagtgatcctcccaccttggccttccaaagtgctgaaaatacaagcgtgagccagtggacttggcctaattttttgttaaatgtatttgttttttgtttatttttatttttattttttttagagacagagtctcactctgtcacctaggctggagtgcagtggcctgataagctcactgaagcctcaacctcccaaggtcaagtgatcctcccacctcagcctcccaagtacctgggactatgagcgcgtgccaccatgcctggctattaaatagatttgctaaaaacagcaacaacatgtatgtcatctctgccccgcctcacggatctggccttccatgtcacagcagtatgaaatgattcccctcgcacattgttgggtaacggaggccagtcattttcctccctagactggggccctcaaaggcagaagctgtgtctttcttcaccctcagggcccagcacaggatctgtgctctaagataggggcctctcaaggttctaccccagtacagggagcggctgctctcagcagggagcgctagagtcaaagctgcaccttgaatgagtacggttcttactctggagatgcaagaaaactttctatctaagttatcttaatgtagataattttaaatacgttgcatatttatttcatattaaacagtatgttgagtgcacgtgactcagcttttccctaatcactcagtcattgttgtcatcaaatattcaacttgaccttaggagaggagaatgcacgcagggctgctcttcccaccacagtccctggctctgaggagctgtgctgctgctttttattttttttatttaattgtattttatttttggagatggagttttgctcttgtcgcccaggctggagtgcgatggcaagatcttggctcactgcagcctccacctcccaggtttaagcgattctcctgcctcagcctctggagtagctgggattacaggtgcccgccaccataccgggctaatttttttgtatttttagtacagatgaggtttcaccatgttggcgaggctggtctcgaactcctgacctcaggtgatccgcctgcctcggccacccaaagtgctgtgattacaagcgtgagccactgtgcccggccatgctgctgctttttatagccagtgttttctagtttctagctcagagacagctgttgatctcattttatgatgttatcagtttgcttgtctctacagtttccaatttcctgtggccagaaagctagaaaactaagatattttaaaatcacatgcaattattgaaaaaaaaaaaaaaaaggctgggcttggtggctcaacaccagtaattccagcactttgggaggctgaggcaggagaatagctggagctcaggagtgcaagattagcctggacaacacggccagactccacctcttaaaaagtaattacacgcttgaaatatcaatacacagatcagagtcccaaaatttatagccagaaataaaccgtagtgtacccgaaatggtaatctgtgtagtatatgtgaagtttaagcttcacatagtagtgagaaaaggaggaattatttaataaaatcataatgaaaaaaatgggtttgccagagggtgggaagaggcatatctctcttctcaattcataccaaactccaaaattagttccagttactcacctgtttagtttaaagaaaataatggaaaagatacatgaatatttaattcaggtggaatgaaaaaggccgtatgggaagggttaaggtaataatggaatgcctgttagatagactgttaggacccttaaatgatatcttcaaaatagatttccaaatatgggaattttttttttttttttttttgagacagagtctcactttgttgcccaggctggagggcagtggcatgatctcggctcactgcaacctctgcctcccgggttcaagtgattctcctgcctcagcctcctgagtagctggaattacaagcacgcaccaccatgcctggctaatttttgcatttttagtagagacggggttacaccgtgttggtcaggctggtctcgaactcctgacctcgtgatctgcctgcttcgtgatccgcctgcctcagcctcccaaagtgctaggattacagttgtgagccagctgggaaaacatttttatagaatacggaaaatatttttatagaacattaataactaactattttataaagaaaaaattatattaactagaaggaatatataaaaatgttattagtttgtagggtgatgattgataggtttttttttttgttttgttttttgagacaaggtcttgctctcttgctcaggttagagttcagtggcatgatcgatcatagcttactgcagccttgaactcctgggctgaagctatctgcccacctcagcctcctgagtagctggcaccatggacatgtgccatcatgcccagctaatttttaaaataatttttgtagaggcagggtctcactatgttacccaggctggtctcgaactcctggcctccagccaccctcccacctcagtttcccaaagcgctgggattacaggtgtgagccactatgccaggctcatattagatatttcctacaccaggcatgtgtgttataactggggaaaaaaaacacttctgtaaaaaagaaaagcctggtgaataatgatatgggccatatcgttatggttactctcagatccccggaaaccagcatccatcacttgtccaatgacggcagctcacttgtctgctgtctttcccagaggacccaactcatcctatggcctcccacgtgaaatactgaactccacaaaaaagggtaaatcagtaaggggaaataagcactgaacaaagactgaggcgctctggggagtgaaggggctgagctgaagttaaagccacgccttacggggcttgcagaacgtgcaccattcacagcctttgtagatttcactgccgatctcagacttcttcaacagcccaggtaaataatcagtttaggcaaacacacctcggtgagaaactggtccttcacagcatgggcacccaggtgtgtgctgtgtgcagtagagtgtcattctgtgtgtaaatacatgtctttacttgaaatctgcacctctcatccatgtgaccttcttgtaggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtaagcatccagtccacgctaagcaccctgaacgcaggacaataccttctttttgcctctctgtgtgatagggtttggctattctaagcattatgtggaagtcaaggcttattggagaaatatcatagtatatgattcttttttttttttttctgaagacagggtcccactctgttgcccaggctggagggcagtggcactatcatagctcactgcagcctggaactcctgggctcaagcaatcctcctgcctcagcctcataagtagctggaaccacaggcacatgccaccacgcccggctaatttttacatttttttttttgtagagacagggtctccctccattgcccaggctgatcacaaattcctggccacaagagattctcttgtttgacctcccagtgcactgggattacaggcatgagccaccgtacctggcctaagattcttacatttcagccatatcaaaacaggttctaccaaagcaggaagcctcatgttctttttctttgtgcgtttcttatgtttttttttttctttttcttttcttcgtaattcttttttttttttttttttatactttaagttttagggtacatgtgcacaatgtgcaggttagttacatatgtatacatgtgccatgctggtgcgttgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgtttttgcgatagtttactgagaatgatggtttccagcttcatccatgtccctgcaaaggacatgaactcatccttttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagaatgatttatagtcctttgggtatatacccagtaatgggatggctgggtcaaatggtatttctagttctagatccctgaggtttcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttgtttttttttttgtaaatttgtttgagttcattgtagattctggatattagccctttgtcagatgagtaggttgtgaaaattttctcccattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcttatgttcgttttaaaaacaaactgaacaggtgtcatggggacactttcatggactcctcacttcaggaccctcttactgggtttctcacacccctttcatagtttatcttttcgccgcttttctgtaatcatatcagagactgatgattgttggtgactgcttttgttgctgtgattagaatcacagagcagaagaagcaccactaaccagtggaagcatctcagtgcagagcacagaagtatgactgcaatatacacgaaatagaactagaatgcctagttctgtaagtatatcacacactaggacacaggtatgtgtgagaaccccgcattatgaagatcagccattagaaaaccactgtgtaaaaggatccactcaagataagagcagctgccatttggagaaattgaaaaaggtatgaaatcagaaagtcagatcacagaagagaatatatgtttacttccaaatttaaattttaaaagtgtgatggctatattaaaagtgcaatttacttaactgtcctgcttaaagctttggggtaattgtctaggtggatcttaagtgtatttttcagttcaaacaagcaatagtttcccaggtgaattgagaagggatcagaacctaaggtcagggagattcattctgaaaaaaaagattcatatgtgggaaacacccctatttttttcccactgggacacaggggtgcacacctggtcatctctaagtggcagtaacacatatgaagcagacccttgtggtactgaaatgtattaacccaaagacctgtcaccacatactcgagcatccagactgaaatacttagagagatcagcttccaacagaattaaaaggtagatcccaaggatccattttgagcaccttttttcagcctttagttttaactggaaatgtagggactgtgagttactgtctcatattttgaaatgaaggtcttttgtttgaggaatttgcatttcatcgtagaaaccacgttcttggtttagttactttctaccaaaggaagttcttcctgtgttttgcaagtaggatgaagaacctaacagactccaatttaaaaagaatatcagagatatataattacactggtttaaaagaaatggggaatctaatttcagattgccacatgatgagagctgttgaagtcgttatcacggtatctgagttagtcacctagatcacatataatagattctcaaatagattttaaatcagttataatagtaattaagactttgttgagcatcccaagtaaagacaggatacttcatatttcgtatgagttaaaatcttaatattaaaaaaatgtatataacttgtcttaagacctagaaaaaagcattgttgacatatttaggcctgtaataaaataaagccacttctttgtaggttattttgaagatgcatgttacctagaagttttcataagccaagccttagcctcacagcactttactttcatgaaaaagatttaaaagaattaagaaattgtaaggacttctagagaggtgcatgccttattttctaagccattaaaggtatacaattctatgattcacaggcaaagaaacccaaagtagtttatatatttattaggaaaatacctgggacatatttacataaagagggatggaaaatgtgtgacaaatttgacatttaaaaaaattaagatttacattgtaatgacagcagtgattcaggttgtaaagattgatttacagtggattaaaattctgcttagatagtctttatctagaaccaggaaattcaactttcagaaagtcattttctgattcctatttagggagaagtaagatgaaccaaaaaaaatatgtggtaacccaaaacagtaacaaaagaaacctccttggtgacctaaataactgtatatgaaaataataatgtcatctgatatggaaacatgtaaccgaaaactttaaaatcaacaagtgaagacaaatagtacccatgaataatgtttaatgctgtggttttttgtggatttttttctgtcactaaaatggaatatttttctcactgctgcactctcttgtcatctagctctgccaaatttttggctattaaatctctgaatcaactcattcccatttaatcattttgttctgtgctcgctagcaagaggctgtcttattatttaaatacgaatacgatgacactcatgaatataccatcaaaagaccaccaatagtgtcctaaatattcaaatgtgagcaccatctccaatgctcagtttttgaatgtgctcacgtacattaacacctgtacacatctgtgtatatatacagaataatcattaattcttatacttcactatactgtactcattagcattataggcaaaataacagtctttaggacaatatttacctgaataatacatttattttacaattctttagtattcagtttatatgataaagaagattttttaaaaaatagttaattgattagttgatattacaggatttttaactcagaaatcctgttagatgcccaggaattcagttggacacattgctctgaagaaaactaagaatacacatagtaacgaaataggtgaagtagaaaacaataagatacttccagccccacctctctaactgttacaaacctgtaaacttgaaatttcagaaatggtattatttgctggagaggtagtgttactgattatgaaccattctttattaattccaccactgtgagttttagaataaaattaaaagggatttaggtcctatggattattcagatttttaaacacctgagcttgagcttctactactagaaattccgaatccaaagctcttgttgaatttgttactttatgcatctcacgtatctatataaagaaaatgtgctgtattttttacttttatgagtggagaaactcactgtcttcagtcctgctgttgcctttgctgagcatccggccatcactctctgttctcagggaactatgtgactggcaaagggaatgaaatgaaaggtagacctcattttctttctttcttttttctttttcttttttttttttttttttttttttttgagacagagtctcactctgactccaagctggagtgcagtggtgcaatcttggctcactgcaacctccacctcctgggttcaagcgattctcctgcctcagcctcccaagtagctgggactacaggcatgcgccaccacacccaactaatttttgtatttttagtagagacggagtttcaccatgttggccaggatggtcttgatcccttgacctcatgatacgcccacctcggcgtcctaaaatgctgggattacaggcgtgagccaccacgcccggctggtagacctcattttctagtggtgatccactctagaaaaccctcgtttattagttttgtttgtcattactgtactgcagcccctcaccactcttttctctttagcaaattgtgtccttagtagtgagaacatgatatggaggtttcatgcagagctgaggctgacattggacccctgggagagttgccattggtggatgatggtttgggcagggctccccatggatgccagagagccgccgatcggctcaggaaatagaccagggcaccctctggaatgcagcttctgtaacaacttgacacggtgcagcctcagccactaagaaaggaaggggcttgtgctgggcacttggagtttatttctgattgcatttgctcatctcctgatgagagattttagtctaaaaaccgtctccagagcctcaagctctcttggctcagtggtctgtttccatgcactgagagaggtgtctgcaggagagcatcgtgcttgaccttccacgctctcgtgtccactagcaggcaggttttctgacacaggctgcggaattcaggacagtgcatcatggagaaacatacatcttgggggccattctaaagaacagacatctgggtcctcctcacagcttattctattactggaatggaattggcttcacctttcagtccctgtacccccaaacacctgtgctccctgccatactctagaatcccaactgttaaaatagatgggtaagtcattccctcttttttttcatttcatcctgttcttattgtcaagtgacaattcttattctttttttttttttttttttttttttagaaaaggtctcactctgttgcccaggctggagtgcagcagtagcacaatctcactgcagccttgacttcctgggctcgagcgttcctcctgcctcagccttctgagtagttgggacttaacagatgcacgccactatgcctggctaatttttgaattttttggaagagatggggtttcacaatgttgcccaggctggtctggaactcctggtgttaagcgatccacccgtcttggcctcccaaagtgctgggactacacgtgtgagccaccgggcctggcagactattcctattcattggactaaatgtaaatatatctccccaaaccctagctactatgtacactagctaaaaactcaaaggtgtgtgagattttaaatgcaaaatttttccttgagcctgtgtccttgcagattttgtacctgtacctatctgcagaacggtcattagcagtttttccaaacaagcgacttttagcaaattaaccgttaattttaatgagattcaaaagttaatagccattcttaacgttttataattagaagctgttatataattagagctggacacccacatggagaaactaatttgactgtgctgcatttgacttcactttggtaacaggaagcactttttagtctgtagacccttgggagttgtagggagttaaagctgatcattatatactattatatacttagggatacaacccaagggcaacccctggcctttatgaaaacctggagtgagttattatttcctggtaatacaattctctgccagccagttgctgcatcaaaacagttctgatacacacacctaaagtcaccacttcctcattctggtccccaataaccctataagcctctccccttgtaggtgacctctgccctgtgaagggttggctcaccccaagattccataaaataagttgtctgtttgtttatgagaacaaggctttttaagtaccatatgtaatacatgcatataaatgcatgtatttagatcagatttctggaggagggattgtaagtttgatgactaaaggaggcaggggagaggggagagatggaggaggaagagaggtaagaaggagggggagagagtgcgagagaacaggatcatgtaggcaagagagcacgtgtacccggaacaatggttagaaactaacaaggtgaaatttaatgaagtcttgaatttagatggaaaaaaaatcagtgcacaagttcaagattgtggaaacctgatttaacagcagttcgtgggaaacagacctaagggttttagttgacagcaagttctttatatgactgccaaagtgattagtccaatcttgggggacattaatgaaagtgagttgccaatagcataggtaggcaatggtccccctgcgtcctgcagtggtcagattacatctggatatctctttctaatagggccactgacaaatgtgtccagagaagagtccaccttcccatctgccctgctttcttgacctttccaggttgttttgttgtgttttggtaacttctctctctcttaacccatgtatgcccgaggttgcaattttttgaatttttgcaatcagaccttggtgctgtccttgagcagtagaatataaataactcccacttgcttagcattccaataatggaacactaggcataaatgggctaatagaaactgggaccatttttggagtcacttccactttctgtggtgtttagactctcgcaccagtctgctctcattatcatatcgtgagtttcccagagacagagctggagcttggctcagcttggcaaacagagccctgatgttattagtttggcttctgggttgctgatgattgtactggaagggaaaagaggagaaacaggtcatgagccaaatgaggagtcccacagatgccacttcacaggcaccctatgtcataggaaggatattcaaatgtccagcacctaacgggtacaaaaagtagttagaaaaaatgaataagacctgctttgtgttagcacaacagggcgactatagtctaataatcgtgcattttaaaataactaaaagtataatcaattgtttgtgacacaaagaataaatacttaaggggatggataccccattctccatgacatgattattacgcattgcatgcctgtatcaaaacatctcagataccccataaatacgtacacttgctatgtacccacagaaattaaaaatttaaaaaaaaaagacaacaaatggcaagcaccctagatcatggctgtcatacccagaagaggattttagcaatttcgtaaggattttttccagacacggcactgtgaatttggtgttaagctcttctgtaagtctggtaaggatgattgcagcgatagcattactttagtagaagctttaagagatgagtagataccttgctctagtcattttcatatctccttcactgcaactggaatatccaacaatttcaagtgacctagaaaatcatttttgaatgaatgttctgctattttctgtgtttgcttaaagtgtcaccaaactatagcagtgctgtttgaaatagccaatctgcaaactgtttatcagcacacaactatgagacactcgcacccaaatgcaaattgtgtttggtttccttcattgagaaaatcaagctgtgaagaaaacgtcagctgaactacacagcaggcttagcgatgttgttaatttcccttctggtgacagccttttgtctaatcatgcagagggacaccaatcagtggaacgcactgtgagcagcacttgtttatacgacaaagctctttctgctttgtctgggattggggttcttgtatgtggtcttgagtcaggctgctcataaatatcattaaacagtaaatgggaatcgtgataagtgagcagaaaatcatcggccacttgtggagcgtcgtgaactgagtccacagccccgcgaatggctgattctagtctagtctcatgatgaaagctgtcaagtccccgattaccttattctaggagtgatggttccaatcaggagatgaggggatgccaatccagcctcgcaccttcctcagattccagcattttctgacaattgtgctttctgcacatacctcctccctccctcctttctgggctgcggttacagcattcaggccttcactgagattagctcaaagggagactggaagaaattggttatctcacatgtttatcctgcttctgcccccagaaaatgctacattttcagtactcaagaagtccttactctgtaacccaacgatgacatattttttaaatgaggtataatttacatcaaatacacagattttaaggatgcagcttggtgagtttgggtaaatgtataatcatcatcccagtcaggataggaaacatttccatcatcccttgtgcctctgtccaccagaattgattcttgaccgcatgtgcaaagactggtatagcctcacagtaagtatcctgtgttcaactcattatgttgtataaagcaaatctcccactgttaatttcttaaccaaaccttatttatcaaaaataattaagcgtaacatttaggaagacttcatgaaataatgtcacacaagattaaaagacatgaagagaaaataaaagaggaaaataaccaccataattcagatgtgatctctctttttgttcatgttttttaaaaaatctcacctgctattttactgtctctccaaaacaatgccctgtgggcccctgaagtaaattttgtactttgatggaatgaaatattttaaaatctcagttgagcatcgctttgccaacccctcagtattatgatcaggctgcgctgctccaaggtggaaagctcagtccacaaccttccactgcctgactcctttgatttgatattgttcattggagaaacaaaggaagaaggtagttaggttctgcagaattcataggtaatcgggtaactcttctgacggtggaaacggcactagagagagatccacatccagtcagggttgtggctgtgaccaggaagttcttggtgtcttccttgcttaaccttagagtccatgaacactggcatcccaacctcattcttacccattcaagccaaggaagcagccattttccagaatgtggaagcttgtcactctggaaggctggaaggaaggtgcatgctggggggtcctgctgcactgggtccaagccccatccttctgttaccagtcgtgtgatcgtgagcagttaatgtcctttttcccttgcacctcaccatctgcatctataaaatggagacgagaagacctcttagagttgctgtggagattatcattcatcagttaatcattccatgagcatctgagacctactgttcaccacacatagttccgagtgccgaggagatgaatgtgaacgaagtctctctctctccagaggctgtcacatcctagcgaagagagagggctgtagcagaaggggcaggtggtagggatgatgttagtgagaccacagatcggggagggccttagaaccaccgcaagggctttggggtttgccctacttgatatgttgagccctaggagggtttgaacaagaggaatgactcatctgccttacatttcaaagcattatgctggctgctaagcggaagatagactttagtggggccaggatgaaaacaggtagaataatgaggaggtcatcttggtaacgcacgtgagaggcggtggtggcttgaactagaatgatggcagcacaggtggtagaaagaggttatattttgaaggtacccaagagaacttgctgatgaggtaggggtggggtttgaaagaaacagaggagtaaaaagcgagtctcaattttttggccaaggcaactcgaagcagggatttggcatagggaagactccagtacaagttgggacagagggaagttaagagttcattttctgggcatgtaaatttaagacgtctattaaatatccaagttgaaatgtcaagagcaccctggggctgtgtatcgtgggggtgaggaggagaactcagctaagaagtctgatgggggagatgggagacagaagaggggagtgtcgaaagtgtagatgctgctgcacaactcagaagtggctgcattctgtgagatcattgctacacagcgcccaggacagcgtgttcactgttggtgtctgatttaggcgtctcctcatccctctctcattttcatttcagatggcagataacctcacccaaatacatgtcatagccaacctcagggatcctgaaacccttacttggagaaatgcttttctagatcactcctgctttaaatgtactaaagacaaagtcaggccctcctggtgaggctggactcaccctgctgaaaatcgcatgacttctgaattgggtctccataagtattatgtcttcaaagcataaaaagagaaattcataaactttcattgctgtgttgactgtgaagaaggaaaaagataagaaaagcatttaaaaggcttattatgtcctaggcatgatgccttcacatactttgtttgtttatttatttatttatttatttatttatttattagaggccgagtctcactctgtctcccaggctggagtgcagtggtgcaatcatagctcactgcagcctcaaactcctgggctcaaaggatcctactgcctcagcctcctgagtagctaggtctacagacacatgccaccatgcttcactaactttttaattttttaaatacagacagagtcttgctatgttgctcaggctggctcgaactcctggcctcaagggatcctcctgcctcagcctccaaaagggctgggattacaagaggcgtgagccaccacacctggcctctttgtttcttattacatacatttgtatttattttacagatgttcctcaacttagaatggggtcgcatcccaataaatccatcataagttgaaaatattgcaagtcagaaaaacaaaggaaacattaagtcaaaaattcacttaatacacccaacctaccttagatatgctcagaacactcacattagcttggatttggacaaaaccatctggccatgcagcacactatggagatgggtcgttcccctcatggttgtatggctggtggcgatctgggagcggcggctcactgcctctgcgagcatcgcaggggagcatcgcaccacacaccaccggcccaggagaagaacagaattcacaattccaagcacaggctctcctgaatgcctatcacttccacaacatcttaaagtcaataaatcttacattgaaccattttaagtcggagactgtctatatactcagactttgagtattcaccaccctggtggtagtcctttggtttttggctggtttcatatttcaggtgtaataagcaaatggagcccagtaagtcccctgtgtctgtgtgggatttccattttataaatgctgagccaacattcttacacaagcccttgatggagtttgacggtgatattgatcaaattttattcttgtcagttaaggtcatgttcgaaaagttgtattgcacttcttttacaaagccctctgttatacagaaagcattcagcctaaacataaccctgtgaaggcggcagattcgttataggaacttgatgtcatttccaacagcaggcgtctgctggcccctcttgccctctgcacactggactgagttgcactgccttcgttcctggctgcaggcgatgcgccaaactcttcccatcaaataaaagttgatgaattggaccctttatatttggaaatgaaatgactttacatacatcttaactttttatttgctgtgggcaaaattgatgtgatgcagaggatggggaggtggggtgatagttttaggagtagcaaggctgaaggatcttactggagaaacagatcagtccaagcctagaccgagatagaggtcagtggttacagcaagacgtacaatagcggtgccaggtacctgcctgtcccctccaaccaaaactcaaaccaaaatgattttagaaaattaagttgattataacttttattttcttttagaaatttctttttgagctgcaatgtgtttccagcctggtgttgaaaaattcttgcagataggctcataaagttttgagctggtaaacattgtaactagcctgtagaatttcctttttttctttctacattgtaagaggagacagggcagtaatctgagtgttcctcctttgacttgctttatgttgttaaaacaaggttgtccttacccatgatgtttctctaaaataccttcagcctggtataattactcgttcatattctgcttggcatcatactcagtcgtgtgttgaggaatgaatgtgtggactatatattacctagcctacctgcggtttaaggtttttaatggctatgttgatttatgattcattttcgtcgttccttagctcattacttgcacttactaggagctcaataaatatcagcagaatggacctgaattagtacttgtaactcttgtgttggtcacattattcagtgataattttaaaaggaaaatgtgtaatagcaactaaaaatgtgatcccattgacttattttattttatttttatttattttaattatcttctttatttgaaatgtgttgttttacatagatgctatttttatattaggctatttaccaacgtgccactgcaaaacttatggaaattaaattaccttttacttttagtcagctgcttacaagagaattgcctggtatttgtgggcagagtgtgactataatagactccgttcttttttttttttttttttttgtgacagagtcgtgctgttatcgcccgggctggagtgcagtggcatgatctcggctcactgcaacctccacctcccaggttccagcaactctcctgcctcagcttcccgagtagctggaattactggtgcccactaccacacccggctaattttttgtatttttagtagagatggggtttcaccatgttggccaggctggtcttggactcctaacctcaggtgatccacccaccccggcctcccaaagtgctgggattacaggcgtgagccactgcacccggccaacagactcctttctaataatttaaaattacttgggaaaacacatgatttgatggccttagatacatttatttttacctcttgattttagtagtgagccacatgtcctggaaactccatgaagtgaatatgaactctatagcaaaatgtgcttatacattttcaaaagacagaattattctttttttccctataatattcctgtttgtttatttttttaagttttaatttaggttcaggggtacatgtgcagatttgttatgtaggtaaattgtcacaaggctttggtgtattaaatattttgtcacccaggtaataagcacagcagcccacaggttgtgtttccatccccgccctcctgcctctctcctccctcaagtgggccctcatgtctgctgctccctctttgtgaccatgtgtactccatgtttaactcccacttataagtgaggattattcttaataaaaatcagcctttaggttttaagttatggtaaagtctgtgtatatgttgacgttttaatagagattatctggttttgttttttgtacacaatagtacagggaaacccaaacatgagtggtttctccagaaagattccgaaggggacacaccttcacttatcaactggccttccaggtacccgcacgccggccctctggggcttgtgtgcatgagtgttgcttcctcctgcctgaccacacatcagctaacacccactctcctcttgccttctttaataccagtgcacttgaaaatcacgtggaagttactttctaatcatttgcttttcccctccacatgccctaatccatgctaatagtatctctccttccccctctttttcaatctttgtcaatctttcttgattgacaaaccttttacttgaccttttgcttttcccttctcaccaactcacataggactggccagtgaggggcagtagtgagcacccagccaggccctgggctcctttccatagctggactcgctagccggcgtcccatctgctcagcttcccactgctcccagcccttccagcctccttgctttcatatctcctcatctctaaaccagtagttaattttcaacagttaaatttagggcatgtggttttaaaagcaaacaaaaccccctatcatttcatttttaagactgggggcagggagaggcggaaggagtcagaatgagtaagtcatggaaggacaaagctccacacacagagtttctgacagtcactttgttcttggctgaggacaacattcagattgtctctgatcaggagcacgcattccacaggagaactggaaccgcgcttcagtctccttttgattaacaaacgttttaagtatgaaaacctccaacactggctcatctctgggaaaaataacaactaagaatgttttctttccctgagttgttcatagttaccacctctatgtgcgtctgtgtggattgtcctttaatgacacatatatagatacactgcctcgtacgttaaaaaaaatatataggagtttttatcaaatttagcagggtgcacttgtcattaaataaactattcttttccatacagtgcacatcataaataattacttttgccaattaagcttaagtaaacagtctaaattcctctccccgcaagaaatcccttttcccactccaaaagccctctttgctttttaaagctgagccctaatcagttttccattctcaagtagttggaattgtgtctcctttcccactacatggtacttcaaaaaccaaaaataagaactagataacactattaaacatttactctttgctaagcactaagccacgtgctttgcaaatatcacattacattatgtcactattatttccatttaaaaggtaaagcaactgaggcttactaagggcaggtgagttgcccaacactacacagctcaacctgactgagccaggatctgagcagaggtctcttccaaccccacagccagagctcttggtttctttgttttgcagtaatggaaaaaggtctgtagcttttgaaaaggatgtcagttttgctctcagatatttgaataactttagaaacaactggagcaatctctctttatttttattttatttttgttttttagggacagagcctctctctgttgcctatgctggagtgtagctgtacaatcatagctcactgcagcctcaaactcctggattcaagtgggcctcctgcctcagcctcctaagtagctgggactacaggcacacgccactgcacctagatattgttttttacttttgtagagacaagatctcactatgttgcccaaactggtctcaaactcctggcctcaaatgatcctcctgcccaggcctcccaaaaggttgtgatcacaggcatgagccccagggcccggcctctcttttgggattcatttttaactaagagcataacagcaggacagggggatggtggtgggaaatgttcacttcattagttctgtcagcaactatcttttctctaacattcttttggtgctagaattattcataatgatgcccagactggccacatgccttctgaatgaatgaatatactctgcattgcatgaaaaagcttgtgaatgtctagttgagtgctttaaaagagaggtgattgttgtatcttgaactaaataaaaagcataaataatcgtgagtgctcttacattttcagacgacaatgaaattacagcgtttggtcaataggtgtctgtatgccaggaaccttcccccacagtccgtgttctgggcgtgtacatgaggaaagcttactgattcaagggaccaggctcattatgccctaatgcatgctggtggtggatattaacgcatttttctgtggcttctgggtatttatttagtcagaagggacccattctcccccaggatagcatctgacccctgccagcttttacaggggtagagttagttttgcacctcctgggcatacatatgcaaattggaaactcaactcaggatcatctgacaagtagttgacattagacaccaaaatgctttttcacaagttattctctctcaggtcagtttccattcactggtaatctgtgatctacgcatgctttcctcctgtgaggccgttactgcactttgcaacttaaatcctttttctttcttaaagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctagtgacgccagaaaccccagaaaatgcatctgagtgtagctgggtagcatcagccacccagaatgtccccaaacctcccagcttgacggttctagaaggtgacggaagggatagcccagttctccatgtctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaagtctctgtcgcccagctccgaagtgcgttcctggcatctgccaacgcctgcaggagacctgaactgtaggtgatgcttcacacgccctccagctgtgtcacttgcacgtccctggcagaatgattcactcctcgacctgtgttgtgttctgcattgaatcatattagcttagctcacaagtgcgtgcagggcgactatgcggaaaatggctcaaaaactaccactctgcttctgcctactaatggggaactagtggattgggtgtctggaatgtctccttccttacgtgcatggtagaggcatgaagaggggtttggtggtgtctgtcccttgactcacggagatgcataatcctttgccatcttctctttctctgtcttcgtttgccttccttatactctctgccctttgattctcaaagcaaatcacgggtggagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtaggcatgcgtatgcgcagtttcctcatccaggaacgtggcaatgacacaggagttttaccacactgacggtcttgacgctatttatataggatgttggcgattccataattgttccatctaacctataagcgttatttatttggcttatttaaaagtctttttaaagaatattagcctttacagcggtattatgatacatacacaattttacattgcattcagatgataagaagtaagaaacattatttttctttatttaatggttttaatgttttttaccccttgttaaattagactccagattgcatattcaccagattttacagtgaaaataactgaggaattttatattcattttataaatgtccatctacttgttgtatttgagttttatactgaagtgtcatatactattgcatagaaatggtaagatttgtctggaaaattgtcatcagtggtgtttaacaagttgttcttgtgcctggtctctctccacggggtgtgtacttggctgggattgtgtgcacacacgctccacagtgttgcttcacaactgtatgtgtgttttcacaactagaattgctaccaggaggttatttcttaaaagaatttaattgcatttttatttttactttcagtatgatgttttatttcgatcttctgctcccacctgctaatgtattattgttatttgctaatgtctttcctaggtgcacttcacattcagaaacgccaactgtcgatggcaagtacctgtttcccttttttttcttctttattatctcatctagactggatttaataataaggtttttggctttttgagagagtaagatgatggagcataacagtgtctccctttgctgcaggttttcgttctgtggatatgataaaatctagttgaaattttcagacaagctttcccttctttttgagagcagttagagaatcatacagtgaccaatgtaaaaacaactaattcaaaccaaaggagcaggttcttcttgttgttgctgctgctactatttaaaactaaaagaaattccccccataaaatatattcatgaaatctcgatcagacaaacgttagagtagaaatccctggacagagtttgctttggtttggctgggttgaattgcaagggaaattagtaccttttcactgagcagaaagaatgggctccctgcaaggggaaactaccaccaattattattttagtgcacctattgttgtattcaaagatttccaggtcagccctgaaagactttttggagaccgaacttaaccttctctaatgatgtccagtttttaatttgtggctttttgcagatgaagaaaaggtggatgaacgagccaagctgagcgtcgccgccaagaggttgcttttcagggtaagctgtgctgacgtgcttgaatagagatccctactgggtgcagtaatcccagctatttgagaggccaaggcaggagaatcacttgaggccaggagtttgagaccagcctgggcaacacagtgagacccccatctcaaaaaaaataaaaattgtaagccttagggagggggaatcttgtggacccagcctacttcatgcacctctgggcatgctaaggccctcctgcctctggcccacctgttgttctcttcctaatctttggctggttgtggccacctcatggacacagcatgagtgtacacttctgacaacaatacgaggtgctcattagtgacccctcctgtaggtcctgtaggagaacaaagtgaagaatttttactacccccatttcctttccttgaatttctttgttatttttaatttttttttagagatagggtctcactctctcactcagggttgagtgcagcaatgtgatcatagctcactgcagcctcaacttcccaggctcaagtgatgttcccacctcagcctcccaagtagctgggactacaggcctgtgccagcatgcctggctaatttatgcattttttgtagagatgagggggtctcactttgttgcccaggctggtcttgaactcttggcctccagcaatcttccctccttagcctcccaaagtgctgggattacaggcgtgagccaccgtgcccagctctttccttgaatttataagggttccacaatacttctaatcttaggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacgtaagtgcccacaggacttctcagccttgtctatagtgtctttttttaaaaaaatacatttaaagagtgttcaatgaaaatgaggcattggggaggtgatttagctagaagccacagagaagttagtactaagggattttgtttactgtggtctctctaaactttgtaatgggatgtgtatcttctagaaaaacttgaaaggagtttttgttctattttgtttctgtctctgcatattgatattttaaaaatctctttgacaacggaaaatagaaacatgaaacttggtggattgctgtgatgaaaccccagcttccacggtcacccgctcctggccggtgatgctcagcccgtgtgccattcatttcccctttcctcctgtgctattttcaagcaaacactagaggtcttaccatttcatccataaatatcccagtacgcccctctaaaagataaggtttgttttgttcttaattgccagaaatctcttttctttttttctttttttttttttttttttttttttttgagagagagtcttgctctgtcacccagaatggagtgcagtggcatgatctcggctcactgcaacctccgcctcctgggttcaagcgattctcctgcctccacctcccgagtagttgggattacaggcatgtgccaccacactcagctaatttttgtatttttagtagagacggggtttcaccatgttggccaggctggtctcaaactcctgacctcaggtgatccatgcctcagcctcccaaagtgctgggattaattgccagaaatttctaaaaattaaattgcagtttgataactttccaaacaataggaagtttgttttgaataatatgtttcaatatattcagaattaatttcccagagtagttcattcagagatcattgcttcaatcaagtgaaaaattttcttatttttgcggggggcattgtttgtttttttgaggcagtgtctcactctgttactcaggctggaatgcagtgcgccatcttggctcattacagcctcaacctcctgggctcaattgaccctccaacctcagcctcccaagtagttgggactgtaggcccaaccaccacacctggctaatttttgtattttttgtggtgatggggttttgccatgttgcccagtctgatcttaaactcctgggctcaagcgatcctcccacctcagcctcccaaagtgctggagctacaggcgtgagccactgtacccagcctagttttgttgttgttgatgttgttaattggttttgtgcttaccttggacacacagacacccttcctggaaaaaaaaatagttcatcccattaggttattgacatcccaaaaggcctctatgtcagtgccccgttctgtagacctgctgttagatcagctgcctacagttcctccccgagttgttcctcagtttcttggtgcatttgtagctaagtatatccttgcactcattaggaactctttgcaaatcagtttgttttttaaaaaaagaaatatttgaatggctggtgtaaaataacaggcagatacccatgggagcaaaacagtaaatataagaaaaattaatcccattttaaggctcaataaatctaccttgatgtgcctatagattgtataagaacactgatacttttaaaaagtagattgaggccgggtgcagtggctcacacctgtaatcccagcacttagggaggcagaggtgggtggatcacctgaagtcaggagttcaagaccagcctggccaacatggtgaaaccccgtccctactaaaaaatacaaaaatattggccaggcatggtggcgcacgcctgtaatcccagctactcgggaggctgaggcaggagaaatgcttaaacccaggaggtggaggctgcagtgagccgagatcgcgccactgcattccagcctgggcgacagagtgagactctgtcaaaaaaaaaaaaaaaaaaaaaggctgggcccagtggcttacacctgtaatcccagcactttgggaggctgaggcaggtggatcacgaggtcaagagatcaagaccatcctggccaacatggtgaaacctcatctctaataaaaatacaaaaattaactgggcgtggtggtgcgcgcctgtaatcccagctactcaggaggctgaggcaggagaatcacttgaccccgggaggcggagtttgcagtgagccaagatcatgccactgcactccagcctggtgacagagacagactccatctccaaaaaagaaaaagaaagaaaaaaattagattggaaacaatattctaaaacacagacataatctactgattttttgatagctaatatttgcttttttgaattattattttttttacaccaagacatgtattctcaagacagagtaaatcctcccagctctgaacacctattcttaccccatttgctttgggtagccactatctcttatttcctgagtttgtatttgcttttgaagttctttcgtgattttttctccccaaaaataattagcaaaatattctgttaaaatttttgatttaacgtttctgaatttaaaactatgctgtccttaatgcttcttttcttctctctccttatgaatgtttcctctttggcaattgcttttaaagtgaacctatccccgcttcgtgttctgggggcacccaccctgtaatggcgagacttcctagccccactgtagctaggagcgctgtgcagcctgccaggtactggacagatacagatgcatgcggcacccggtgcaaaggtgccgaacagcagatgcatcctaaagtcttgaatgtctgtcgtttgtttgacaaacaagtcaatgccgtgagttgttccagaatgcgtggcattttgttttgtcatagcacaaggtgctgataaccacatgctggcgtgcgtgggaaaacattttgtctctctgcatatgttatgtgttagaactaggatcacactaactcacgtatccagttgctttgtttgtttttcataataatggtcatccctcaaaaattttgttcttcatctaaatactgttatagcacttaataaagattaatagaaaaatgggacattggccaggcgcggtggctcatgcctgtaatcccagcactttgagaggccaaggcaggtggatcacgaggtcaggagattgagaccgtcctggccaacatggtgaaaccctgtctctactaaaaatacaaaaattagctgggcatggtggcatgtgccagtaatcctagctacttgggagactgaggcaggagaatcgcttgaacctgggaggcagaggttgcagtgagtcaagatcgtgccactgcactcccgcctggtgacagagcaagactctgtctcaaaaaaaaaaaaaaaaaagaaagagaaaaaaagaaagaaaaaaaaagaaaaatgagacattaacctgaatgttgaaatgctgataagacccagtctttttcaaacacctgtagacacaaatacagactgaaaacaatcctccctctttctaatttatagagtcaatgccattatattttgggactgggaaaataacaatttgtagtgtctaaacgtagatgttttactgtcgtgtttcagattgtggtgctttaaaattatgtcctcacatcaggtcatatcccttcattttactgttatatgagccaaaccgcaaaagctaaaaataatggcagtgccgggataaagctggtacacccacagcagggccctcccggagaagtgggtttccctgccctcctggttactgcacgaggtccacggaggactctgaggctcaggtggcttttttgtcactggcctcattatacacctggaatatggaagctggctactctttggcctgggatagcctgtgcattggggattcactagaatcaaggcagaatatctcctttactagatctgacaattggatcggtcagggacagaagatatagtgcattacaaacccctagagattcatattgaccgtgaagacttcaggctttccttctcttctagctggaagttggagggagctatttatttatttactgatttatgtattcattcatttatttttgagacagagtcttgctctgtcgcccaggcttcatcactgcacactgcagcctcaacctcacaggctcaagcgatcctcccacctcagcctcctgagtagctgggatcacaggtgcacaccaccaagcctggctaatttttatattttttgtagagatggggtttcacgatgttgcccaggctagtctccaactcctaaattcaagtgatcctcttgccttggccttccatagatatgagccaccggacctggccagttggagggatttataatcacctgaaattttctttactcctctggttactggaaattgcagatttaagtaccttttagaaaactggtaggaacctatgagagtaaatgctaagctgaagcagtgactctttaaaaattaagccatttgtctttagcaagtaaaaatcaagaccttctgttatgttgttgacagaggactatatcgtttcctaattatttaaaatgaaagaccaccttctgaaccatatctttagataaggtctaaatacaccgtaggtaatactttgtgactccctttcattctacttattacgatactaacaatgccgcctctctgtctaagataaggtatagccaagctgacttcaatgtcttaaacaggaaattcgttttgtagaaataattcggagctcaaagtctgctctttgtagaagtgatgatgctaagtgtcctgtgccgactctgcttgttgagtagctgaacagctgcctgcctctgtcctagacgtgcttagggaaaaagaagccctttgcaaaatgatgtgacacttggcagaaagttaacgtagaaacttagcggtgtgcttttgtttgttggtatatgtgttgctgacattttatttttttcagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgggtgtgctatagtccgattgcagtttgtgtgtgtgtgttcttaaattatagcactgcagtattcctctgaggtcaatgatgtaattaaggtgctctaccaggaaactgctacctgtaggtgatttggtaatagctttcttcctaaaaatgagaattctaccaagtatgttgctctttttttgttttcataccttgcttgctgaaatatctagaatgagtccattttggagagaaaaaaatagtatgcccaactgtgtttcacccagaggattttgtttaatgagacgtattatataactatgtccaggaatggttttccactaagagaaacagtgaaactgcatcaaatcgagtatttcagcttctgtcaattcataaaccaggatttatatagatgatatttttcaagcagctttttaatttttaactgtgtccttccaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagaggtaagtgaccagtgcccctaaagctttagaaagccactgggttttagtttctgcttgatttgtcctgtgtctatgatggcttttaacaaagttctataggcagtttacagctagtattggttaaaagttcagcgggaatcctattcttccctggatctgactagaggatacatcaagttttcagcaataaaactactggaagagctttcacacatcttcatggagtttctgttgactttggtcactcacacaatggccttctgagctgcttagttctggtggccccttttagaaattgatgaccccaaaggtccaggctgggtaagcacaaggaattcaggaaagacttgaccccagtctctgaatcgctagagtgcttcttcctgcatgcctgttttgcaggctagcaagctacactgcgtgggcccttcatcctctttctacgtttgtatgaaacagtacagtgtaagttataataggggtttgcgtttgtgagtatagcacatttgaatgttaaggtattattttggagaatagaaccattctggagtaaatagttaaagctgacttcctgtgtctcgcacacaggagagaaaccaattgccacgaagcattttgctgtgtgggtaaccctccaggaagtttggttttctcacagagtgtagcgtgctgcagatttgcataaatcccagtggattgggtcacccgccgtgtgcccacggattgaaccctgagagctgcactgttgagggcgaatcgctggaagaatgtttgcctgaggagttcagtgctgatgttgctcttttccttcccagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaaggtaatgagattcggtgagcgaaaagtaattctctcggggaggagcttacagcttgcttttagaaaacaatctcggtgatgggcaaagagatgaaatcatacattcagcttctaacaggactgtgctgttgtcctggagtaattctaggaagctgaggtgtttgagagtgaactgcctttgctcatgagcctggtttggtaatgagcctggtttggacagggctggttccagactcagatgagaaaacaaacagaaacagacttctgttttatttatttgtttccactgtcccaatatcttttataatattaaattcttggactatctaatgacaggagctgaaatcttggctcttccccttttagatacacagggttcatactgaatgcacaaaccacttgtgactttgtgtaaaatatgtgtagagggagtgaagataaatttacatagagggcatatatctttggacttagaatccaagttttgtttcttttacagattgtaaaatggatgacttttctgaactgcatttagaaattgtatgtcaggtaatagcttgaaagattgcatttcagcatcaaataacacagtagcctaatttctttcaaaagaatgacgtagggtgcagaggaatatatttaaattagacagatacagagaactggaagtaaattaccttggggatgtgttttccttgttaacccttaaccacagatgaattaagcagcaaaagatgcaatagtgggaataaattcagagtttgatagcagagtagggtgactaaataaaaacgtattgtactgaggtgatggacattctaaatagaggcttgatcactatgcattttatatgtgtaacaaaatttctcatgcaccacataaatttgtacaaaaaaaggagaaagtattcagtaggaaaaaaacatgatggaatagttgataggaaaactgggtgaagaaaaatcttgtcaactccatattaggagaaccatttccatcgcctgttcccacagttctgccaacctccacccttcctcagcacctcccaccacacggaagtctgcaggcttcactgaccactcttatttttctagatacatttcaaactgcctaagactatactaaaccacaatgaaaagtcttctttctttcttttccttctttccttttttttttttttttctttttgagactaagtcttgctttgtcacccaggctggagtgcaatgggatgatcttggcttactgcaacctctgcctcccgggttcaagcgattctcctgcctcagcctcccaagtggctgggactacagacgcacaccaccacacccagctaattttttgtatttttagtagagttggggcttcaccgtgttagctaggatgatctcgatctcctgacctcctgatccgcctgcctcggcctcccaaagtgctgggattacaggcgtgagccaccgtgcctggccccttctttctttttttttttttttagaggaatggtcttcctctgttgcccagactagagtgcaatggtgctgtcacagcttcactgcagcctcgaactcctggacacaagtgatcctcctgcctcggcctccccagtagctgggactgcagacacgtaccaccatgcctggctaattttttcaaaaagattttttgtagagttgggaggtctcaccatgttgcccaggctggtctcgaactcctggcctcaaacagtcctcccacctcagccttccaaagtgcggggattacagacatgcaccaccacacctggcccttctttctagttttaagccaagcttcttgaacattatttgtaaaataatagatgctatctttttcaactgacaaattaatcacattgttaaatctgacttactttctcctttacttacttaaaattcgtgataagttagacctggcaggctgaggggcatagggaaggggcagaggggacagtgcaatgaggagagggatgtcttcaatcggggaagcagttgggcctattgaggcttgaagttctcttccacgaaaatggggctcaaagagagtttcatcccagaaacccaaatattgacaactggttaggtgaggaagaagagagatcatttaaggaaattaacaataaatatcacttatacacaagttctgatgttttacacatgagaaaatatccctggggtattccccagtgggaaatactaatattatgcccccttctttcaaaggcttttaaaggagccttcccatctttgggaatattctgtccatctggacttaggacttttgatgaagaagtcctgtgtctatccactaagcaataattcctgatttacttacctgttttttggtaaattttagttgacctgtatttttctgaaagctttaatcctactgtaaaattctcatttttaaaagtgagatactggaaagacgtagcttcttagcttgggctttgtggacatgtaaggcgttcaaggatggctgtaaagtttctgtgaacagcccggaagtgtattcagaattgaatgggtgagcacacacacctgctggctaacagaagccataacttatcatggtctccaagagatccctgagcccagtctgttcagaatcatgatagaaaggaatgcttgattgatattcagctattcagtttgttaaaatacatttatgaaagaacaagggacactttatttagcagctatgcttgtaataaattacactaatgcaaaatatattgccagtgatcttttcccccttaccttcacagtacttttatttgtactttgctgaaagtgactaaattacatatatttacaattcatccatgatagcttttccatgagactttaatccctcccttttgtgaaaatgaaataatgaagcttaaactatttaaaataagaatgttattcctccatttatttgggctttacttttccttcttgagaaagaaatatataaaatcataggacttccaaactttattctaaccgcctctgactgcctcattttaccaaaggagggattcggctccggtagcctccagggccacgtagtgaatagagctgacccaggggccacgtctccaactctcccctggtccatggtgagaccgcggtgcgctcagattagtgttagagcagccaaccccgtgtgctctaaccaggagaatacggtgagaggacagaaatcccagctagacagcagtgttagaaagacacaccttctttcttcatgaattttctcagttcacatgctcttaacagggctatatttcaaattacacatccaagttcacatttcagagtctcagaaatagagtctggaatttgcagatttccttcatcgttttttataaatgcctgtccccactaaggagggcaggtctgtcttcttcagccttgttgtgtcagtctctcccctgtccagggcctgactatattaagttctcagtgctcagtgctacccagcgtcacagactgccttccacattttgtacatgatctctcatttaatttttgtctgtttgtttgttttttgagatggagtctcgctctgtcacccaggctggagtgcagaggcacgatcgcggctcactacagcctccgcctcccaggttcaagtgattctcctgcctcaccctcctgagtagctgggatcacaggagcccaccaccataaccagctaatttttgcatttttagtagaggcggggcttcaccatgttggctacgctggtgtcgaatgcctgacctcaggtgatctgcctgcctcagcctcccaaagtgttgggattacaggcgtgagccactgcgcccggctttcatttaatattgaagacagcctccagaagaaagcaatattatccccatttgtagacaaaaagcatagaaactaagaaattataggaaaacctccatacactccttttttagaatatgtttgatgctcaaggaaacatattaaaaagttatttttatatttatttatttatttgtttattttctgagacaagagtctcactctgtagcccacgctggagtgcagtgacacgatcttggctcactgaagcctccccctcctgggttcaagcgattctcctgcctcagcctcccaagtagctggaattacaagcacttactaccatgcctggctaatttttgtatttttagtagagacaaggtttcaccatattggccaggctggtgtcaaactcctgacctccagtgatccacccgtctaggcctcccaacgtgctgggattgcagacgtgatcaccacacccagccttaaaaaaattttttttcatcttttctgacattgtgaatgtcaaatttgaaccataaccagcaaaaaacttaggatgcaatcgacttttcccaccggattagtaaaattgctattttctgactgtccaaatgatgtgtgtttaaattatccctgtttgggaacttctttgagaaacattgcgaattaaataattcttatgttatttagggataaaacctttgctattgcttaaagagtatgttaggcctttagaaatcttatttccacaatgtcagaaacagtggcatctgagctttcttatttagggaaaaagactattgaaaagaaaaaaagagccatcctttcactttggcaaattggtggcatgtaaggacttagtggaactccctgaactgttgcagaatccacctcacgcctctatggtgttctgccctagagggaccggctggaggctcctgtgtttcccgcctgccggcccccgccccaaccatccacccttcggtatcccacccagccagaggctgtctccctgtctccacaaactccaggttcttaccctgtagctgggagatttcagccactagagggccccagatttatgtaggaataagaatagagcggcagttcccctttactccctccttttctttttctttttctttttttcttttatttttctagacagggtcttggcactgttgtccaggctggagtgcagtggtgcgatcatagctcactgcagcctccacctcctgggactcaaatgatcctcccacttcagcctcccaagtagctgggactacaggcacacaccaccatgctcagctggctttttattttttatttttatttttttgtagagacggggtcttgctctgcggcccaggctggtctcccacctcctggcctcaagcgatcctcccacctcagccttccaaagtgctgggattacaggtgtgagccaccacgcctggccctccttttccaaagtgtgatttgtctctcatttaaaagacactttagttcattcacttctccaacttgtgaaccagccaaaaccaagatctaatataagtacttaagtgtgctgttcatccctatcagagatctatggggtgcctgtaattctctaaaatgaagggaaaattctgaaaaagagagagaaaacacatcttatttaatattaggggcacatggttgtcatgtctcctgtttgacccagccctgactgctctgagcctgatgtccttgttctcaacaagcagggttctcaggccagcattccctgctggaacagtgtgggctatggaagaggaggcaccgtttccccgggtgtcctggcaggcacctgtcacggtggccctgggccaggcgttgggtgagcaggccagtgtcgtgcctctctctgggttcacacagcccaggcctagccactgcccaggctcccagcatcacagtcctgcaaacagcactttggcttggcagttgttagaagcgctgacagttgtttgaattgcaccggcaggaatttatgtcctgcgtaggcccagacgtcggctcctcgaccctctcagagcctggtggtctgcggtgagccggagggctgtgagctcacaggaggaagggacacatttgggaagatctccctccctcctcagcgtggtggacaccaatgaggaaatctaaagggacaggaagaacacactcaagttttagtgcgtgttattttcgagttattcgtcatgtgctccgtaggctggagccgagggctggctccaagtgccaggtgggctccatggaagcacagtttcttccagattattctggttactctgtagtcttcggaagtccccaatggtaaccctgccagcacatgtagaagcaaaatttcagggttttggaatggaggaattctttggaggccatcccatggtgggaaaaaccttataagaaagccagaatcctatgcctttcctaaaacggtgtggcaaaaatgtgtccggtcagctaatgttctaccgaagtgaaacaagctacacacaggcaggcgagggctgcagtcacgtctctctgcccactaacatccagtgtgacctcagtcaatggaattcttgacccggatgtacccacgttccttgtccgtcagaatgggaataacaattcccagtgtcttaggggtcgccgtgcagatcagcagagtataagatggacgaggaggtgatctcagatgccacagcttgtgtttttctaagtcagttttagatgccacaaagcaaccaccagggaaatcgtccgatgacataggtgctggtgtccttgccccagacttttgggagcttctttttgagaaggtcttcaaagaccggagctcatgacttttaatgaactcaactcaggaagatgaatttgatcttttaaaaattcatcatttgaatccaatctgattaacaaggtggatgttcaggaggagtagctgccagcctgggtggaaggtgaagtgagagaagctggttctgaggccagtttacagggagaatatcagtgagatgagtgcttggttccacaagatcatgaactggaaggacttctcatttgggtattaaagtgctggcatgcttactttttgaaagtctcatttattgattgagctttgaaagctcaaatacagcatgcaaatatgaatttcttttaatgatttcattttgtgagattattttattaggataaaactgactcattcaaaataattggagaaaagatgaatcatagtcattatatagtatgaaatggtgtggattagagctcttgaaggaatttcgacttcgtgtccaagcccatgaactagctcttgtagcatgcagggtgttgttaaacattcgagaattacaggagttaggactaaatgagaccttgacccaaagggatctgcatgagattgacaaggcagccttaccccagttctagagattgagcacttgagatcttatctgctgccacttagcagaaagaggaaaacagaaatgaaggggggagaaggaagagattgaggaaggggacaggtccagagttcgaagctcctgcctcctttgggggattcctttcttcacggcttacttcccgttatttgactgagtgaatagacaaatacaaggtgtgattatgtacacatacgtagatgtcgccggattcttgtttaagtactacaaaatttgttttcttattagcataacaaaacttttatcatagaatatatctcatcccatctccaaaacaaatatttaatgggaatcgggaagcttggaagaaggacccttagagatcatctgaccagttcctgatgtgacagatataggagggagaaccgagatacccaaagggagtagccaaattgggaccaaagctgatgttctgcttaaaaatacactgttgtctaggcgcgctgtctcatgcctgtaatcccagcactttgggaggctgaggcaggggatcgcttgaggccaggagttcaaaactgccctgggcaacatagcaagcacctgtctctaccaaataaaaattttaaaaattagcctagtgtagtggtgcacaagtgtagtcctagctactctggaggctgacatggaagaattgcttgagcccgggagttcaaaaccagcctgagcagcatagcaagacctcgtctctacaaaataaaaattttaaaaattaaccaggcgcagtgatgcacacctgtcatcctagctactctggaggccgaggcaggattgtcgcttgagcccaggaattcgaggctgcagtgaaccgtgattgtgccgctgcactccagacctggtgacaaaggaagaccttgtctctaaaacaaatttataacaataaaaaatatttatggatttaatatttatggataaaaatatttatggatttaatatttatggatttaatatttatggataaaaatatttataccatttgtggattatgcattagtgatatcaataagacctggcccatcaggtccagcacagagggaaaaggatctaattatttggcttttccctactctttaaattgtttgagcatcggctcaaatgagtttagtgatcaccaccttttttttttttttttaccttttatctttcccatgtttgtttgtccagcgtaaatacctaagatttcttcattcatgcaatacagttagctgaaatagcctcaagtttgtgaaaaataacctttcaggattccagtattcaagcactgcctatcaagtcacatcatcattgagctaaagtaggttagttaacaatatcagttaattagattctttttttgtgtatatccttcccctgaggaaagttgaagtgataattttaaaaaatgggtttatagaaaatagtttctgtctaaagaagatggataagaatgatcaaattcatttgtaggaaaagaatagggcttagaacacctgaggagaaacagtcataaacatcaaattttacctctaattgaaagggatgatattaagagactgtaagtgcttcatggctttatgtttttgtttgtttgtttgttttttgagacagagtctcactgtgtcacccaggctggagtgcagtggcacaatctcggctcactgcaacctctgcctcccaggttcaagcgattcttgtgcctcagcctcccgctggctaatttttgtatttttagtagagatggggtttcaccgtattggccaggctggtctcgaactcctgacctcgtgatccacctgcctcagcttcccaaagtgctaggattacaggcggaagccaccgtgcctggccagctttatgtttttaagcccatgtctgcatcattttctgtaacacagctttagtcctttaatgttatttcacaagtgaccagaaggcgtcgctaaaagacatttttctctggggacggttctcttgctttcagcccaaggccaaggaacagacatccttggctggaatgatggtgcatcttttatctagcaagtcagatttcagctctgtgtttcaatcaactgtaaaatcttcgggccatcttagaaaagggactttattatttttccagacatgctgtcttccgaataaatgaaattcaaaatgttaaaacgaggcggctgtggtcatgtcttggcccaagccgcctctcttacctagattatggttccatcacaaggaagagtttggtgctgaactctttgtggcgggcatgttttcctcctagattggcactgttgaagaaaagcggggaggaagattggagaaacagactcagcaggaggcaggagggcggcaaggcgccggccagcagcctgcacacccaggaagcagggcggtccctcatcaagaaggtaacattccccatgttaggaaaagccttccgactaacatcactcttggaagtgcatcaaaaagacaagcgtgtgccacctaattcctactctgtgaagcatttgtgcatttttgcccttagggtacacactgagagtctgtcacagagcagctaaaattgggcagaaggctgtgcctggagatgttttaaaactgggatcagcaacacacacacactatgtcagcaagcaagtgcctgaattttaaagtgtggactttttcttcagtttaaaaaccttcttaaatgaagtctggctttcatgtgttattaaagcctttataatgaaaaaaattgaattcaccactaatatctttaagttccatgtaaaatacagacttgtgtttcccatgcagagattttaaacctaagtataaaaaataaggacataattgtggtttatgagtatttagttcatcatttaagcgtgtttcatgagtagctatgccttttattgagaatgtacagtaatgtataagttgaaacaaaattaggtaatgcatggtgatcaatactagcaagcatttcatatgcgaaagtattgatgaattgttaaatcacagatgtgatgatgaccagcttttgaccaggtagtgcacacttttgaaactgatggtgacttacttgctgactggccctacaattgcaaatgcaccttctggctggaggcgaaatgatgcaccggtgatgcactccctggtcactttctaggatcagaagtcttcaagtagaaaagaaaaagaatgctttcaacccgatgatccccaggccccttctagctctaaaataagttaagcatctgtgaaagggagagatgatgagtgtgactttcatgcattaagaaacgtacataaaaatgagatgtgcacatagaagtgtgagtcaggagttctgacactatttcctctgatacttctgtgtcttcttagattacactggaatggcaatttgaattctcttctttgagacatacatggtgttaaagataacataactaaagacatttaaccctcagccatttgtaaagttctcaaatataactagatatttagaaagtatacccatgcgcatatttttcacacaccgtgtgaaattcagatttcaaaaatgagatcctgaagtgaaagaaaatccatctgtcaaataatgtatccctgctacccacaaactttatttaaaagaatcttgaaatcattgcttcaaaaacgactttaacacattcctcattagcaaacctgccaactactatgtcctggcaccaagcagcgcctggccccttctccatcactttggaaggtgcagagactccccggcccatcaggaactgggagtcccagagagccagtggaaatttaaatgaagccaaaaagcacgaagcaaaagaggttcctggtgaatagtgaaatgggtgcactgcccccttagaagaatggaggatcaccttaggtgtggaagccagaaggctttgagtggaggatgagatccgaaccacctgaacgctggctaaggtttttagaaggcaagagaggccagttgactgcagttgcccttggggttgataatccagtgacctgaagccccgggacttgcaagcaggctagggctggaatgggaaatgctgcctctgggcgcgtggaggctgctgtttctgcagacggtgaactctcccactcttctcagtggcctgcttccctttggctggagacaataagctctttgaagctaaaataagcggatctattttaggcctttgtagcccacactgggcaatctcaggttctgttgaggtcaggtgtttctcagacggcctctgacgacccctcggttcgttccttcccgagggctggcactgttttcagtcacccgccggctgtgctcagatgtggtgggtgaggcgccttaaacctggtctgtcttgagggattcccccagtagctgaggaggcttgacatgcccactgcttgcggggtgtctgaatgctgccttggagaaggacagacagtcatgacacgtggggcctgaacaggggcgcttgctgcacggagtagctctagccttgctgacggagaggtacccaggagagcaggtgccggaaccttccatctttagcaccaaaggcagaaaggagccggcgttatggtcagctcatcacgcccttcacggttcctacgttccttttgtgtgctgagaggctgctgccgtgagtgtgcagtctgtggaaatgtagaagaggcaggaaagagaggggactctagaagttccttccattgctcctgtgaaaacacgtgcaacatagaagtcagcaccatcctgtaaaaatagaatgtgtgccacacaggtcattttgaaatttccttggagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccagcaggtgacagccagggtacgtgccttctgctctggaagggggcacctttgcactcttccttccttggcattagctccacacctcctgtgcttctcccccgctccccacccagcccagtgcctcgccataaacaggggtcttgcggtgcagggagggatggcttgaagacagaggaaaagcaaactctgccggccatcgtttgaggacctcctgccctggtatcgcccgcgaccaccacctacactcttctccccaatacacatcactcagtggcatgagccctgtcctctgcttccatcgctgctcctgtccctccctcctcagccccatctccccatcccaggcctgtcctgagcccctcctcctttcctgatgccctttgagtcccctgtagcttcttccccttcccctcctgccacatccccaaccgcaagcctaatgagcatcatcaatggcttggaaatggaagaagcagatctctccagaaatattccaattagaaactgctgagagcattttcagtagaaatgttaccgtgcatgtaggttttgtctacagcatagttcaccctcaacatcagatgtctcacagtttaaagccacttctgtgggctctcctggttgtctacctgcccgcagaacatcagtggctgcaggaaaaagcaagcagagtgccagaaaaccttctcctgccccttattcctaaccagccttccctgtctctaactgggcaagttccttgtgtgctcacatggataaagttttctagatcaatcatgttctttgtgagtatatagggataaaaatctcccagttaactgagtttaactagatgggttaagacagagaaactttaaaaccctgtagagtccagggcatgaaaacaatctatttttaattgtttgtgcttacaaaggattgttctggtgctccagtgccccaaaccagtaagtcacaggacagaggcattcatctaaagttacagcatcgccaatggtgatctcccacccaacctggacgtaaggaagccaagcccatttcagatagaacatttttgaacatctttggacaatatacttactcctctttgtctacctgcttttttcacgcatgaaatgctgcaggctgagatccacaccgctgtcatttctctctcctgttttctcttctgtacatttatgaacagcgggtcacagaaagtcgagagagccaaatgatgattgaggagaggaagcagctcatcactgtgagagaggaggcctggaagacgagaggcagaggagcggccaacgactcgacccagttcactgtggctggcaggatggtgaagaaaggtcagttgtgtgtgtgtgcctgtgtatgtgtgtggtgtgtgcacaatgcacacatgtgagcacactcacccatggagggcatggtggtacacgatagctcaatttaaaagaagaaaccatggtctctttaattttttttttttttttaagatacaaggtcttgccctgttgcctaggctggagtgcagtggctcagtcatggctcactgcagccccaaactcatgggctgaagcaatcttcccacctcagcttctctagttgctgggactacaggtgtgcaacaccatgcctggctttttaaaacttttatgtagaaatggggtgtcactgtgtttcccaggctggtctcaaactcctgggcttaagtgatccttccgcctcagtctcccaagtagctgggactacaggcatgagacaccctgtccagctttctttaaaaagttttaaacttactgacattctgtacatgttttttgggtaggttctgtgagatagtcctactgaatatctttttgtcataaatagtgtcatcttcaaatgcataatttaatttgtcactatttcaaaacttacccctttagaattgaatgcaattgtaggtttcaaaagcaattcaggtctgctagcaaatcttggtcctttcccataattacttttaaatcgtttccattttcttgtgacctggcaaccacttaccccaagtcagcctttcacaatagagaagtttgtctcctcttccttttatattaattcctgggtccttctccatcaaacctgatttctctgactgaccaaagtcaatcctggatatgctttaatagatgtctaaaatatgtcctcagttccaaggcagtgggatgtctctggggcagtccattctttgctgctgagctcttggaactgatttgttgtctgtattcaaacatttatgaaattgacttacatatgaaatacttagtaaagtcacctgagagctttaagtcttcataggagtgtttggggctttgtttcatgtcctgcaggaaatcgttaaaatttggggtccctttgtcacctatatgcacataccatcattttctaagctattatttaaaagcagatttcccaacttagtggtaaacattttcacattcactttgtcttaacatcttgtcatcaactttataggcttagctttcctttttctcagaacctttaggggtccatgctttcatgaatagtacctaattcattataggtacataataaatgtttgcagaaggaaaggaggggaaatccctgaattgtaaataactcaaatcttagtggggaatcccttccaatacatctcttcagcctcatcttggaattgtgaaaagatgagagaagataatttactcttacagtaaattatttgccaattttctgcatcagatcacagaactggatactcatgtttaaactcctttaacgtgagccccaacccttctttaacagaagcacgtcgttaggtgcagggtgactaagtagaactggaactgagaacctgaaccagacctcaggttttccaacttctagcccagactttcatcttgatgactttctgctttggtttcttttttcctcttccatcttaaaaatctgaatttatttgtaagtgggttcttactaccaaatgccactgcccttgtccacattgacatcagaggatatagatttgctcttattcaggtttgtggaagcaacagttcccatttctcggtggatgagttcgctttcatattttcctgaatatatcagggatctttatttaacaggtgttatatggctcactgaggaaattatcttcttatactttataattaatgaaaaaactgtctcttctgtttctaatatttgccatcacctcctgggttatatgtttcacttgagtcattagctctttttgatttgcagtgatatggtaaccgattaacattcactgcagaataaaataaccccctgcacaacagcctggggtcctatctcccagaaacatcaggccaccaggagtgaccacctctcagcgcgttgccaggaggcatctgggacctgaccttcattctcttaccccagaaacctctcttctcccgctagccacgttaggactttctcccttttttatattccttgattctgtgtaacggttagcactccacaaggttctcgtggtattctaggattctcctggaagccaagtactccaaccacacctggagtaagagagacgtgaaaatattcctgaagacagtaggtgactggttgctgtacctagaattcattgaaaagagctatggtgggatctttgttttgtcttaacattttgtaatctgcatctccatgccctgagccattcattgcctaaagatccttatctctagctgggagaagagctcttttggatagtgccactgcctgaaccgccagcagggggagccatggcagcggatttgcccggcaccggccaagatagggatggatttctccggttgctttggaaaccagccttcagagccagtcctgtttattagctgcggagttaacggcctctttgctaatgaactcctctgatgtctcttaagcatccttctagtgaatgatgatttccctccccaccctgtgataccagattttatttatctttaaatctttcaagaaagtttaatttctcatggatataaaccctttgcagttctggcaattgaaacaacttttaaaacttttaatgacatcatcaatcaaacatatataaaatgagaagtacttctaggatattacctaaaacttgagttttaaaccatttaattgtatttttattaaattttttatgctataatacttctcccgttcacaggaggaaggggcagaatcattcattcatttggttttccttgtgatagtgatttgcatatcctgtcgatgttgttcgtccagggttgcattgtcatctaagtggcaatgtcatctaaggatttcacatttattacaaatgagtacagagaacattcacatctcattttggttttttgtaaatgcactaattagttttctttccaatgccttccacttaggttagggaagcaatactcatccttctctttactaagttttcttcttccagctggatactttctccatgcaggaattcctccctttccctttcatgtgtctctcaccactttcccttttaaagattccccaccctgcttctcggtaaatatacgaggaaaagcatttcctgtttctgcccacacgggagatggactggaccttccaaaacttgtagtcggtacaaacctgccctgctctgtggtttcttctgaaaggttgaccctccttgggttactgtctgtgtcaattccccaaggccactgtccctccnnnnnnnnnnnnnnnnnnnnggatgtgcacaggctgtgtgcaaatcctaccccattttacatcagggacttgagcatctgtggattttggtatctctaggaggtccttgaaccagtcccccatagacgctgagggacaactagatatatttttcagaagaatttatttttttggagcagttgtaggttcacagcagaaagtacagagttcctgcatcatccctgccctcccacacacagccaccccaattatcaacatccccctccagagtggcacatttgctaccattgatgaacctacgttgacgcgtcattatccccaaagttaatagattacgttaaaatttacttttggtgtggtccattctttcggttttgacaaatacttaatgacatatgtccaccgttacactatcatacagaatcgtttccctgccctgaagatcccctgtgctctgcctgctcatcactctcaccgcccagtccttggcaaccggtcattttttactgtcacatggttttgccttttccagaatgtcattgaattggaatcacacagtatgtagccttttcagattggcttctttcatttagtaatatgcatttacgattcctctgtgtctttttaaaattttatttatttttaaattattatgattattattattatttttgagatggagtttcactctgttacccaggctggagtgcagtggtgcaatcttagctcaccgcaacctccacctcccgggttcaagcgattctcctgcctcagcctcctgagtagctgcgattgcaggcgcccgccaccacaccccaggtaattgttttgtatttttagtagagatggggtttcgccatgttggccaggctggtctcaaactcctaacctcaggtgatccgcccacctcagcctctcagagtgttgggattacaggcgtgagcctccactgtgtctttttatggcttgaaagcttttttctttgtatcgtcgaataatatttcattatctgaacgtgccacagtttatttgtctattaatctactggaggacagcttggttgcttccaagtcttggcaattatgaataaagtgctagaagcatccatgtgcaggcttttatttggatgtaagttttcaactcatttgagtatcaaggagcatgattgctgtatcatacggtaagagtatgtttagttctgtgagaaacctccaaactgtcttccaaaatgactgtaccattttgcatttccatcagcactgaatgagagttcctgtcgctccatatccttgccagcatttggtgttgtcagtgtttgcatttttgccatcctaattgatgtgtaataatgtcaccttgttttaatttgcaagtctctaatgatgagatttgcagatatgatgttgagcatatttccatgtgcttattttctgtcttatatcttctttggtgaggtatctattcagatgtttttcccatctgttaatctggttgttcattttcatattgttgagttttaacagttctttgtatatttggggtagtagtcctttatcagatatgtcttttgcaaatattttctcccattctgtagattgtcttctcattcttttaacagtgtcttttacagaagtctttaatttcagtgaagttcagcttatcagttatttcttctgtggatattgcctttggtgttatatctaaaaactaatcaccaaatccaagataatctaaatttcttcctatgtaatattctaggagttttatagttttaatttttacagttaggcttttgtgatccatttttagttaattttggggaatggtggaaaatttgtatctagtttttttttacatatgagtgtccacttattccagcatcgtttgttgaaaaatactatcttttcttcattctaatgtttttgctcctttctcaaagatccgttgactaaatttatatgaatctattattgagctctctattccattgatctatttgactgttctttcatcaataccacacaatcttgattgccgaggctttatagtaagtcttgaagttgactggtgttggtcctccaacttttttcttccccttcagtgttgtgttggctattctgggtcttttgcctctccatgtaaactttaagatcagtttgtcaatatctacaaaatctcttgctgggactttggaactgcatcgaatgtacagctcaagttgggaaaacctgccatcttaacaaaattgagtcttcttatccatgaacatggaatatatctccatatattgttaagtttaaaggaaattaacatttgccaaaggcatttctgtttcatcacttcaaaattaaaatttcaaaaaattatatacttttacctctgaacaatgtttcccagctaaatataaatagtttatatactgagtatgtagcactagctcatctgtgttttcagaggtcaagtcactccttttctttcttccagcaatactggtgtcttaatatttaataatacaaaggttcagagaagaaaaaaagcacacaggctctgtctaaatggactgtttgtctctgtgtcaggcttcaacctgaattctttctcacatgcctcagggctgtaccagaaaaagattttactttattcccttcctttcatcttaggagctggtagatggtgacaggactggaaaacacttactttgaggtctgagccttaacctgtgatcttttcttcatcttttattcagggtacttgagggtgtatgcagtgacgagggactgaaatttctcttaaggaaggggcaaagctaaatttctttcatagtgtgtagaatttgaaatgatcttagcatttttgaaaactgaaaagtacaactttgttcctttcaccttatttctattacttaatatgtgcttttataatttcttcctttacagtttaactacatgtgaataagataaaaaaaattttaaaagccaggtcacaatattttatttcgataaagctctctggttgtggaagagtttgacccttaaatccgccctaatccttataatacatcttagttctatgctctgtgttggatcacatccctgcgtgagaaacattgagtgagatttgctatgatttttcagtcagtgtatacagagagaaagaaacccatcagcaacatcaggcaacctaaaagtattcgtgctgatttgtcctttgcacagtttcaagctgtgacctaccaatatctgaccatccctaagacaagaacctcctttctacctatttcactgccttctacacacacacacccacccacccacacacacacacacatgtgcatacacatacacaaatactcaatttctcttccaccctctttttctgcctttccccaccacattcgtgggatctgtctttgaaagaatgaaggacagatggggtaggattctgtttagattcttcctcaactctctcttactattccagccaatcccaaacatgtgtcagctaaacctggaaaaatgacacaatacttattactatatatataacatccttctctaaacaaggaaagaaaaatttagaaggaaaaaaacaagacaataatgaagttttaagcttaaaaaaatcaaatgaacaaatatatatatcttctttgttctcacattttgagttctaaattgtgataaatatttattagattatttagagaataaacaaactgtatatgctttacacccttctagagccacgtaaagttgaattgcagcaattagggggtcctaagctaaccctactaagtagcaaagttaagtcaaaatttctagaaaacaaaaacatttatgtttaatattactattcagaagggagtaaaaattatttcttcttgccctaggtctggcaaacgaatgggagctttaaattctaaaatggttgtatcatcccaaagtttgtatccattgtgtgcataaagggctctgagggaatcccagtgctttgaaaaacgaaattttggatttgaagataccatttttctgagtcattatccacacccactaccccaccctggactgttgagatgcctgagagaattcaccacagagttgactaagtgaatagtgaatcaccacagtgatggctggacctttggagacgccaactttcttggcacttgatgtttcttggaaatatttgaagccaagcgccatcttggtttgattaaaattcactcctgaaacttcgttttcaaagaaaacgtattctctttgttgaattttgatgaggtctttcgggcaagtgaacctcatcgtttatttaaaaaggatacgtgattcagagagttacttggaattaggggcttctcgccgatcacgaggggaaatgttcaggtttttaggaaaaaattttagtaactttgaattttgataaaatgttaaacttacagaaaaatttccattataggcagagcactttcatacgctttaccagaaccactcattgttgacattggcccccctccttcactctcgctcccttcctccctccactcctcaccccactttcttgccttctcttcccccatctcatttttcccaccccaaccatgtgccagtagtttggaaacattgtgctcctctacctttcaatatttgactttatttcctaaagtcaaagatatttcctcgcataaccacaatatggtggccaagaggaggaagttaatgttgatacaatatttatctgatccacgtccatcttaaaattgtgtcagtttcctccaataatgccctttgtagcccccaccccatctaggattcaagccaggatcatgcatcgcgtttggttgtcatatctctttaggaaaaggtttttaacctaatttaagttggcagggacctcaaaatcacttctggctatgaaggctttatagaagaatcctgtgaaagacagattcatcacttagatgatggagaagtccacgttcatagcttaaaccaaatcttcccagtgcagacctggttttgtgctgctggaaaggaagggaaggcgcctttcctctgtcaactcccatcattccaggggttaagaaaatgaactgtccccatctccactctcttcctgtccctcctgaatcaggaagttctctctcgtgggtcagtgaagggaagtggtttgccatagtgaggaggaaaggcatcggggaagagaatctctaggatggacttgactcggggctctccgagtccttccctgtgtcagcgcgaggccttaggatcacattgatccacggagacttcttagccaaggaaaatgccttaggaaggcagaaaaggtgggggacctgctagaataagttgagtagtgctcagaagtaatttgaaagcagatgcgctagcagcaatctggggaacctcctagaagaaggtgtggagtgctcagatgtagtttgaaagcggatgcgctagcagcagcagccttcctcgggttcaagagacagtggaaagtgagagggcaaacccaggaggccatcaccggcctccagagccccttccagaaaccagcaggtgacagccagggacgtgccttctgctctggagggggcacctttgcactcttccttccttggcattagctccacacctcctgtgcttctcccccgctccccacccagcccagtgcctcgccataaacaggggtcttgcggtgcagggagggatggcttgaagacagaggaaaagcaaactctgccggccagcgtttgaggacctcctgccctggtatcgcccgcgaccaccacctacactcttctccccaatacacatcactcagtggcatgagccctgtcctctgcttccatcgctgctcctgtccctccctcctcagccccatctccccatcccaggcctgtcctgagcccctcctcctttcctgatgccctttgagtcccctgtagcttcttccccttcccctcctgccacatccccaaccgcaagcctaatgagcatcatcaatggcttggaaatggaagaagcagatctctccagaaatattccaattagaaactgctgagagcattttcagtagaaatgttaccgtgcatgtaggttttgtctacagcatagttcaccctcaacatcagatgtctcacagtttaaagccacttctgtgggctctcctggttgtctacctgcccgcagaacatcagtggctgcaggaaaaagcaagcagagtgccagaaaaccttctcctgccccttattcctaaccagccttccctgtctctaactgggcaagttccttgtgtgctcacatggataaagttttctagatcaatcatgttctttgtgagtatatagggataaaaatctcccagttaactgagtttaactagatgggttaagacagagaaactttaaaaccctgtagagtccagggcatgaaaacaatctatttttaattgtttgtgcttacaaaggattgttctggtgctccagtgccccaaaccagtaagtcacaggacagaggcattcatctaaagttacagcatcgccaatggtgatctcccacccaacctggacgtaaggaagccaagcccatttcagatagaacatttttgaacatctttggacaatatacttactcctctttgtcaacctgcttttttcactcatgaaatgctgcaggctgaggtccacaccgctgtcatttctctctcctgttttctcttctgtacatttatgaacagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtcagtgtgtgtgtgtccatgtgtgtggtgtgtgcacaatgcacacacgtgagcacacttacccatggagggcatggtggtacgtgatagctcaatttaaaagaagaaaccatggtctttttaagttttttctaagagacagggtcttgctcttttgcctaggctggggtgcagtggctcagtcatggctcactgcagcctcgaactcatgggctgaagcaatcttcccaccacagcctctctagtagctgggattataggtgtgcaaaaccatgcttggctttttaaaaatttttatgtagaaatggggtgtcgctgtgttgcccaggctggtctcaaactcttgggcttaagtaatcctcccacctcagcctcctaagtagctgggactacaggcttgagacaccatgcccagccttcttttaaaattttttaaacttactgacattctataaatgttttttgtgtaggttctgtgagatatttctactgaatatcttttcttcataaatagtatcttctttaaactttatatgattcttggaagtatttgaaggtcataaaacagtgatgcataattccatttgtcactatttcaaaacttacccatttggaattgagtgcaagtgtaggtttcaaaagcagttcaaatctgctaacaaattttggtcttttcccataattacatttatttatttagacggagtttcactcttgttgcccaggctggagtgcaatggtgtgatctcggctcactgcatcctccacctcccgggttcaagcaattctctcgcctcagccccccaagtagctgggattacaggccgccaccaccatgcctggctaatttttcatctttttaatacagacggagtttcaccatgtgggccaggtggtctcaaactgctgacctcaggtgatccacccgcttcgacctcccaaagtgctgggattacaggcgtgaaccactgtgcccagcccccataattacttttttccttttttttttttttttttttttttttttggtggaggggacagaatctcgctctgtctcccaggctggagtgcagtggcacaatctcaggtcactgcaacctctgcctcccaggttcaagcaattttcctgcctcagactcccgagtagctgggatcacaggcgcgcgccaccatgcccagctaatttttgtatttttagtagagacggggttttgccatgtttgccaggctggtctcgaactcctgacctcaggtgattcacctgccttggactcccaaagtgctgggattacaggcatgagccaccccgccagcccataattacttttaaattgtttccatttccttctgacctggcaaccatgtaccctaagtcagcctttcacaataaagaagtttatcccctcttccttttaggttaattcctaggtccttctccatcaaacctgatttctctgactgaccaaagccaaatccggatatgctttaatagatgtctaaaatatgtcctcagttcctaggcagtgggatgtccctgctgcaatcttctgctgctgagctcttggaactgatttgatgcctatattcaaaaatttatgaaactgacttacatatcacttggttagtaaagttactggagagctttgaggcttcataagagtgtttggggctttatttcatatcctgcaggaaatgattaaaatttgggttccctttgtcacctatatgcacataccatcactttctaagctattatttaaaagcagatttcccatcatagtggtatacgttttcacattcacttgttcttaacatcttgtcatcaaatatagaggcttagcttttctttttctcagaacctttaatccacacttttatgaagagtacctaactcattataggtatataatgaatgtttgtagaaggaagggaaggagcgagacgtgggaaatccctgaatggtgattaactcaaatcttagtggggaatcctttctaacaaatctattcttaccttatcttggaatggtgaaaatataatttactctcacagaatgaggtaccatttgccaattttctgcatcagatcacagaactggatactcatgtttaaactcctttaacgtgagccccaacccttctttaacagaagcacgtcgttaggtgcagggtgactaagtagaactggaactgagaacttgaaccagacctcaggttttccagcttctagcccaggcttttatcttgatgactttccgctttggtttcttttctttcttccaccttaaaaaccctaatttatttgtaagtgggttcttactaccaaatgccactgcccttgtccacattgacatctgtgaaaatgttcccgaagagagtaggtgactggttgttgtacctagaattcattgaaaagagctatgggggagatctttgttttgttttaacattttgtaatttgcatctccctgccatgagccattcattccctaaggatccttagctaggtggggagcacgtttgcatagtgccactgcctgaaccgccagcagggggagccatggcagcggggtttgcccggcaccggccagaacacggatggatttctccggttgctttggaaaccagccttcagagtcagtcctgttcattagctgcggagttaacggcctctgtgctaatgaactcctctgatgtctcttctcttaagcatccttctagtgagtaaagatttccctccccaccctgtgataccagattttatttatcatctttcaagaaagtttactttctcatggatggaaaccctttgcagttctggcaattgaaacaaattttaaaacttttattgacatcatcaatcaaatatatgtatataatgagacgtacttgtagaatattactaaaacttgagttttaaaccatttaatggttttttttattaaattttttaatgctataatacttctcccattcacaggaggaaggggcagaatcatttattcccttggttttccttgtgatagtgatttgcataacctctcgatgttgttcgtccagggatgcattgtcatctaagtggcaatgttatctaaggatttcacatttattacaaatgagtacagagaacattcacatctcattttgtttttttgtaaatgcactaatcagttttctttccaatgccttccacttagattagggaagcgatactcatccttctgtttactaagttttcttcttccagctggatactttctccatgcaggaattcctccctttccctttcatgtgtctctcaccacttgcccttttaaagattccccactctgcttctcggtaaatatactaggaaaagcatttcctgtttctgcccacacgggagatggacaggacttccaacacgcacagtcggtccagacctgccctggtctgtaatttcttctgaaaggttggccctccttgggttactgtctgtgtcatgtccccagggccactgtccctccctcccctcagcctggaggagagctccactgcggggggccacttgctggcaagtgtgacacagctcattctgcagatggcaccaatgcactctcagctgcccctgccatctccgaagggcctcagaactcacagctgcatttgcccaagttaacgtgtcatggacatgttttcccacgtctccaccgttcattttggaatatcggcttgtcagccactacagtccttggaaataataaaatccagtctacgtttgcagttggttgtcccacagtcgtggtacgtgtgaaatgtgtgtgtgtgtgcctgcatgtgtgtaaattcttatatgttgtgccgtctaccctgggactcctggagatccaccagggtcccggagatttccagaagtgaccctgagatgctcagtagctcgtctgtgtgttccgcaggtttggcgtcacctactgccataaccccagtagcctcagccatttgcggtaaaacaagaggcaccacacccgtttccaaacccctggaaggtaagtcgccaaggccccggccacgccaagcctgatcagaagaggccttagtgatgctgtctcactgacggtttctgcttgcctagatatcgaagccagaccagatatgcagttagaatcggacctgaagctggacaggctggaaacctttctaagaaggctgaataacaaaggtacctactggaagccagaaggctttgctttcagaatctctaaatcctaattctgattgcttttcttcctcagccaaaaaaaagaagttttggtcaagactgattagagaaacaagccctgattcacttgataacgtactaaattggggactcccaataatacatttttttcttgaatctaagcccttgggatgccatccaattggaattgtgaactgagtgattttgcttataactctgaaagcagattattatgtgtcggcaaaatcaacgtgaccttgggcctggtgaactttaaattgtatgttatcaatttccaataaggtaaaagctaatattatttcatataatcacaaatgatttctaaaagaaaattatggcaaatgaatattgaagtaaatgtttcaatataaaagtcaatgcggtataccaaataaaagagcaatatgcaaaaacagccttttatctcttgattaaaatgcccaatcctggaaacttatcaaatactaggcgctgggagtccctactattgacagtgaccactaaaaggttgaaaataatacaaccaccactgaacagaaatataaaagtgtaatataataactgaactggctaggcagggaatgccagtcagcaacgcatttattacacacatggagcagtgatctagcccgtgggtcagcaaacgatggccattgccaaatccagctgcccacttgctttttttttttcttgtttgttttttagagacagggtcttgctctgtcacccaggctaaagtgcagtggtgccatcatagctcactgtagccttgaactggactcaagcaatcctcccacctcagcctcccaagtaggcgggactatgggcgtgcaccaccaagcctggctaattttttttctgtttttgtagagatggggacccactatgttgctcaggctgaagtcctgggctcaagcgatcccccagcctcagcctcccaaagtgctgggattataagcgtaagccaccatgcccagccctgtttttgtaaataaagttttattgaaacatatccatgcccatttgtgaactattgtcaatagcttttgcattaagacagcagaactgagttgtcgcaacacaggccccatgtcacccctccccatgcaaagcctaaaatgtttactggctggccctttttggaaaaagtttgccaacccttcacgtagaatgaggctgaggctggttcacctaccctcaacagaagcaagggcaggttcagaagcgttcagtgggcgcgtgtgtgcagtatggtcagcctccctctctcccattttactgcagatttgttcaggtgggaagtccttacgtcagagattaagtaagggcctgggaagcaaccacaggaccctgtatatcacaaccgtgtttcttccactcctggaacttaggaggcaatagaatttttaaactattgtgaagcataattggagtccttgtttttataaaactcttatgtcttttgcttgtttgttgatagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaagtgagttatttgggtctccgtctttcctccactgagaagggcttccttcgcctgcagagggcacatccatgaggcttttcccccagtgtggcctccttctccttctaactccatcacggcggcgttagtattctagagccagggcaaggtgttgcaggagccaggggcacggagcctcgcagcagataaaacatgcagacggcagaccagatgtgcatgcaggcagaccgcgtgggccacagatgcttgtcctgtgccataaagagggcgtcactggatttttcacataatgtaaatattgttttgcagtttttaggtttacatcacttagcagagagttcaacgcctgtctttcatttgacatattgaattcttgctcataattttgcaaaatatttggatgagatgggctcaaactaatacagctaactagaaaatcagtaaggcatgttacttagcttccaatcatttataaaatcaatagatctgcgggctttctcattgatgtctaagggtttctcttcccaggggaacatgactaaaccaactaggaaaagtgattatggtattaggagtccgtcaatttcaagtgccaagaaaaagatcccaactcaaactgatttcagcaaaaagaaaagtgcggagggctttgtcggctcactggctgaacagtgcggaggggtttgccggctcagccactgaacagtgcggaggggtttactggctcacgcgctgaacagtgcagatgtggcctcgggttctagaggcccctcagaacacagtctgtcttggctgttttcctttgggctggcctcactctccgtcaggcagcggcctggcggcagatggacaccccagctctggagtcacaaggctgcctccctggccagcccagcacgggtagcttttcttcccagtagtccaagcagaagttccaggtttgattttcttggcttcaacttgagccccctgtccatccctaaaccagtcactgtggccaatgggatagaagatgctgactgggtaaaggcggggctctgggtctcctttagagccacgatgggggtgcagtgaggtggtttccccaaaggaaaatccagatgctattaccagaagcagagggagacacgctagacaggctccacccacggcaatccaccacatccatctgctcttaactgcaaaattgtcagtgacatataccattttctacaagctgctcctgataaattctttgcatattccagtttgctcaatttgtttcagtttgcatgttttaatttcctaccttaaaaaatgagccctttgccattttctacttcaaaatagtattttgggtatttgcatacatagcggtttaaccatttctcaatcttccgcccacacaatgtcactgtttaagtagttgtatatcataatttaaacatattgatagacacatatgacaccatggtacgtaaagacgccttttgggcacagaggcccgcgcagctggaggtggagagtggcagcaggagtctgttgggagatcgcttctctcggtctgctcaccttccctagtctggttttccaccccaaagaattgtgagaatgtggggtggtcacagatggttgcgggcctattttatttcaatatagtcttccaaaaagtggttatttttcagaggaggcagtgcgttaagtggaagctagtcatggagggtcagtaaggggaccgaaagctattgcatagggagaaagtttaggccgagcgaagaggattacgtcaaggagcccgtgcaaattcccgaagggcttgccggaaacagacaagtagacatgggtgtatgattccaaagcgagaattaggacgtgtgcatgggcgtggtaggggggagggaagagctccctaaaccctagagctgtctagcagagccgtgagctgcccggaagtactccacaccctcccaggaggagaccaaggggcatgagtgagtgggggcatccgggtgtggctgagatttgaactcagtgggcttgcatccctcttccatctccaagattctacgactccatgtcaggggagtggcggtgggaggaagagttgcaagatttgtaacaaaatcaggaaatactttgtggagtccaagacccccaggtcatccaggggtggtggtgtcacagactgggaccgcggctctgcttccatccgcagattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagagtgagtatttgaacccccaccctgcttctgtgtttgggaatggcttcttccgatgctctactcattgcttggttttctgccttgtgaaggccaataatggtgctcagaagaccctcatgaagtaaaaaggagtaagtttgcacatacatgtgcacgcacctagactttaaagatttttcatagaaattctcaaagtgtgtatcacctgttcagttagttaattcagattatactggggtttggttttttttttttttttttaaagactgggggtttcatcatattgcccaggctcatctcaaactctctggcctcaaacaatcctcccaccttgatctcccaaagtgctgggattacaggcacaagccaccgcacccggttacaaattaccctgttttgttgagtttttttctggaagttagaagagatggatatttctgagtatggtaattcagccattttcagctctgtagatcctgaacacacaatcattcttcatttaatcttattagtcgtttgatctcttatagtaaaagagttatttgatctcttatagtaaaacacttcaaatcactggagtatctaatcctagatttttatattattaattaacacaaacgccagtgcttttcagatcgttcttggtaggaccctgagcttctcggagttgggatgtgggctggagggagcagggggagctggcaggggcgatgaatggaggcgaggagatgggctccagactctcagtctcactgtaggctgagccacactgctctcatctgcccagtaatgtggggttccatcattctgaaacagtgattttcttggtttgaggtgatagcatgcataatcttgatttttgggataatcttgctataattttcattttcccataacactcatagacctatttcctaatgtttttcttagaaatatagtatttagatgaagtggttgagtctttttgttataactggtttactatgaaagtatatttcagactgggcatggtggctcatgcctgtaatcccagcacttcaggaggcagaggcaggaggatcacttgagcccaggagtctgagaccagcctgggaaacatagcaagacttcatctctacaaaaaatgaaaaaattagccaggtgtggtggcactcacctggggtcccagctactcaggaggctgaggtgggaggatcactaaaccccgggaggtcaaggctgcagtgagccatgactgcaccactgcactccaggctgggcgacagagccacaccctttctcaacaacaacaacaaaaaaagtgtatttaaaaagcacaacaccataatgaattgacaagtggtattatatgtcttcaaacctaatcccagtgaaataaatttctgaatttctctctagcatatacatttttaaaacaataagttggagaaataaatgttggcacagattttacatatgtttcctctgcctccacttttgggggctcaggggttggattagtgatgactgaccggtctatagatgtttgctgttttgcagtgaaaacccatcttataactacagtcttaactctaagagcagaagatctcaagatatcatctggctgatcactttgccttcagataaagattagaacctaatcatcccttacagagtgtctacttttttgttttctttatgtataaaggcttttggtgaaagcggtctaacagtcatctggcatctatacatttggacatgtaaaagttgttaggatttagaacagctttcagtggaattgcaacaagtgcatccagctcctggttttgtactaaagtagctggtccacgtcatcactcagttcttgtccctctgcacagcatggagtgacacttgtcaacaagcagtttatattttcaatgctgtacttaattcttaacacagtggttaagcattgaattgcacatttaatcaaacttgagtatgttttccctctcgggattaacttgaaaagacaaaggtgttgagtcagttatgaataatttctgactgtaaatattgtcactgtaactgaacctcctgcgttgtgtttccttattcaacgtgcccagtgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggtatttcagagcagcctggcacggtgactcagggcccgtggtttctgtctggtcccatacggagtcctgactctgtaattcattgcctgtgccgggaaaggaacgcacactttttgagaacttattgtgtgttccttgctatgcaacctcctgtctctcaagcttccccaaatcccatgacataggaagtattctgcccaccagggcttccagaggcaggaacgtgtctggagtcccagcagctactgggtggcagagctggatttgaacccaggtccccccactccagaatcccagcttttactcctggcgccccgtgccccacgaagcggtcacacatccatgcagttaccagaggtgccctacatcatcagaggggctctctgctctctgcccagttctccccgagtcagtacagaactggggaggaagacacagcttggagaaggaatcaagggaagttcgacgcagatgaagcccacctgcattccgctctagtgcccttcctgtccgtagcaagggagattccaaagatgaaccagggcgtctctgggccatgaggaggagactcggctgcctcctggtggccactgtatagatgaatccttgagatgagaatgaaggaaatatcctctccctccaggagggtttcccacatgtttctgtgtaaccactatcctattgtgtgtatttaaaaagactagtgacaagctcaaataaccaatctctgtcctgagtcctaacccagagactacatgatcagtgtaattgtggaaagctcaaaatcaacaaatatttaggaaaaggtgttgaaagccacagaaggtggcgcctccatccttcctgttgagaggcccctagggttcatagtggaaactccccaggggaagatcggacccttcctgaaggcgtggcttcccttgcctgggccacagatgtaattgggtgcaggaggtggccaggggagagaaaggccccgggagaagagtgaaggagggaaaaggagcctgtgtgctcatctccctggaagggggagccttcattaacccacgcacatgacactgataatggtcctgataagtgggtgacatttgggaaagcacaaaccaggaaagcagccactagtgccatcatcatgccctttctaaatccccctgctgccaccctgggccatgggcactcttattagcagacaagactctagaagtgaaagcgtccgcagcagggatgcttccgatatggggtgcgtcctatccccgttctgtctggaaagacggtgactgtctgcctcgtgttcaggaagaagacacgtgcagaccaggctggtggaacctcgagcttcggcgctcaatagtggggactgcttcctcctgctctctccccactgctgcttcctgtgggtaggagagttcgcaaacgccatagaaaaggcgaaggttggtacctgaaaaataaaaatgctttagctaacatctcctttacgcaccggtggagtgttcttcctgacgtcagtcacaaagcttctcaaaagccaggtgttgcattcaagtgagaagggataggtaggatttcttttcctgaatgtctctcaaacaagctttcattacatgtttaaatgggatactttaggactatgacctacaccccagtgtttaggtcctgggttccttcctactcctgtgtaaaaaaggaagcggccccactttaaagtcctttatcccaggtagctctgaagttctgccatagacctgttgaatgagactgtcatggggtaaagcccaaagaatagtgttttttaaaagcatcacatgtgacctattgaagatggagaactattgctctaaagaattgatactccctggtctttcagttacattttcttgaggtcattgaaaatacccagtaaccagcatccacccacacccgtggtcacaaggctttccttgcaggcacactgtttctcctctctggttttgacatgtgccactctgtctagccaagggcttttctacccaggcaattgtgttcctctcttttttaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatgtaagacttcattgtacttcagagattgacgagacttgaatctcctttcttctcccttagctcattcttctattttacattgtaaataaaattttacaatgtgaaattcattcacattttacattgcagctactttgcaatgtaaaatgtgatgctctcctgttcttcttatccccaagctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtacagtccgtgggctctgcccttcagtgagaaaccacattgaaagcactcagcacaggctgcccaatagattagagagtaagttcccaataaaggttagccagtgtcggtatccattgtagaacatttacagctttttaaaggatatttgtgatttcaaaccattactggtatcttaaatgctaatatggaatccagaatatcatttagagttggcatggatcattgaaggcttttatatcttaggcaaaatacaaatattacttagccctatcttttgcattttgcataaacattataataaaatatttttaaatccttaagtttaaggaacactagatgcatgcatatataatttatggatttcccaattaatgtgctgtttttgtcctgtcacagcagtaaatatttattaattacatacatttccagtatcattaagcatgctaagtgttgagaaagtggaagacacgcaggcccttaagtttaattgggtggaagagtattagaaggaatgtaatctggagcaaggttgactgtgtgacatgtatgggcatttacatgagggaaaagtcacagaaaaagaaaccttcaggaataattttacatagaaagtgaaattgagcctagtttagagttaagcaaaatttgaattgctggaagtgaagggagaactcattctaggagaaagaataaaatgaaccatgaacataagaaatagcattacattcatgtattcattcagcaaacacttagtaatcaacccctcctgtatgtatcaccatgatctgatccctgcccttaaggatcttggaattgtgtactggagagaagacaccactggaccatgagtgcctggggtatatgaagtggcctctgtgtatatattaagtgaatgaatgagcacatgagagggggaggaataggggagagaggcaggaagtcgacaggaagatgtacctaaagaactcttgtgaatcgcaagttgtaagcaggttgagagttcagaggagggaacattatcctggccacttaggacactgggaggaggaatcatgcccgcagggcagaggctggctcggtggggcagtgccagctgagatctcctggcctttttgtgtctgtgttggtcgccccgttaggatttctgtcttcctccgtttgactcactgtcaacaagagaccctgttgcacctgattcaactgttgcatgttcttgaagttaacaaattcttttgtgccatttctcccaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccaggtactcctgccgccgcccggggacagctcttcaagcgagctgattcccttcgatccctctgttctcaccacagtcctctactctcgctctttatagggttcagttttcataaacgattatatgcagtggactgtgaatattcacaaaaggaacagttctttaacttttatctaactattgcagaaatatggatgtcgtagtcttctggaagaggtttgttatagttgatttcttgaagtgagcaagaaatgctgcaagttcctccctgcggcattccaagtgctgctgtggcagatgaacagcaattgtttaaacaaattacatgcggatctgaaaggcttccccgggtctggaattcagccattgatctgaaagtgcaaaagcaacatgcctccctctaatttcataccttcccagcatcgccctcgaatttcaggatttatttggcagcagatgatgtttatgtctttatatcttttgggaagggaagagggggaggagatggtgttaaaataatgattgcaattgtaatattccctgcatgtactagactctttaaagtcattttggcaattcaatagaatatgtgcaaagtcagaaattatgatgttggaaaaaataattcctacgtgcaaaggattgttgttttttcaactatcagaccaaaaaaaaactagtgctttttaactatgggtgccgttataatagattagaaaccagtgaaccaccaaacagcatagaatattgggcatctcccaatacattttaatgttttccattgaattggtctatgaatttcaactttcctgcctagtttcctgcttaaaatccaattattgattttcttattaattaatcattatagaaaccattaaaaattatggcagtgtgataagttttaaagtccttgttaagcaaatgcactaatgtttaacctcagtatggtaacaaccattattttaaggactggaactacagctcagaagattttatttggtatagcaaaggaaaaaagaacaagctaaagcataaaatctatgtgatagccaactgtatttaatagtggcataatcacagatctgaaagtggatgactgagctcctaacccactggttttcaacatctctgagacagaatcacctgaggggccttttaaaaaatgcatttgctcagcccagccccagagatgtgttttcgtttcatgtgagttagagcttatgtgtcaatatgtcttaaaagctcctagggattttaagatgcagccaggattacatacccagaccttcttagcaaatgaggctgaaaccactgagcccagttccagctgtaagtcagggaagggggtagagaaacccctggctcctggcccaggtttgtccccctcaccctgcaatctgccacatcgcttgctcacaacgcttcaaaacataaatgccagattccaaagcagaaaccaagagccctttcaatcatcatcttagcaagcctgcagagtaggactgacataacaaacagtcattcagatattttctgataaagaccacagcctttcaagaccgccgtgcattttccataggtgcttatgtttggttcctaaagtcccataagagcatgaggtagaagtgtctgtgctctatgatttatccggcagctttctttgaatcaggcagcctttctgatgtgcctcagctgtgacatcagcagctgtggtcttgaccaagcaggaagtgactgaggcagtagcacagcagggcacgagcagcaaggggggttgctctaaggggtggctgcattccgggccggattcacaaccgaagatggatctggagggatgagagatcgtgcatgttattccagggctacgccctctgcagcacgtgtatcttctcagctctgcctttatctaaaatacctgtgttcttggggacagtgtaaattttgaaatcctaaggccacacaagacctccgggtggagctatgccgttttctttcctatctctctgtgctctcctgtctgctgccctggccagtggcctagaaataagtgcacaaaaaggcacttcaagatctatgaaagtgtgttcattttagtgacgggagaatctccatactctggagagctttgttgtaacatgacataaaatagtagagaattgaggagggagctacctcttccctatgtctattaattaattggacgggaaacttggtaagcatctgcaggtgactgggcggctaaagtagacaaggttttcctgcggctcctgccttttccaaaatccccacccagcgtgccaccccagggtatcccaaagacaagaatttgctagaatgtggcccacacctgtagtcccagcactttgggagactgagaaggaaggatcacttaaggccaggagttcaagaccagcctgagcaacatagcgagacccctgtctcatatttaaaaaaatacaaaaattagctacgcatggtggcacacacctgcagttccagctatctgcaaggctgaggcaggaggatcactgcagcccaggagttcaaggctgcagggagctatgattgtgcaactgcacttcagcctaggcaacagaacaagaccttatctctaaaaaaaaaaaaaaaaaaaaaaaagaaaagaaaagaacttgctagaatgtaagaaaagtctagtcctgacatggttcatgtcacattcaggcacatcaaaaactccatggacacaaagctttgcaagacttcagactaaaataacaaaatgtcattatttggtaaaatgcaggaaaataaaccatttattttatatgtactcacgtactttgaggttttttccagcagccgcatgtgttttagattcctttgtttaagcttggcttcatcttggttcttttcctgtctgttctcccaacccccctcccaccctacagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggtattccggcgaccaagcctcaaaactcggggcttggttcgggtcccaataaaagtggccttcatgtaaaatgatcaaatcaggatagttcgtatggctgtcaccccagatgtatcatttctttgtggtgagaacattcaaatcttctcctctagctattttgaaatatgcaatacagtattggaaaacagtcaccccactgtgcaggagaaaaccagagctcattcctcctctctgtcactttgtaccggttggccaacatctccctatcttccctgtcccgtctccttcccacacccccttccccataaaacagatgcatgtatcaacacatcgaatcatacccataataatgtgtcaactaaaatacttttttaattaaaaaaaaaaccatggacacacagacacacaaacaaacacacacacacacacacacacacacacacacacacccttaaagctaggaagccttcccaggattcactagtagaacagcagacaggcctccaattctaatctgactctgggaagtgaagagtctgatttgtgcctgttctcaggcacccatgtgctgttgtggcgatgggtgttcagacctcccagagtctttctggaaatgcagcctttccctgactgcagttaaacatcctgagacagagtgtggaagctgtatttttatgctgtcccatgaacagctgaagcagcattgagcatgacaaggaatagctgcagaaacaggcaactgaactgatgtctttgtgttcccctgtaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcaggttagtgagcgcttgtggttttttccagctgaaagaggctggcccggcagccctgcgggagccagcttctccaatgaaccctgtcatgccctctgctgcgtccgtgcagtggggcactgcagtcatgcgcctttgagagccacctagtaaactacagagatgaaaagaagtaaggccgaattcctaacaacctagcattgccgaggccgctggtgttcacctgtagaaattgaacttgcacatcaaggcttctcagctccctctctccctcccctgcccctgtccccagagcttttctgggaaagagatgattggcctctaaatgatatttcccatgtggctgtgtgctgcttcaattaaagtcgttaagtagagcatatcttcgtgatttaaagctggaaccaaatggtgctgtaacattatagtaaatacacgcacagaagattgatttgaaaagtgaaagaggctgtttctcccgagactgagagcacgggtggtgctttgtgggtctggtgtagtaaatgcagagtctaaactctcctcggttcctgatggtgacggaccccattgcaaaacactcacctggatgcttggtgctggggaaagggggagtccggtgaactctggagaaatcatccctttcattgccaaggaggagccttttccacagcgctgctcaccccttcccatttaggagagcatgcaggtcacaggtttgtgatttcaactcagaagagagtatttttgcctctttacagcccccttgctgtgcaggtgcacctgcccccggggccacaggaagcacaggcagctgtttgctgatcagaaaactgcaggctcagaaccaggatttctttcctgatttatacaagatgcatctattcatcagctgacaacatttcctgagcacctactctacggaagacactttgtagggaccaagtaaatatttcagaccctgtctcagtgacataaagcaggtgcaggaacagccagcaggtgggcctcgctgagcacacggccagtggggctgtgtgctgtgcagagccgggctgtggcccagaggtccccctgccccctcagggcacgatgctgggggctttactctgcctgtagctgagggcctactgggctccctgagacatttctgttgtggtgctaatttttcagataaggaccaagacagtaagatcaaggaacctgcctgaagccacacagctagcagggagtggagctggacactcaagtccagacctgcctcttttcaaacccaactgtgctattaaaccgctctgcgggcagagagtcagagtggggctccagcacaggatgtgggcagctgtgagtctggctacaaggaggggctgaagatcccagtcaccagaccttggagcaggtcagcattgaaccagcagcaaggcgacttgaggttgggccgctgaacacaccaaacttcaggggcttcttaaacagcaggaaggggatcttccagggcccaggcagctccagcctctccttccagggagtagtgggatgtcagacaaggacccccaatgggagggacatttctttctctctttttgttctttttttttttttttttttttttgagacagggtttcactctgtcttccaagctggagtgcaatggcagaatctcggctcactgcagccttgacctcccaggctcaagccatcctcgtgcctcagcctcccaagtagctgggactacaggcatatgccaccattatcaagctaattttttctttttttttttaagagatgaggtctcactatgttgcccaggctggtctcaaactcctgggctcaaaccatcctcccacttcagcctcccaaagggagcagcattcctcatctacttaatttcttatgagcaagcaattggaactgctcctttcctttttcataaggagctgtgtcccttgagggaaggccacaggtgctgggaccctacagcctgggattcagaatctcaggccctcacttaccagctgtgtgggctgggtaaagttactctgtctgagccttggttttctcacctggaaaatagggattatagtactcagctcacaggactttataatcaggtatatatgacgtttagcaggtgcctggcctgtgttcacattgtaggtgcaggaaatactcatcactgacattgtcagcaggaacagcgtaattactgtttttaacttgaagataagataatgtggatctccccaaaacaataacaataacaattaataacaaagagtcactgtcgtggacttacgcttttgcttttgtgcagaggtggcatgtacagtgttaatctctgatgctggttgccaaagacaataataatagggaattgagtgtgtttcggggcaggcagatctcttaacctttggagtaatggaactgggaactttaaagaacaaactaaaggcacttgtagtgcccgttcctaaaatgcaaaaagggaaatcgtgttttataaaaccagacatagtttaatttagccattttcttactttagctgttagttatgagaaaaaaaagtaattgtgagtgaatgaatgagtaaaactgttaaagtgaattaattaaaaataaagcgaagagttcagactttcatggactattgacttggaggcccttaggaaatatgatttgagccgggtgattcctttctatatttcttcccaatgaacacaatggacatctcacagccagctccaacaacatcttttccagcagacttacaacttagaaaaagcccagctttagagaattaagttaaagcagggagcattcagattccagaccatccctccagcaggggggaagcacagcccgatggcacttgcagtcactccgtaaccaacgcggaagctctggccccttggtgacactagtccggctcccctatcacttgtgcgcacaagggccacacctgcaaacaggactgagtcagagctcagggtgcacttctgggagagggtcagcaaaagcagcagctgcacaggtggtacagcctccgcttggccaatgctggccggcctgctagggtcaatgtcctggcccagtgcctgcagggtagggttgctcactccccagcagggtcgcgacagctgctcaaggtgcccagggatctgagccaggctcctccagggcctgatagatgtctagttcctataaataggtggctctggtgcaagaatgcttgaccatgaacagtctttatatttgtgttttctgttattcctaaatagaactactagtaccaaacattcttgaaagtgccttggtggcgtaacatgtccacactttaaattaggtaactaatcaaggttgtaaagagaatagctggctgggcacggtggctcatgcctgtaatcccagcacttcaggaggccaaggcaggcaaatcacgaggtcaggagttcgagactatcctggccaacatggtgaaaccccctgtctctactaaaatacaaaaagttagctgggcatagtggcgggcacctataatcccagctactcgggaggctgaggcaggagaatcgcttgaacccgggaggcggaggtggcactgagccaagatcatgtcactgcactccagcccgggcaacagggtgagaccctgtctcaaaaaaaagaatagcccagaagttcttactactaaaaatttaatctttatattgccaaaattaaaaatgaatacacatacgaaaaattaagtttcatgtaggactaaatttgggtatgtgcagaaaaactgtaaagaaaactagtgaaatgtttgcttcataaaatatctttaaagaaataaaattctagactcacacttgtaaccccagagttttgggaagctgaggtgggaaaatcacttaaggccacatgtttcagactaacctgggcaacatagtgagagaccttgtttatacaaaaaaataaaaaatgagcccagcatggtggcatgcacctgtaatcccagcactttgggaggccaaggcaggaggatcacttgagcccaggtgcagtgagctatggtcataccactgcactccaacctgggcaacagagcaagaccctgtctctaaaataaaagtaatttaaaaaagagacacaattctattttgtgtatatacactcaagtctgtttgcaatgttaggatgtgatgttggttatttaagtgtgaatatgtatttacacaatgtatttgagtgctaacagatttcaagatctttataaactgttatgatctatttgaaacatatctttcctcaataatctatttagtgcaacaaatgttcactatttgaagaatgggattgctattcaaaggcaaagttttgttgctaagttagcagaaatttcaattaagtggcttccaaattaattgtgggatttataatctagtcattgatggttcctattttattttgccctctcaaaaacacccaaacttaaccagttgagatccacagtggatggtacaaaagactgtgcttagtcaaaatactgtaagaaattattagaatcatttacgaaacctatgttacagatactttaccaaacaaagggctaaaaatcaaataaatatgaccccctaccttttaagaacttaaatgagttttattcttcccttcaaacctcaatacagttgcaatgttggaaatgggattggagctgggaaaactgcagtgatataaaaccagagactccagttattctcattccttttaaacctgtgtgggtgttcccaccaactgctgcagcctcccgtgttgaccctcactccctgggacacctgggcctttgggtcaagtgcttggtctactggcctcactcagcctagaagcttctgcttccagattagcatcattcaggtctacactccccacctcctcagaaaggccctccctcagcaggtgtcccacgagccctgaccctgcctggcgtcaccttcttgtctcttgtcctcatagcacttatcactatctgaaattgtcttgctcgtctctttgtttattagaacaaaagcacccagcatcgagttcatcattgtcttgttcaccattgtagcccagaatcctgaagtccccgctcattgaatatttgttgaatgcatgaacgaatgaagggaatctagagtgagacatattcttacaggtagagatttggatgtctgtagtaacatctaaaatgcccatttggcctataattccagcacttttggaggctgaggtgggaggatcacttgaggccaggagttagagactagcctgggtaacatagtgagaccctatctctacaaaattttaaaaataaaaattagccagacatggtgacgcatgcctgtagtcccagctatttgggaggctgaggcaggaggatcatttgagcccaggaggctaaggctgcagtaagccatgattgcaccattgcactccagcctgggtgacagagggagaccctgtaacctccctgtgactgctctccacaccaagcagtctcatctgcctcctgtgctgctcatgtttaccgagtgcctgtgcagttccagccatggggaccatcagcacttaatcctggcagcagccctggtgacagacatgaaatccagattagtttatgctcaagtgatatgtcagcaacctatctcctcctttctgacagaacttgaaaacttcaaagttgtattttttactagaatagttttaacagcctgcattttttcctttgtgcttaaagctggccctgctattgtttttaacattttttctctaccagctattcttttgccaaagagtggtgtaatatggaaaatgagtttgtgtctgtgtgagcccttagtcctgctctggcggtcaccaaatactttatttatttatttatttatttatttatttatttatttatttgtaagagagtctcactctgtcacccaggctggagtgcagtgacacaatcatggctaactgcggtctcaaactcctgggctcaagtgatcctcctgcctcagtctcccaagtagctgggactacaggtgtgcaacaccacaccaggctaatttctttaaattattttagaggtggggtcttgctatgttgcccaggctggtcttgaaatcctgacctcaaacagtcctcccagagtgttgggattacaggcatgagccattcacctggcctcaccaaatattttgaagaaattactctgttgcacacttggagtgatctgccaccccctccagatgacagatctttttctcagggcaccaagagggcccctcagatcccttttctccctgtgggaagttctgggtcaggagctggaaggaaggtggtttttctcttctcctgggcgtgaccagccttccctccaggtgccaacggtttctcccctgccctaggtccgaggctctttgccactggtccttgcaggcccagggaaagtgagccagacatttgcttctcctcgggtgtctcagctgctgacctgtccctctgccattctgtgtttgcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtgagtcctggggagctctgcaccccggggactgagaggagcatcctctcctgggagccgatggcactcggcctggtccctcccaacatgattctgataatggaagaccacgtcacccaaagcacttcagtcctggtctggcttctgcaggtctcaggctgtgcctcccatttctttcctcctcccactttttgtaagatgatcctggagaaaatgttgtatctgcaaataggaaatccacatgacaagtgcagatggccaatgggtggctttgaaaggtttccacctaaccaatcaaggcactgtaagtaaaacaaagagatgccatcatccacttctcacagtggtagtgattttttaaagaatggatccagggccagctggcaaggcctcggtaggatgaggatgctatgttttgggtgagaagtgtaacttgaacagccatcctgaaattttgtcacgagaaccttaaaactttgatcacttgttccatgtacacgaatctacatgaaggaagtatcaggtgaatgtaaggattgggaacgcccatcacctgtattcgtggcagcctgagtggttttctggaacaggtcagattgggtcactcccttactgtctgccacacacactgcagtctaagcggcttcccagggctccagcaccttcgtgatgggccctgggcacctctccaagctccccctgctcctcccctccacccaggccactccagcctctccctgttccacggccacctccttccactcacctcctgccctgtgacccattccactgtctggaaacttcccctgcctactccatactgcctctacgtatgtacccctgtgtacagcctcttatgaggcaggtttctgttgaaatgttacccgcaccactgccccccgcacccattctatccagagccttctcattctcccatccttctcagtccctgcactttatccctttattttcacagcacttcccaccacctaaagctacatgatcccccaggagcatgacagagaccctgagaccctggccttacaaccccatggccttatcatcccagggcctgcatcgtgcctgggagggactgctgcccagatccaaggccacctaaagctactggcctcacaaccccatggccttataaccccagggcctgcatcatgcttggcagggactgctgcccagatccaaggcttgcaaacctgtctctttaacattcagatgagctctgcctgagtctcctctgctctgtagagtaccagcaattaagagttaacttgctgagtagcagcaattaagaattaactctgggattctttgaaaacaggacaatgccatgtgcaaatctctttattctcctggatgaatgattaacgatagcaggagggaagacagcagagacattcttgccagaaatagatccacactcacccagccttccacagttccaagaaccaatcacatttcctaaaacaatattttctactatggactatattttagaaatggtactggcaagagttgcattttaatttattcctaatagccatttcaactacccctttatttttttgtaaaggccatgaatgaatatgcttttatcatgccttcaaaatcatcctcagagttttgagtcttaatctctctcatttgagcattttacctgttaccaatccagtggatggaaaatcattttatttttatttgtatcatttttttgagacaggggtctcactctgtcacccaggctggagtgcagtggcaccatcaccactcactgcagccttgacctcccaggctcaatcagtcctccttcctcagcctcctgggtagctgggacttcaggcatgcaccactacaggcatgagccatggtccagctctggaaaatcattttagatatgaaatactgccacaaaatggcaattggttatgcaaaatgggcacagagattgataactcacagtgagaaatgctttctctcagtgctccctgactaccagctccaggaaacatttcctctttaaggaaaggtgtcctagagggaggtgactcaaacctaacattattcgtggtgcagataacacctgaaggaagagccttctctaacaggccaggaagaggctgagtggactgctggggtggccacaaaccatatattttccctagaattattaccaagtcagtgatgagtcattctcattgctgagagctatcttgttaagaatgtatttatatcagtcttgtgacatcaataaccacagaataccattaaaatatcaggagttatgttttaaaagaatattccttgacagaacaacattaagtaaagaaaatgaggctgtacatcaatataaagcaaggctcctattttgtttaggaaaagaagaccctccctgagtaacaccctgagaggaggctgcacacggcagcgttcgcagagcttctctttaggtggtagtgttagcaatggcttttgtttgtacgtcttggtatttttcagattttctgcaagaggcatgtattgtttttaggactttgaaagccccgcgccccttacctatttacctctgtttaaatcggaaggtccaggttctccagggaaaggagcccccctgtttcctgcagtgtttccagggggggatggtggtgcactcggggaggcgggaagaggaagaagaaaatgtgcaaagtaagtcacttttactgctggaattcgactttgcctttccctctcttggaaagaatttttataagctgggggctgaaagtgagtctgtcttcatctagctgtggctcgacctctgaaagcctcctgatgtttgcctgataactcagctctatgggtgctcatgacccgcctctccctggagaatttactcggggattcacctttgcacgcaggaggctggaaggtggtctcccctcctctgtctgctgtttttaggaagaaagaaaaatcagtggctcttctatgataaattatgaaattttgtgttgaccagcaccccaccccccaaaaaaatcttagctctagagccttttaaaatatgcctgttatagaacttgttgtataaatcttgggaaaatggcttttctacattgtggacttcagatcacctgcttctaactatgtaagaacccactttttaggctggcaggaaggcctgatgcctcagtgctccacagggctccctgtgcagtgcctcagcccctccagtcccctaagtccctggccctggacggaggtggctgccttggacgacacagcggacactaggaagggccgcgtttgctgccactcgctcacgtgctaactcctccgcgccgccggtgccccctgcaggtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacagtgagtgttgtgtctgcggcgagtccccccacacaccgggcttcccagagggacggggcaggctcaggggtaccaagactcccagcagatcccagggtgctgaaagtgactgcagcaaaggatggctgggaacgtggtcaggggcctctgacattccgagcagagaggacacacatctcagtccagacctccgacttgggggccgctctgaggatttatctggctgggtgagaggctggtgaggagccagggagtgactcttggaagcactctgggttctttcttcatagttgccgttcagcttttggatgagaagcctgggggcctttgatatttaaagggagcacatttcaaatttgtggagttttcgtttgccagaacagcagagtgttaaaaagctaaagaagagtgtgggaaaccgccatctgtgtcagacgataagatatcccccattctggagagcagcccccgatggagagggatcggactctccgggcacttcccgggtacagcacttccgggttgggttttgttcccctcccaggcaggcacctgccgttggccacttgcaaagactcagcacactgtgagatagcactgagtggggaccttggggaagaggggaaccggaagggcagtgaaggccacagcccagggaggacgctgtggtggccggcccccccggtaaggtggtctgcctctgtggctctgcacttcctagcagcccaggcaaaataagcattgcaagctgccagagaagcccagtgtcgcccaggcattcaggaggcaactgagacctgtgaggacctcagtgaggaaaagtgaagagcttcctagggtcacatgtccccagagtttgatttggtgaaccccattctctgggttctggaacagagcagtggccagggcccctgtgtccactctgaaaacacactacccagagagggcagagaggagaacggggcaggtgacctctctacagggaggcagatgtgaaacaagatgtttcatctcaaaacaccacctgtgggctagggcacggggaggggtgagaaatcacatgccctgaggtggcccaaggcatttgaggcccatcagagggtttacttggaccactgaggaaaagaaaaacaatgaagagctcattcacatattcactcaacaaacatttattgagtacctgattggcgccaagcaatctggaattacaggacttatcctataaatctcggaaaaaatggtttttctgcatcatgaactttgggcaacctgcttctaactccaaaggactggagttaggaactggggacttggtggtgaataagcccaagtctctgtcctcatgaagttcatgttctagcaggagagaaagacaagaaatagtcaatatgtattgttctgtataaaaatgtgtgtaattttcatgacacattagatgtgattaaacatccctccctaggagcaagtcaacttcccctcctccaccacacacacttagagactgcagagcatttttccattcatgagtaagaattgcttttccttagaaagtagaagagacggtgaactgatctccagatttagttttgaataatttatggctgtaccccatatatatatgtacatgtatatatatatgtatatatatatacacctactattagtatatacccacaaattttaaatttaaaaaaagcagacaataacaagtatcggcaaggatgtgaaaattggaacccttacacattacttggaaaacagtctagcaatttctcaaaagatttaacaatacagttaccatatgactagcaactctactagatatctacccaagagaaatgaaaacacttgtacatgaaggttcatagccatattagtcatagtggccaaaagatggaaataacccaaatatctaccaacatattaatggatgaaaaaaattagtggaatattattctgccataaaaaagaattcagtattgatacatgctacaacatggatgcaccttaaaaacattacactaagtttaaaaactcagtcacaaaggaacatatattatataattccatctgtatgaaatgtccaaaacaggcaagtccataaatacaggagtagattagtggattctgaggactaaggatgggggaaatgcggagtgactgctaacgggtacagggcttcttcttccgggagatgaaaatgttctgaaattagtgatgacagttgcacaactctgtgaataaactgaaatctgtacacataaaaagagtgaattttatgacatgtgaattatatctcaataaagctattataaagctgttatcataatagtaataataattttgggtcaccagcactctccagacttataaagaactcttggagtttctcccttgcagatgtcccctggaagcaggactgcatagtagcagcaaagtcacaatacacgagtgtgatgaaggctccgagccactcggattctgggatgccttaggaaggagagacaggaaagcctacgattgcatgcttcaaggtaatgtggcatccacagtctgcgatctggtttttttgtttgtttttggaaacaagagtcttgctctgttatccaggctggagtatagtggtatgatcacagctcactgcagcttcaacctcctgggctcaagtgatcagcctgcctcagcctctcaaagtgcaggcttgagccactgtgccccattcatgttttatcttaattcttcagtctgtcttaaatctagtgtgatgagtattatgtccagctgattgaacagtttttttcttcccaggggtgagtttaacttggacaccaggacttcaaattctcactggcaaatcagctcccaaggcctcccggggaccaagccaccttccagggtcttagggactcagggcaccattttctttctttcctcatagctgccacctgagaaatagcagtcctctgggtgttggagtgcgatctggggaaggaagccggcctcttatcccctttccagagcccttcagtcattaacctatttggaaatacaaagatcgtgtctgtatagaacaggcactcccattcaccagagtgaggttaggtgtgtatatgtgtactttcccagctgttctaaaaatacagatgaacattagaaggaaagcgaacttttgttaagcagttccagtaagccagacaccagccagcaccttacatatagtaactccgttagtacaacccaacactctgccatttttacagatgaggaaactgaggcatacagaagttaatcaacttgcccaaggctgggcagcaatggagtatcctcataactgctccataatactctgcccctcaatgtttataaacttttatatagctttttaaacataatgcctagaaaacgtttgaaattatggagaagttaaaaaaagaaatgaagtcacttataaccacatttctcagaacagaattcacatttctctatgctatatataatatctattttaaaaaataatatgtggatctactgttttgtaaccttttttcctttataatgaataatttcccaagttattaaaatttagatttctaatggctgtgagatattctgttatactgtgaatatatgccactctctacctgacagtctctgacagctggggagttgagttgtttcttatttctgatttttctcccttatacaataatgcagtttgaatactttttaaaataatcctatacattcattcctaattgagaggaattcctagatgtggaaccgctgtgcttgtcataaaatctgatagcatgtatcagctcgggccaagtttcattctcacctgcaatacacagaagcgttcatttctcagcacaatcataaattcagcatattattttttcctctttgccaaattgatgaaaggagacagatagctaagcattgttttgttttacttagaagtacatatagatgtatatttatatacatgtataatgtatataaaatacaatatatgtatatttatgttatataacatatatgcatatttatgttacatatgtgtatgtgatatacacatacatatatctgtgtatagatatgcatatatacacagtatctatatatattttttagccattttaatttctactttggtgagtgttctatttgtgtcttttgcacattttattgatatttattttttccttatgtatgtcccttcatgtattaaggatattaactagttgctgtattacaaatatttcccatttgttacttggtttttcttttctttttaattttgcattgtttttcatttttatataattaatgcattattttcccttttgattggttcttttactattgcacttgaaaaggctttctccaccttgaagctcagataaatcctacctgtgtttccacagtgctttgaattatttcatattttacattcattcttcatctggaatttactttgatgcacatgatatcttcagctttgttctcttttctttcaaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccaggtaaggcctgcagggggcagctatgctgagcagtagaaggcacatcttccagaaagccttttgattttacgttggtatttattaagcagcttctgtttgccaagtacattcccagagcacccagaacatgtgcttacactcttttcatcctcacccctacaccaaaaggaaggagagtgaaatcagccacactttatagcataaggaacgagactcaagtcacttaacccacccaaagacgtcagctaagaacaggttgagcaccacagcggcaggcctggcgtctccgctcttttcccagccttcctctcagtcttgttgctgcatggtcacccgtcgactgccattgctccagccattatgtttgcattcaagatagaaagagaaagaagggggaaggaaaaaagcccacctaatagccactctctctctttaatcagataaagcacgtgttttcccagaagcccccagcagacttctgcttacatcccattggccggagcctgtcacatggccagccccagctgcaagggagcctggggaagcaaatggcagaggagaaggatgttggggtattggctaagttagccagggaacagggtctgccataccaagtctccacagcagagccaagactccagcccaggtcttctgatcccaaggtcagggctctgtgccctcattctggttgggaaagtaacaagagactgggcttgacaacccctcccacccaccctccaatgaagccaaggtcagctgcctctcagtttgtgtttgttgcttctcacattacaagagcctggagctgcagccagggacctcatcttgcaccgggatctcagggcagcactgaaagtttgcccagtgcacatgtcatgcttggaaaatcagccaccagtaagagagggtgtgcccacgcccttcatcctggggctcagggcgggttatcaacctccactgggcttttaaagtgtggttttcacagaatcctgaaatgcatgtcaggaaaggacttacagtgagccgactagcaagagtgagaggcattttgccacctggagtaagagtcagactgacaatttgaggaggagaaaaaggtaggaggaaaaggcagtagaacagttttgatttttatttccttttattttattttttagagacagggtcttactctgtcatccaggctggagtgcagtggcgcagtcatggctcactgcagcctctaactcttgggctcaagcgatcctctctccttagcttcctgagtagtggagactacatgcatgcagcaccatgcctcgctaattttttttttctttttgtagagatagggtctcatcatgtggcccaggctggtcttcaacctccgggctcaagcagtccttcctcctcagcctcccaaagcactgggattacaggcatgagccaccactcccggtggcagttttgctttttaaggcccatttctctgtaagagagccatgagctcacctcactgctaagcaatcgcgtgcagggcaggaacgccactgacctgtctgcagtgagatgtgcgctccagtgttgattgtgctctttggagatatgcggtgctaacagccccttgagtggcacatgcattatcccttccactcttagcacagccctgccagtatccagaagggccagggccttgagctggggcaaagggaggaggacctggaggacgaggaatgaaaaagaccaactccttgacaccacttctctctgcctacaggcttctccccgttgaactgtcaaagggctggggtatcctgggtttctctgtttgcccctttgcccctggtttgatggccaagggggtttccccctgtgacactgcagtcaagagggacaacatccactaggttgggggaggagtgagctagaagtgtccgtgaaggagctcctgatggtctggccctgtccctgccctcacagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggtgaggctccctctaacatgcctgcagcacggaacagatggggaagcccctcaggcatgcgcagccaggagacccccttccccttctgtgcatgtcagccagcatccatccataaagcctggcaggtggtgatgaaaccaattttttcccctttaactttttgagatgtattaagttttagattagcgcattctcagctgccagcatgaagaagaactagtttttctctctgatattatgaggctaacttgttaccctcaaggataaaggctgtattgtggaatgccccaggcagattaaaaccccgctgtactcggggttgatcatgctgagagacaagttggcctctgccctgtacattatctgcaagcactaccacgctgttggagaatggaggtctcccccaaacagtgaacggccattgccaacctttttattattcattattatttttagtattatatccaaagagaaatacccatagtaagttcatggttctttactatacacatgaaatttctagtcttttatataaaatgaaaatgccagtaattaatcttatttaatttttatggtttcattgacacaactagtttaatgtcactgagtatgtgcaatggattctcttcctgaaaaactctttagcaataaataacatatgaaaccttccactcaatgttatagtgaatgtggatgtataagatgctgtcgttcgccgtcagtcattatgggagttaatcctgtgctaggaaatgagacggatgactctacaggtgaattcaggaggaagaaaatgctccacccagaagctgcagacagagcctctctctcccttccaggaatacacagcgttttgttaggttcaagaagtatagactcaggttgattataggtcactatggtagtcacaggcatgaaactaacaaacatcttatataaacattatccatgtgttgttatgaactactggtaacttgcattttaagcatgaagtcatgagttctggcaaagaagaaaagatttcaagggaaatcagagaaagacagggtctccctggggtctactgacattgcaatctgtgtaactacaggaaaaaatctcaagaaaccagcccccaagtcttaccttatccacgctggtctggagcccctgacattcaccaatatgtttcccagctgggagcacagagaggacatcgctgagatcacagagatggtgagcacgctttcctgccctatgaaggtggctcctgcgccttttggattgtgggttaactttactttggggagagcatccaattgcactttcagagtgggaaaatatttttccttttgcaacatcttaacaaacctacatagaatttgcttaggaagaagagaagtctaatggaaaatcaattaactattttagtaattttctacacgatacccaaattttaaaaacttaaaagcaaaggtgagttgaatcatgctgaggactatatatgtacataaaagctgcgaactcttcattctgtttgctaagaacctgttgcttggcattgcttgtctctcagtgtccatgtgacgcacaaccaaaccctcatgtttcagatgttaaccttgtgtagaggagacacaaacgaaatctgatgaattagtatgttcagaaaactgaatgaatggaggtgctgcgactcccttatgataagggatcactcaacatctcattaatattgtcttttatgagaccacctggtatttctgcatgaggcatttatcataacttctatccaccaaaatatattataatctagaatgttttcttttccaaccacacaggaaagaattttattatagctatgttgaatttcttatatatgagctattaacattgctaggaatagcaaatccaaggatttgttttgatttggtgagagataggttttttaccattttgatttttttttaccatgtgagagctgctttgcttggggaaacgacccaagtgtattttataggaaattcgagtaattttaaacaaacagaatctacttctgcttagcaatggagagggcctgttgggtagtacagacatcactgctcaccctaacctgtctccctggagccaaatggacttgatgtacacagggaaggggctgacttcagcttggtgtctgccgcagccggaacgagatgtttctgttcactgcaactgtggtttcgtgaaaccagaaggctctagggattacgagctctatggctgctgcatgcagtctaagttcaggagttaccaaattgccaggggttcagtccagggcttattgctcactacacagaagaaagccaatcactgagacaagcatagccaaggaagaaagtttatttgggtgctacagccaaggggaacaggacataagtctcaaatctgtgtctctggcctactaaaattagggatttttatagcagggaagaaatgtaaccatgtgtgggaaacaggaattagggaggggtgaggaagaggagctggtcaacaggaagcggggggttggttaggcatcatggtgggtaaggggtctggtaagcttcaggttttgtttttgttttttgagacagggtcttgctctgttgcccaggctggagtgcagtggtgtaatcacagctcactgcagcctccagctccaggctcagacaatcctcccacatcagcctcccaggtagctgggactacaagcacacaccataatgcctggctaatttgttttgtattttcaatgaggttttgccatgtctctcagtctggtcttgaactcctgagctcaagccatctgcccacctcagcctctcaaagtgctgggattacaagcatgagccactgctggctttttgatactattggagatgcctgatggttggtttcctgagaaaggaactcagataagacaaatataactttctcgaatttcaagactaggagagttaatttcgacgtttattccaaagaaatcataaacatcagttctgtggcacagttgagccactttcagaaggatataactcaccatcctccctgtgtattcactatagatcttgggggttagcagcggggccatttactgttgtgcaggcctgtgggattccagccggagaagagtcaggcttcccacaccagcaagttatacaaataattaacattcagcaagtgcccactctgcactaggcacatctccaagcactttacactgattttctcatttatcacaacagtccatcaagatatcttattattattcccattttactggtgtgggagcagagacacaaaaacacgaagtcacttggccaaagtgactttcagtgagtggaggagtcagtactcagacgcaggcaagatcatccaaaattcgcctcttctttttttagagaaaggatcttgctttgtcacccaggctgcagtgtggtgactcaatcatggctcacacaaaccttgaacccctgggctcaaacgaccctaccacctcagccaccccaagtaggtaggactacaggtgcacacttccatgcctagcctatttttgtattctttatagagacagggtctcatcatattgcccaagctggtctccaactcctggattcaaggactcttcccacctcagcctcctacagtgttgagattacaggcacaagtcactgcacccagcccaaaacctgcctcttgaccaccagtctgttccatgtatttctaatatgagcaacagctcttagtcatgcattcccaccatccacccacccaaaaggagagcagccaatctggggtcccaagtttaatggaggaagagaatttacccagaatagtttgttcatattcacacagtggttttaaaaacaaaaaaattgattctgctccagaatattctaggtgcattttctgaccttctttttctattgcagattaagaaatggggccaggggagggaaggggggtgtgatttcttttcaggttattttttaatatttatttttaaacaaattccattatttggaggcttctggtgtttagacttcaaatctactaatcttagtccataattcactcatgggacagtccctaaacatttttccagagacagttctgagacagggtttgtttaaaactctgtgacaaggtgagaaaagatctataagtcagagaaacaagactccatcatctctacaaaaaaaatttttaaattattaggtgcgcgtggtggcacatgccaatagtgccagctactcaggaggcttgaggtgggaggactgcttgagtccaggagtttaaggctgcagagagctatgattgagccactgccctccagcctgggttacagtgagacactgtctctaaaaaataacaaaatttggggtcaagtgtggtggttcacacctgtaatcccagcaggaggatcgcttgaggccagaagtttgagaccagcctaagcagtatagcaagacccagtctctacaaaaaaaaaaaaaaaaatggaaaaggaaaaataaattagccaggcctggtgatgcatactcatagtcccagttactcaggaggctgaggcaggaggatcacttgagcccaggagctggaggctgcagtgagctatgattgcaccactgcactccagcctgagtagcagagtgagaccttgtctcaaaaaataccattttttaatttaaaatttaaaaattttaaaaattaaaagtccagacaactgcagggctttgggcgatcccttttctttcagagccatttcctcctcagtgatatggaactatgcatcctcaggcagtatgcaggtggcacagggctgtgtgtctgtaagcacttaataaaacaagttcaaatgtaggacacgagctctcctctctgccccctcctcttctctaggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgaggtaagcggttcttccggtggggtggggatgggagtaaaacaacacacgcacgcccggctcctttcactgagccgcggggcgcttctcccaatgtttccagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggttcacattgaattccaagcatgttcctttctggaattttttttttttttggtaaatattaacatagcaccaaattttgtaattaagtataaatgactatacatttgaatttagtttagggcaagattttatacaaggtcataagattaaatacagagttatttgccccataaaattagtactcagtactataatgaagacatacttttgcaaatcatcattcagcagaagttctttatcccacagctatatctatctacaatttcaattttaggatctcaatgccctttaaaaaattgtatgggccaggcgaggtggcccacacctgtaatcccggcactctgggaggctgaggcaggcggatcacctgagaccaggagttcaacagcagcctggccaacatgttgaaacccagtctctactaaaaatacaaaaattaggcatggtggcacatgcctgtaatcccagctactcaagaggctgaagaaggagaatcatttgaaactgggaggcggaggttgcagtgagccaagatcgcgccattgcactacagcctgggtgacaagagtgggactccatttcaaaaaaaaaaaaattatatggataagacatctagaaaacttaaaaaatgagttagaaaactcctcacaagctcccatgttcttaaatccatggttttgtgaacatattctacagacctactctgaattgtcatagcccttccccactccctgttagtctaatttaacacatccagtcacagcacatttgcctgaaacttcaggacttacaggccccatcctgggaccgcaccagggtagaaacctataacctgctcctggtctcaccattttatgatttttatgatattgggtcatcactgaacttttctaccttgatttcctttaaaaggagacactcctagctatcctgcctgcatcacaagattccgagcaaggaactagtggaagctctttgaaaatcgccaagtgctagatacctgccagtattaagattattgtgatggtagttaaaatgggaaagcaggggggttaagttagggagtgttgtcatgcacctagaaatgatggattaaatcaaagcaaggagacgaaaaagaagagaggttcaaagtccatgttccatagataacacgcaagaggtatggagaaaggttcctagagtcactagggcaacctgagggtcagaaagaggcaggattgcaacctctgcagcaggttccagatatcacctgaatctttagatacccaggaaggagcttgagttgctacaggaactaccagtggagagccgctgtaatgaataaataagacagatgtcctcattaatattcattaacaccagattttcccaaagtcctttaaaactgtgtctatccacttgtattaaacattggcaaccaggtgcggtggctcatgcctgtaatcccagcactttgggaggccaaggcaggtggatcacttgaggtcaggagtttgagaccagcctgaccaacatggcaaaaccctgtctctactaaaaatacaaaaattagctgggtgtggtggcgcacacctgtaatcccagctacttgggaggctgaggcatgagaatcgcttgagcctgggaggccgatgttgcagtgagccgagattgcaccactacactccagcctgggcaatacagtgagactctgtctcaaaaaaaacacaaaaaaacaaaaaccactgtcccccgacaaaacgtgctgtctgtctgcttctcgccacttcttggtgaataagacaccccagcttggagagccagtatactttttgcctcttttcctctaaattgtttcctgcatctctttcctgcttatagaaccagatcctattttccatggttttttctgatccttttccttccataactgcaaactttgacctttgtacactgggaagggacctagctgaaacacttgaattgctaaaccttaaagtctcagcccaggaattgacactggtgcttggggcttttctccacagtcatccaaactcaaacccccgctctcactaaatgcatcaggggcagggaagtgcgatgtcctgaatttgctgtccttgaactaagagactcaagagaggggtgggtgtttggattgagatcgatatcagaggtgccgcggggcagatgggatgttgagcgtgttctgtagctttggatgaactgtgcgaatatgagccacttctagagtgggacaatcctgcctctttgttcccaaatccgaggaggggaaaggctgctgtgagcccacttctttctctcctactttacatttcctgccctgctattagaattcccattttggtaaaaggaaacgtattccagaaacagttccagaattcattttggtcctttggttttgttttttttattataaaattagccgtgtgtgtccactcagaaacctggacacagatgttcatagtggcattattcataatagcccagacctgtaaacaatccacatgaccgtcaactgagaaacagaaaaacaaaatgcaggacctccatgcgatggcgtcctccccgacagcaaagggacagatattcctgcgtatacatgacgtacacctgatactcactacaacatgcatacgcctcaaaagcattaagtgaaagaagccagatgcaaaaggccacatattgtttgattctttttatatgaaacttcccataaaggcaaatctgtgcaaacagcaagatcaacagtagctgaggttggagatgggagtggtggttaactgcaaatggcatgaatgatctttttggagtaatggaaatgtctcaaaactggattgtggtgatgattgcacaactctataaaggtattaaagatttttgaggccagacaccatggctcactcttggaatcccaacactttagaaggcgaggctggaggatcgttgggcctaggtgttcaagaccagcataggcaacatagtgagatcccatttgtacaaaaatttttaaatcagccaggtgtgttggtgcgtgcttgtagtcccagccacttgggaggctgaggagggaggatcccttgagcccaggagttcgagtctgcagtgagttgtgatcatactactgcactccaacctggtgacaaagtgagaccttgtctctaaaaaataaaaaaataataattaaagaaattattgttcacttacatgagcgtattttatggcatatattattatatacatacatacacaaacacattttatatatatatgtaaaatatcacaaaaaagcagtttaaaaaatagtaacacctgatctacgtaaaaaatgcaatcactacaaagatatataatctaggaatcaaaaatcataaataataccactaaccaaatacaagtactttaataatctgatttatattcttctggatttttctttacatctactagcatagatgtgtatgctcacattaaaaaaggaaaaaaactggcacatccctgtagtttcggctacttgggaggctgaggcaggaggattactggagcccaggaggtagaggctgcagtgagccatgattgcgccactacactccagcctgggtgacggagcaagaccctatattaaaaatatataaacaaaaactgtttttgttctgcatcttaaattttttgttagcaataagttgcagacactggtccttggaggtttatttatgggtgtgtgatgttctgagatcacagaaggcccagtgtgaagacctaaatcagcgatggtcctgagccccaatcccactgacctcccaccaccgtcctcagccatcacaggactttcttgatctgagatctaggtaaggcacagaagtctcaaaacagacctctgtgcaaagcctttctgaactagcgtagcgactagtaacaggcgacaataaccaagaagtcaataaagagtttggtgcgaggccaggtgaggtggctcacgcctctaattccagtgctttgagaggccaaggagggaggatcccttgaggccaagaggtcaagatcagcttaggcaacatagtgacatcctacctgtacaaaaaatttaaaaatcagctgataatggtggggacatggctttagtttcagctactctgaaaggtgagatggaaggatcacttggacccaggaagcagaggctgcagtgagctattatcctgccattgcacccagcaacagagcaataccctgtctcttaaaaaaaaaaaaaaaaaaaaaagtacagtgctctgttttcagaaatatcaaggtaattcaaatgcaaataactgaaaattaactatattggtagggcatttggcccaaagaagccttcctctttttgaaaagaaaatacattgcattgcatgcatttgctcttctccccagagaaaggatgttgggctgcttcagacctctgacaatggatgcacccccaggattagatcagaaagatggacctgccaggggaaagcatcagaggcttctgttcctaccatcagtaccatggatgcgctgcgagtgtggagtctgtatggaaatgccccactgatttcacagtgtctaaagctgatccttgaggactaatagagaagaaagatgaacagaccagtatcccttgtttctaatactgaactggcctttactgagcttttctgtcgcgcagctgagattgaaaaggaagccacaggagcagaagcgaatgcaagctaacagaaagaaagggagcgcggaggatgccacagccccagcgccctcccagcctcagcagagctgtggggattgttcttcacatctgacgccatggggttctggaagtctcttaagggatatattggaactgacttgtattatttggaaattgacataaattgtctattattaaatctcactgaattaagcccaaatttaccatctgaacaccgttttagcattcatcctgaaatggctggaacacgagttgttagctccataagggtaaataaatattagctgggcgcagtggctcatgcctgcaattccagcactctgggaggccaaagtgggaggacagattgagcccaggaatttcagatcagcctgagcaacatgatgagaccctgtttctacaaaaaattaaaccattagccaggtgtggtggcatgtccctgtagtcccaggtactcaggaggctgagctgggaggactgctggagctcaggaggttgaggctgcagtgagctgtgattgcaccactgcattccagcctggatgacagtgagaccctgtctcaaaaaaaaaaagaaatattgagaaacgactgaccaagagcccatatggaagcaaagaaaaataaaacaagcccaatgtttagtagtggtttctgcagatggaagacagcaaacgggggaagagtgcatttgggattgcaagacttggttagtgtcagagcccgtcctaaaagacaacgatgcagcaggaccctacctgtccttatgacttcctttcatcctccaggctcaccctccatgcttcccttcctgaaggaggccattcattattaaaaacaggaactgcaaagatccagcagggagcatcgtttgccaatgacacttgaggtcccagtggggaagactttttttttttggtcagatggggtctttccccagattcacatacagttatcaccacagccacagcatctgctgaagtctatttctagtatcatgttgcacattccagagccctcattatttgcagtggtccgcattcattcatgaatacttatatttactacttgttcattcaaatatttattgagtgggtgcttagcttaagggtcaacagaacacaaatacgccttatatctaggctctgatgccccaaggggcctgcattccaggagaggtgaaaataatgataattcaccaagaagcacaaataatgatgcagggtcagacatggtggctcacactgtaatcccagcactttgggaggccaacgcaagaggatggcttgagctcaggagtttgagaccagtctgggcaacacagtgagaccccatctctataaaaatatttaaaaattagccagtcatagtgggcacacctgtagtcccagctacttgggagactgaggtgggaggatcacttgagcccaggaattcaagactgcagtgagctatgattgtaccactgtactcaagcctggaccacacagtgagaccttgtctctaaaaataataataataatagcagtgcaacaagaatctgttctgggtgaaattgtgccccactttttcctcctcacccactcccccaaaaagattggagttctaacccctagtacctcagaatgtgaccttatttggagatccttgggtaattaagttaaatgaggttttcagggtaggcctaatccaatctgactactgtctttatatgaaggggaaattgggaagtggcggcaggcatgcacagagggaagaccgtgtgcagatgcacggggagaagacggccctctgcaagcccagaagagaggccttagaagaaaccaaccctacccacaccttgatctcagacttccgccctcccgagctgcgagacgataaaggttctgttgtttaagcagcccagtttgtggtactttgtcacaacagcccaaggaaactaatcatgtccaaaggagggacttctggctggaggtgggagggaggggaaggaatcagggtggcttccgggaggaggtgtcctctgaatcagcctcgaaggactggcaggatttctcactgcaactggacatcagttctccagccatcagctccaaagagaagatctggaaggaggagagggaaaggagaggcacacccagtctcctacgtgtggcacaggcaggataagggcatagcaagtagagcctcaaggctgaggtgagggtgcacagaaggaaagtggacttggacatggacgggccaggggaacccggctaaggggctcttcagatgtggggatgacccggcaacagcacctgcgactgattcctctggtccgcaggatccccaggcctagtgcgtccctttctcatggggcccggggtgtttccagggctggggctggtttcatagtatcctgcgccctgcgctagcacttctatcttggatcttgatgttgaaaccattagaggtgctgactctgttacattctcctctcatctgatcctcatgtaaagatatttctgaaatctccagcaagcaatatggtacgtggaaaatggcggacttgcgtttcccacacagtaatgccgtttctcggtagacatcagtgaccatgaggcagctctaccaaatgctgctctgatcttataagctgctcaggaaaaggaaattgttctgttgcattgaaaatatcgaaagttttggaatcttatcttgctattttaaagtattaatctttttagattttgactcttaaaaaatatttgaatggccctgggagatagattggtcatgtcataaacaaaagaccaaggcatacgaaagttacgggactcggctaagataacagagctgggtggggcaaggctctttaaggacggcacccagatgtggtggtccgcattcccctgtacctgattgttgttgaataatggaggtaaactgaggcccaaggtcacctcctgcttcagggagggctttaggtaagggcgggagaggaatcgcaggccccgcccgaacaggctgctttctctgcatgatttcatcacatcctcgcaggcagccccgagaagcacctgctgtgccctttactgaggagggtctccaacattcagttcttcctcattctcccatcgctggtaagagacccattccagtggaagctgaggaacgagacctgcctgggaatgagacctttcttcatgaacactaattttatccaggggtgatagggttagggggagatgtttgctgttaatatccgaatgtctctctaacagatttctatcaggtttgatataacctgtcagctgcctccctccagctggagaagccaggaaaggaaatgcagggactggccagggaaggaaatactgaagcgacaaaggagaaacctttgcatctggcgaggggcagccgcgctgagggaaggctatggccagcaggtggcgctgttgctcacagcagaagccaaggctccaactccagcgccgcctccggcttcacagtcctaggatctgcagaggaagcctctgctcttaggcacagaactgggccaagaccttcccctaaagaccccaggggccaactccagctccgtccggctcatttgtttccagttcaaggaacctgaactctacgatgggctgacctgggaatgttcccattgccctgatgcaagcagtgataaattgtgcagtgacatgaacgtgcccaagggctgggggagtctgcgaaccacagttcctcttagccaggcttccctccgcctgcatgcacacgctttttaatttttgttttattttgtggcttctttaaagctcttccctttgccagttttgccatctgtagaatgaaggtgataccttcctttggctcaattagttaatgttaggaaagctctctgcagatgaaaagcactaaattctattgatcaaatatttaattagccacacttgcggatgattcataatcatctattcaacttcctgaattgccaagcagagaaaatggcatgattagaaatataattttaaataccggttttcagagattttgtacctgtcaaggctatgagagaatttctgaattagcataccagttcctccccgattttccaagggcctgaagaaaccagctcccttcccactcagcctgtggctgtggccatgactgccctcctctacccgcacctggcctggggagtaactcagccgcagggcctcaatggcagcgtgcagagggttggaccgcagtgccaggacctccccagcacggggctgcctctcagccctggcaggccacagcacctcttctgcctagggcagtaccttcatggtctgtcacatgcctgccccttttctgccctggtagggactcagtgaggagaaactaggtcatgtaggagacacggacacattcaaaagcaagacacccaagcagctcgagtgtaaggagatttccaggcatttccagttgctttgaagcacagtcagcaacatggcctggtttgtcttcagctctgggttccaacccaaccaagactgcaggttctggttgtgcatgtggcctctgaaagcaaaataggctttttcttattcattcattctgcaaatattagtgtaaatgctatgctagatatgcaggctaaactggtacagacgattatctttgactttctggcaaaacgtaattttcaaaaagtgaaaaaaacaaaaccatcatacagatagatgggaagcacgtgtcatttggggtcctcaggaagcaggtgtcaagacagagctagacgtgaaagacatttattgggaggaacactttttgcagataagaacagtggcagcaggaggcagggagggttttgggagggtgctgcaaggctgacccctaggaaaggagaggggaaggagggagaatggggaggaaagagcctctgagtgaggggcagctctgagaaggtctgaccagcccccagggagccccagggcagaacttgatccttagaggaaataggcagaaatggccaggtcctaggcctccctcctgggctctgtcactggctgggcctgaccttggcatgaaaggtatactgcagtggtccccatcttttttggcaccagggaccggtttcatggaacacaatttttccacgaacaggggcgggttagggggatggcttggggatgaaattgttccatctcagatcattaggcattagattatcataaggagtgtgcaacctagatctctggaacgtgcagtgcacaatagcgtttgcgctcctatgagaat

SEQ ID NO: 959 - DNA, 7025 bp, Homo sapiens
cactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaagatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgtgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtgcacttcacattcagaaacgccaactgtcgatggcaaatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagctggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacacgtgcagaccaggctggtggaacctcgagcttcggcgctcaatagtggggactgcttcctcctgctctctccccactgctgcttcctgtgggtaggagagttcgcaaacgccatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgccttttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacagtacacatgtcattttgtgatataggactcccaaataaaagtatcagaataaacacaacaattaactggt

SEQ ID NO: 960 - protein, 1578 aa, Homo sapiens
VPPGRPMTCPQQPRVPRPSLSLGETPPSLKCHGPPSTPTAPPCSRQPPGAPPLVTHSYPLRPDPGALHIQKRQLSMANEEKVDERAKLSVAAKRLLFREMEKSFDEQNVPKRRSRNTAVEQRLRRLQDRSLTQPITTEEVVIAATLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASAICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANAIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 961 - DNA, 33259 bp, Mus musculus
  misc_feature (1)...(33259): n = A,T,C or G
ctctctctctctctctctctctcacccccccccacacacacacacacacaggatctcaccatgtagctctggctggcctagaactcagagactcactgttctctgcctcccagtgctgggattaaaggcctgaaacaccaggcctaatccaaatcattttactcatctagatttctggaagcaaaagtctaaatattaccctaatttaaggtcattaaaaaaaaacagatttattcccagcactcgggaggcagaggcaggcagatttctgagttcaaggacagcctggtctacaaagtgagttccaggacagccagggctatacagagaaaccctgtctcaaaaaaaaaaaaaaaaaaaagatttatttattataagtacattataagtacactgtagctgtttttagacacaccagaaaagtgcattagatctcattatgggtagttgtgagccaccatgtggttgctgggaattgaactcaggaccttccgaggagctgtcagtgctcttacctgctgagccatcttgccagccctaggccatttttaaccaccccatatgcctgagtatgaaaagttttggagctagagaaatggctcaggagtcaagaacactaactgcttttccagaggacccaagttttcagtggcttacaaactgtctggaactccaattccaggagagccaatgacctcttctgggcttcttgggtaccaggtgggcatgcctttgatctcagcactcaggaggcagagccaggcagatctctgagttcaaggctatcctggtctatagatcgaattccaggacagccagagctacatagagaaactttgtctcgaaaaacaaggccataggcaaacatgcaggcaaaatgttcatacatgtaaataactaaataaacattaaagccccttttaagttagactatgtcttgttgagcttacagccaattactcctaggggagagagctattacggcgcttcttatcctcgacagacttaaccaacacctggcactcggctgacacttgggctccgtgcataaactattttgagcaaacagctgttgagcagcttggggcgtttcaccccgagtttgttgaacaggcaacttctttctgccaggtgcagatataaggcaggcaaaatggccacgtctgagccttgtaactcatgcctgtgattacctatgaaaacacactctttaaaggacagttcagaggggctggagaggtggctcagtggttaagagcactgattgctcttctagaggagctgagttcaattcccaacaaccacatggtggctcacaaccatctgtaatgaaatccaatgccctcttctggtgtgtctcaagacaaccacagtgtactcttatatataaaataaataaatctttaaaaaaaaaaaaaaaaggacagttcacagccagtacatgcaatgcacaaagccctgggtttgatccccagtaccccaaaacataaaggatgactttatttcagtcagatgggaaacactggctacacaggagtatgacctgagcccaggaatttcacataatttcacatatatgtgtcgactgtagagagatcccgtgttaaagactcttaatgcttgagcttgcccagcaaatgctctcccactgacctgcatctctggctcccttggctgctgtttgaagggagcatggataacctgtgctaatagtaacacacatcgtgcccagtgactgagtgattgaaggagacccccgtccaccgccctggttccacctttcctttctgttagatgatcatgcagacaatcttgtatcccctcccagtctgactccagcaaggttgaactccgatgatcttttcccatcactggctgggtctctcctgtatgtaaatgtatgctccctcgctttctcatgacctaggaagctcattttagactggacagtgtaggggagaccgattacttcggagtttggatcaggatgtggttggttgtactggccagccatgtcgccctaggcctttaatcccagcacttgggaaatagaggctggctgatctctgtgagtttgaggtaacactggtcattggtttacatgaagaattccaggccagtcagtcaatgtcccaagagagggggggaaaaaaaacccaaagaaaaaaatacaaacaatcaaacaaaaccaccaccaacaccaacaaaaaacagtcacgcccccaccccaaccccctaaagtccgaatccttctgcctgagcctgggactacaggtgtaaaagtcaagatgggagcagggcagtgggtggcacagacctttactttttttttttttttttcgagacagggtttctctgtatagccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggggaggcagaggcaggtggatttctgagttcgaggccgcctggtctacagaatgaattccaggacagccagggctacacagagaaaccctgtctcaacccctccctcccaaaaaaagtcaagctgtggcaaaggacacttcagacttgatatagccagaagtgcccacactgtgtctgatctccctcaatgtcttcttagttcctcctccaccaccctgcagtggtatcataccattcaaccatcaacaagaatcttgttaggtcagttcagcctgtttgatataacctagactcacccgagaagggtgtctcaactgagaaattccttagatcagataggcttgtggcatgtcggtgggaagttatctttattgataactggtatgggaggatccggcccactgtgggcggcaccatcccctaggcaggtggtcctgggctctataggaaagcatgatcctgagtgagccagcaagcactctcctccatgagcgctgctataccttcttagctgtgaatgagttcattgatcagaggtaatgttgggtggaatggcaagcaggcttgctttcaagttcctgacttgacttctctcagtgatggactgtgatctctaagctgacatgaacccttcttccctaagctgcataatagtttctcttgctagttcccctctactgaccaccccctaccctgcaggaccaactgtcaaagcagtccctagctccaccacagttgtctgccttttcattcaaaaattattggatgtttgtttttatataacaataaaatgtattcataatgctctcgtttgatgctctttgtccctgaaaggatagcatgtctgtgtggccttatgaggcagaggtctaatgggaaacaattaagtcatttattggggtgtaatcaatgaagagataagactacttctcagggcccggcagtggtgacacaggcctttaatcccatcacatgggaggcagaggcaggcagatttctgcagagtgagttccaggacagccagggctacacagaaaaaccctgaccctgtctcgaaaaacaaacaaacaaacaaacaaacaaaagactacgtctcagggaatgtgggtttgttcccaagaaattaaggtgttagggaaagaacgtccctacccttcctcactcttttccttcctgcttcctgtctggtcactctcatgtgctgcctgccattggatgccttctatcacgcagccttctttaagggcctgccctgatagtgttgtccaattttggaccttcagactccaaaactggattcctcttcctgacttcctcctcctcctttctcttgggatctcatgtatcccaggccaccccccaaactcattctgtagcccaggataaccttgaagttcagatcctcgcccccacccccttgcttttttttccctttgagacagaaattcacctgcctctgcctcccaagtgctgggattaaagtcgtgtgccaccatgcccatctgcgtcaccacgcccggtcccttacctcttaaatgctgttataaatgcacaagccaccagacatggatttgtacaactctgctgggaaccaaacccagggcttcatttgtgttaagaccagtactctgctaaccgatttgcatctcaaggctagtaagcctcattataagtaaccagcttagggcattttgttatagcagcagaaagaggactagtactctttttccttttttctcttttggtttttcgagacagggtttctctcctgagtgctgggagtaaaggcgtgcgacaccacgcctggcatggactaatactcttaagcatggctttacaaatgttgttgaggctggagaagcctctcatcagctaagagcacttccagagggcccagcttccattctcagcatccacgtgaggctcataaccatctgtaacttcagttccaggagatctgatgccttcttctgctctccatgaacctcaggtacacatagccaggtgtggtggtacatgcctttaatcccagcatttgggaggcaggggcaggtcccaacgtgatctaaagaactagttccaggacagcgagggctacagagggaaaccttgtctctgaatacaaaacaagcaaacaaaagaaggcattagccccacgtggtgatgtgcacctataagtgtagcactgagaaaactgatgcaggggggattgagagttggagaccagcctgggctaagtagaaacaaaacaaagcttaagcaaaacaagagggccagagccacagaggtgttgtgttgataacgactggactcggtatcctgagctgttacactgggctggccttgccacatggccgtgcctgtgcttctgcaagcagagacaagttcaaagtgctgacgcctacagaagccttgcctcacagaacaggtcagaggcacccacacaggcgtttcctcacactctggcgcccactggcactggcatgtgcttgtttttctaaagctgtcatcacctccagagcgggtctgcacagccttggatcctgtcaatcattcactcactcacacagcatttacctgattcgtacaaggccagccgagagaatgaagcctgtattggagcctagggtttgcagggacaaggccttcctgttgcataaaggaagctataaaggcccagagtgtagttctctggaagagcgctggctttccatccgcagcactgggggacggggggagatggataggaactatatgatagtcagtttcttctattgaacattccattgaagtaaactgggggacagcggtggaaggaagtcataggtttgaagaaaaagtatatcagagctctgatttgaacacactttccttccaggctgctgtctgcttggtcattgcccaggccaacatctgtgcacctcagacatttggtatgtgtgacatcaccttgcccttgggttgctgaggcgatcacccacacttagcttaaactctgttcaaaatgactgtccagatggacatggtcagacacagaacgtggactaggattggctgcctgggctgctctgcccggaacacccagccagcatggctgcttgttccctgcttgctgctttccaactacaggctcattcccctgtgtcctctgaacccactgttccagtgggccctggggtgggtattttgcttttgttttttgtaaaacacacacacacacacacacacacacacacatctaaatgttgacaagaagcaccttgagggtaacttcctttctaaatttatttttaattttttaatttttaatttttttttaggttttttttttgagacagggtttctctgtgtagccctggctgtcctggaactcactctgtagaccaggctggcctggaactcagaaatccgcctgcctctgcctcccaagtgctgggattaaaggcatgcgccaccactgcccagctttaatttatttttatgtatatggttttgtctgtgtgatagtttgtatgtgcttggcccagggagtgacactattaggaggcttggccttgttggagtaggtgtgtcactgtgggagtgggcttaagaccctcatcctagctgcctggaagtcagtattctgctagcagcctttgaaagaacctagtggggaaacccccactcaatttctgttcggagcgcacccaagaatcacgaacagacaaccatcttgatgtaaaacatgaggtagtttaatgacggagctccgggctgacacatatctcccgcaggagacagaggtgttgaccacatggtggagccataatggcggagctctggttcgaaacgtatctcacgcaggagacagtggtttcgaccctgaggcttggaagctaggggtttttatagaaaaggggtggggcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgctgggattaaaggtgtgtgccaccactgcccagctcacccagttcttattgatttacttaaacaaaataccaagtgtcacatacgtaacacctgtttgtgttttttttttcttccacatttattttgtgtgtgtgtgcgcatgtgtgcaggacactactgtggcagtcagaggacaactgttaggagtcagctctcgattaatctcagtttgttcagcttgctagctgatgccttcaccagctgagccatcttaccctcacaccccctgcgcgatttctttctttccttagaattaaggagagaatgactccttagcaggcttgctggtgctttgcctttctctatagctccatattaaagtctttgtaatgcattacaaagtttaaaaaaaaaaaaaaacaaactaggatgtcacaacaggcagtggtggctcacacatgcctttaatcccagcactagggaggcagaggcaggtggatttctgagtttgaggccagcctggtctacagagtgagttccaagaaagccagggctacacagagaaaccctgtctcgaaaaacagaaaaaaaagaaagaaagaaagaaagaaagaaagaaagaaagaaagaaagaaagagagaaaagactactgtttcctgagaattcccaaccccaaacatttcttttgtcttttcttctcatcttgtatttatgtatttgttcttgtgtgtgtgcatgttcttatgtgtgtgcatgttcttgtgtgtgtgcatttgttcttgtgtgtgcatgtgcatgcggctgccttagagctccagaagggagccaatggaatctggagttacaggtaactgtcagcctctggatgatgcgggaggcaagaaccaaaccaggctgctctgcaagacagcaccggctctttccttctgaaacgtctctgtagacctcaagacatttcttaaccatatgtatatgtatatgtatatgtgtgtgtgtgtgtatgtatatgatgtatatgtatatatgtatatgtgtaatgtatatatatagtatttatataaatacaaaatattattttgtatatatacacaaaattatacaatatatatatatatatatatatatatatatatatatatatatatatataattgtgtaatcccaggatatgagaggtagagacagttgaaagccaacctgggctgcataagttctggatcagcctgggctaaggaatgaaaccaaaacaacacaacaacaacaacatacaaagcaaactaaaatcactctgaataggacagccaaaggccaggtgttggggggcgggggtccttgcaatgacaaacctggggtggggcaggtgggcatgaatggggagcctcgacttggctcattgaccatccaggggctgaagtccagatctgggcaggtggagaaacccttggggctttggggccctctcagcctctttgatcccagtgtgtccctgccctttgaacgctgcaactgagggctggcacactgtcctggttgggctcctcaataggcggcatgctgaggctgctgaggtccagctgggcccgcggcttggggtctggggtggccacttggcgtccctcagcggggctctttcgtcctgggtgccctgggatccgccaggcttcaggtgcctcagataccccacaccaccagtcccccagctctgagtcaccggtacagccggtgggggtgggtgtctgttccatgatgcgcctgcccctgcagtcctcccccgaggggctggacgctgctttcatcggtgtgcctctggatactgggacttccaaccggcccggggcaaggtaaggcagaaaggcacctgggctggggacacgtggcagaaggcacacggggcgggcgagcacctttttacccaggtcttttttggaatcagggagggcgttggagaaactgatttctctcctccctcaacaagcaactcccagggctgagcccgggattggagggccagtcatgatatctcagggtccttagtggtccagaatggcttctgtgcactctggtaaccccaggaaaccgaggcagctcagaaacaccaacctgggctgcattagcaagccaggagagtttctaggacccgcagcctccctgggatgctaggtgtgcacgcatactaccctagtcacgtcccagggaacactggtttgaggacagaagttggttgttccccaaacgtctagctctcaaagtcaaagagacataaaatctattatcttaattagcaagcatcagcagttactgctttggcccattacatctgactgcatggggctgaattttaaaagctgtcattttattaaatgtcaaggaactcaggacattttgcaaagatgacctcgtttaatttttacaaccacaccgtgaaataaagaacatcattattctaaagaccaggaaacagaaacagagattaaggagttatctaatgtcttctaataaagtggtggtgggcaggcccgtgaatctgcggatggaaggacagaactcctactcagctttccaggagccctgggtttgatctccagcagtaaaaacacaaacaggcaaagaacaatgtagagtctgtgtcaccggctggtactctaaaaatatatttttttcaagacagggttgcactgggtcatgatcagaaacactgttagcctgctgtggtcatacatgctggtaactccagaccaccggaggctgaggcaggaggattgagagtttgatgccctgaaacttgttatgtagaccaggctagcctcgaactcacagagatccacctgcctctgcctcccaattcctgggattaaaggcaggctaaatttttctttaaaatattattttcattttatgtgtgtacatgttttgtctgcatgtagggttgtacaccacatctctgcctggtatcaagtcaccagaagaggatgctgtcagatcccctggaactggagttagggaccgttgtgtgctgccacgtgggtgccaggaaccaaactcagatctcctccgagagcagccagtgctcctaactgatgagccgtcccatctttgtagtccctttagaaaacatttaattgaagccaggtttacggggtgcatggctttaatcccagcactgggaaggcagaggcaggcggatcgctgtgagttcaaggccagtgtttcaggatagccagggcttggttacacagacaaatcctgtcttgaaaaaaaaattttttttaattcgtatgtgtgctcgatgcatttgtgtgtgtgtgtgtgtgtgtgtgtgtgtgtgtgtgtgcactcacatacacacatgtggggagaggcttgggacagctcactgagtctgtatcactgccttgttggagatgggggtctctcattggccttgaatttacggagcaggttagactggtggccacgggtactttactaatcagtcccgattccccagtgctggcatcccaaactggtggcaccccacctggcagttatatagatgggttctagggatcaaaactggaccctttcacttacacggcaagtgctttactgactgtcccatctgtgtattaaaaaaaaaaaaaaaaacaacaccctcagatactgtagtaggtggaagagtgataaactcagcacgatcagaaacactgttgttagcctgctgtggtcatacatgctggtaactccagaccaccggaggctgaggcaggaggattgagagtttgaggtgatcttgggctacagtgagttttggaccagcttggacaacatagcaaggtcctgtcaaacaaagaatgaaaaacaaaaactccaggttatcaaaagagccccacgtgctggagagatggctcagcagttaagagccctgactgctcttccagaggtcttgagttcaaatcccagcaaccacacggtggctcacaaccaactgtaatgagatcatatgccctcttctggtgtgtctgaagacagctacagtgtactcacatataataaataaataaatcttaaaacaaaaaaagaggcccaaatatgagcagatgactgattctcagaggagattgttttagacccagtggcgatattggataatattcagacatgcttttgcaggttgggggaagatgtgctcctgactgctagtggttacgggctgaacaggcaatcctacagcactgagtcacctgtcccaaatattaagagttgagagagaagcaccatttaggcacagagttgccttcagagctgtgcggcagctgacatagacagttctcctgcagatttggaccctgtcgcatccgggaggagtcactgatgctgggggctgtcaaccccagcacgggagctctccccttccagtccctcagggttgcagacctaggcaatgtgaacgtcaatctctacaacctccaggacagctgcctgctgattcgagaggcctatcagaatgtcctcgctgcgggctgcattcctctgaccttgggtaagggcaagagccagggccagggctgctttttctcggcgggtgagggagggtggctattcaatacgggcctatgggcagttgtttctccaggggaagctactgtgaacccagaaggaaagtgaactgcaaattcattcatattagtcccgggggaaaggattgttaatattttgggagggctagcacggaggcgccatagatagaccctctctcaggaggaccagtaaggtacggtaaggccggggaggcatttgtcctcggacagaaaaaaacaaaaaaaaaaaacaaaaaaaaaaaaacccaacagtcaaatcaataaagcaggataagtaacctattgctgcttttgcttcaagccccagtgtgactaggggaagctgtgttactggttttcttgttgttcatccaaaagtttcttttcaccttgatttttttaaaaactactgttcttaagacagtattggtctcagttaattaagttgtagttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaccctcttccctcaccctcctcccagtcctccatcccagtacctgtcaccccttcctcaccctcctcccaatcttccatttcagccctgtcaccctcctccctcaccctcctcccagtcctccatctcagccctgtcaccctcctcccttaccctcttcccagtcctccatcttagacctgtcaccttcctccctcaacctcttcccaatcttccatctcagccctgtcaccctcctccctcaccctcttcccagtcctccatctcagccctgtcaccctcctccgtcaccctcctcccagtcctccatcccagccctggagaaggctctcaacaggggctcagttgtagcttctcaacctcacagacgaaatgattgtagtgactatgagaactgcaagggggctctttcttttgttccttactgtttcttttcctcttacgtttatttacttagtgtgtgtctgtggacacatgtgtcacagcatacacagagaggtcagaacacaacttttgggagctgttgtctccttctaccatgtggacgatcaaacacaggtcttcaggcttggcagcaggcgcccttcctggctgagccgtctcccctgccctccagagggggccttgaactgtcaggattagcatctatgtacgagccactggtgccttttcctctctactttggttcacaaattgaaacattgtgagtgagatttttttatattcctgttaatttttgttaatttggatggcctagttactgggtatggcagagtagggagggaggcttccaatttttggcaacacaacccagatcttgcaagctgtctcacagtccagtctgtgctgcttggtgcttggttacatctgtcaacaggtggagtgacagacagacagtgggctgtctcacggcgttatgggtggggcacatagttcaccaggtcatctctctgtgctttgaatatttgcttcagtacagcttagctattgttccttgccctcagcctgtcctgctcgtgctcagcagggtagcctgtactcctgcttacccctgagacaaaggcagggggactacaagttcaaagccagagtgagttcaaggctagcctgggcaacttggtgagatcctgtcgcaagatcaaaaaagtgaaggaaaaaaaaattaaaaagacagttccagcaaataactgcatacctctatctgcatgtacaagcaaccctaaatgtaaaacagataacatgtctgctccatggtgcagttacaggatgggtttattgtagataagagagagaaaggtcagagacatctggaagagttcagagcagtgataaaaggaagactgaatatgacctgtagagagggggcagggaggagagaaagagagagaccaagacaggaaaaccaagagaccgggcaaaagagaaggagctgagcccaaggagtagcagggctgtgaggagactgaggagctgagggaagggagcctgtgagctggggaaggttgcttaggggaggggatgaacaagctgagaggtcccggttagcaggactctgaagtgcagaacagcatctgtacttcagagggagcctacagaccagcatgtgtttatcttacaggcaccacacccagctgtgtgtccgtctgccagtagggagggaaatggctccattcggagagggccaggagcttctcaagttcctgaggaattctggcttctgtttgactaccagggtttggggaaatggagtttcctttgaaactgacactaaacataatgtgatttaaaaaaggagaaagaggaggaggaggagggggaggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttcaattcccagcaaccacacaggggctcacaaccatctgtaatgggatctgatgccctcttctggtgtgtctgaaaagagagacagtgtactcatatacaataaataaataaattaaataaatccttaaagaaatatatctgagccacggagatgactctgtgtgtaacatccttgccatacatacaagcccgaggagctgaatttgatccctggaacgtactgtaggagggaaactgactcttacacattctctcatctccacacataggctgtcagtcatacacatctctccctccctccctctctctctctctctctctctctctctctcacacacacacacacacacacacataaaagcccagacaaaggtaaagtagcaccctcatcagctaccatatcaggcagtgcaggcctatgccactcactccatccatagggcagagtggtttcgtagaacaactcataagcgttgatttatgtaatttcctctcgtgtgcctgagtgtgggtttgtgcaagttgagtgcaggtacctgtgaaggctggagggattggtccccggtctaggtttgtgagctgcctggcgtgagggatgcctattgagcagtgtgtgcttgagccatctctccaactccggtctccgctgataaatgaactttgattcgacagacgtaattgttgtcttggaggcttactgctaacctaggccgagtcctggaagctttatacagtctttttttttttttaaagatttatttatttattatatgtaagtacactgtagctgtcttcagacacaccagaagagggcgtcagatcttgttacggatggttgtaagccaccatgtggttgttgggacttgaactccggacctttggaagagcagtcgggtactcttacccactgagccatctcaccagccctatacagtcttatcctagaatgttttcagcctatgagaattgtcacttagtaagcttaccctttcttgttctttttctttctttcttcctttcttttttttctttctttccttctttctttttttctttttttgtttaagatttatttattatatgtaagtacactgtagctgtcttcagacaacccagaagagggtatcagatctcattacggatggttgtgagccaccatgtgttgctgggatttgaactcaggacctctggaagaacagtcagtgcttttaacccctgagtcatctctccagcccgcctttcttgttctttctgagctctgactggctagttcaattcagctaatctggctcaaactcctcaaactgactgattcaatctggcttttctcttggcctctggctgaattgctctgcttggcctctgcttggcctcatactaactttagcatatgttctaatctggctccttctcattctttggcccattctgtctccatctgcaacctcactctcccaggaaaaactgcctctctcctctgcattgctctctctctctcttttttttaaagatttatttattatatgtaagtacactgtagctgtcttcagacactgcagaagagggcatcagatttcattacggatggttgtgagccaccatgtggttgctgggatttgaactccggaccttcagaagagcagtcggcgctcttaaccacggagccatctgccttgctctctcttaagttacctctctttcctctctgttctcctgagactggggcatattctgtcaaatctttctctgattcatcactttgtctgccactcagtttcaaacatgggtgctttcttctacaaactagttttcccttccttgtttgggattaaaggtgtgtgtactaagggtgtgtctgtattccagccaggattaaagatatgcattaaggctgagccacaccacaactagtaacagctttttctggtaaacaacacaatcaatttcacagtatgatcaaataccatgccacagatgggggaagacattttccttttaaaatgccacccatggccatttagctgtagatacagttctgtagtaatacctgaaagggtggcagctttggggacttcaggactgtcccatgtgatgatcttgctcatgtttgcagatgtgtcctgttttctctctgtaggtggagaccaaacaatcacatatcccatactgcaagccgtggcaaaggagtaagtcccaaggttgcaacattcaggagctaaggtccaggttgctactagatgacatcaagcgaccactgaagggggtgggtaatggaagggctattgtaaattccccactgagttgtttctgtagctcaaaactaagactccatgtgtgtctgtcagtcatcagcttggtgtccttccccttggcctagatctgccatggtacacacacacacacacacacacacacacacacacacacacaccacacacacattgcattttcagttggcccatgagtccggagtgaaatatacaactccaactatttgtttttctatgcaagccatatataaatattgacagggggtggggaggcccagttccctccctgccccccatagactccttcgttgcctggccaacagaaggtagatttttcagtagctgcaagcctactgataccgaccagctttggctggtttagctggaggaaggtagagggaggaagggaggtgggagcttcaggatttgttttagggaaggcatgtgggcagcattctgattgggcgttctgggagggcacatggatgacatcctgactgagttggaggggtatgtgggtagcatcgtgactcagggttggggtggggtcagtcttgtctcgagctgttctacgctcccgctagcatggactgtgttcatctccgtgtccagcaaggctgatggagaggcacaggctctgaatacccttccggtgccttagccgggtgacaggtggctctgactggtttagcctttacagagctccgtcattgcccttctctctgaaactcttggtggcaggccagtcgtgtctgcttctgcctggtttctcctaggtgagctgaacactgaaagcagacttgaggtaggcagccgatgccaggactgttgacctctgagatgccgttttccccccaggcatggcccggtgggtttagtgcatgtgggtgcccacaccaacaccacggacaaacctcgggaggagaaggtctaccatcggacacctttccgccgaagtgtggatgagggactgctggacagcaagcgagtggtacagataggcatccggggctcctccaggactctggatccctacagatacagtaggagccaggtgacagacgcacacctctctttatccccgcagagtgtcttttgcatggtcaaagagggagtcaacaggggctttactgaagttcagaaagtgaggctggggctagatatggtagcacaggtctgtaagcccaaacttcaagaattcgacaccattcacagtttcatattgaattcctggtgagcctgggctacatgagaccttgtttgaggataaaaccagaaatgggctgacaccatggttcacggagtaaaggggcttgccgttaagtttgagaacctgagtttgattcccagtaccctcatagtggaagcagagagacaactgcaaaagtgtgtgactgtgtctctcttacacacacacacacacacacacagagagagagagagagagagagagagagagagagagagagagaggagaaaaggcaagtggagatggaaagctgagtttgaatcaagtgactcatgtggcaagagtattgataactgattcttggttgttgaagtctccttttgtattgatacaggatcttacgctgtagcccaggctagcctgcaactcatggttttgcctcagcctcccgagttttgtcttttgggggggggggggacagcaggtgtgagccactgtgcctgggacacattaatgaggcagaatgcctgttgctgtgtagcagaattaagcagagagccaaccctggggggctgctggcttagaagacatgggtagtgaacctgagttaggacagatgccccttcttagtgtttactgtaacacccggcagatggaaagccatgatccaaacatggtgtaaggcgtctacacaaacaccccagtccctctttttggaacaaggtttcattatgtagccctggctgtcctgggacttgctatgtagaccaggctggtctcaaacgcacagagatccatctgcctttcccttcgagtgctgggattaaaggtgggggtcaccacatctgctccttcattttactttgcttttaattatatttacttattctctgtggcatgagtatggagggcagaggacacttgtggagtgggttcccttctgctgtgtaaggtcttggggattgaactcaggtcactcggcttggcagcaggtggtacctttaccccagccgagctgtctcaactgtccggtcctttgatttttagagtgtcaagcccagagttctggacagaagcatctagaagcataagtgagcaataacatcagccttgaccttgcttcctaacttcatcagtagaggagggggtgacaactgtggattgcctcatggcagccaaggtcagatgtgacatgcatgtgttaggccaagcctggggtcagctatcacctccagctctttgactctggccctcacagggcttccgtgtggtcctggctgaagactgttggatgaagtcactggtccccctgatggcagaggtcaggcagcagatggggggcaagcctctttatatcagctttgccatagatgccttggatcctgcctatgccccaggaacagggacaccggaaatcgcggggctcacccctagtcaggtaagtgggcttccctagtggattcctggagagggtttttttttttggttttttcgagacagggtttctctgtgtagccctggctgtcctgggactcatgctgtagaccaggctggcctcaaactcagaaatctgcctgcctctgcctcccaagtgctgggattaaagacgtgcgccaccactgcccggcagccctctgctttccatgtgcaggatggaaacttctttggtaaggcctgtgtacctgttcctaaaccccaccccgagccacaccttgagtcagtcgtatccatgtccctgtgcctatcttgtttctgtgccttagcctgtgtttttgcccataatgttcttttcttgtttgtacttcaggaagccttccctcacccaggctgtttcctgaaaattgcctgtctcaaggatctttttttgtttttttcgagacagggtctctctgtatagccctggctgtcctggaactcactttgtagaccaggctggtctcgaactcaaaaattcacctgcctctgcctcctgagtgctgggattaaaggcgtgtgccaccacacccagcctgtctcaaggatcttgacataagacattgcctggtttgactccactatcacaccccagagcccctagtagagaggggctgtgtgctgtgaattgtgtaccttaaacagcatcgaggctgtagccagcacccgcctaggccaaggatgggtatctgggcctctattttcactggaaatgactgtcacatttaccttggacaggctctggagatcatccggggctgccaaggcctgaatgtggtgggctgcgatcttgtggaagtctccccgccgtatgatctctctggtgagtgaggggaaagaatgatccatggggtagctgtgagcttacattagatccatctaatgaggtaggcctccatgttcacctcggggaccccgtggagaagatccagcagcgaagagagaagcctgcccccacaaacccgacaggcacgagctaatgcaaggaacaaaacccctgggaggagccagctgttgctggttagtgacagggaggctcagtggcatcgcctctgatgtttcattgagaaatgaatttgcaaagcatgctttgctgtgaagtagggggttgctttagctgacacctgggaaaaggagatgtcacccctataattctaactggaagaaagaagaaagcttccagttaggccgagggtgggccctgagcagccattagtatcaaaggtccctcaggattctcctacagtctccaaaagatgctcggtagggactgaaggcatgttcacaggcaggtggcatcccgagtgcagaagccagggcttctgggaaggctagagtccttggagagtggctttggggaggcgtgtgccagcttcatagcctttctctccctcttaggtaacacagccctcctagcagctaacctgctgtttgagatgctgtgtgctctccccaaagtgacaactgtctgagtctgtgttcctgaagacaaaacagactatgtcatgacagagcctcaaggacttgtgagccagcagtgcaaggaccaaagaaagctttctgtgaaatgtcaccactggctgcaaacaaggacaactgggacactaacccaaacagctcgtgtctccttccttccctcctaacattaaagcatttcatttttatgtgtgcctgtggagttcagaagggggtgtgggattaatcctcacgagctggagagttaagatagcagtgagccaccactgcatgctgggagctggatctgcatcctctgtaatagtaagtgctcttaactgatagccatcatctttccacccaagctcgttctgcgagacaagagttcccctgtgtagccctggctgtcctggaactcactctgtagaccaggctggcctcaaactcaagagatccacctgcctctgcctctgagtgctgggattaaaggcgtgcaccaccactgcatggctaaagttcacattcctaaggagaaatgcagcagcccccggtctggtgatgcaccttggcacacacctgtagtcccaacacttgggaggctgaggcaggaggactgttacaaatttgagcctaactagggttatatagcaagaatgccagactcaggaaaccagaacccgtcatctggccagtctctactgctttaactttgttccctttcatagaaggtggaggaaacaggagaaggagacaagtcaactggaaaggcccgagaagtagcgcagggcaggcattccgtctccacagcatctgtctctacagtggaataccgaggcaggggagttcatgtgtgtctgaggctaacctgattgagagcgtaagacccattactacccttcacctcaaacaagactaggggtaaaaactaaaccagatgctgccagcttgctctgagagaactcttaactctctctgtatacctcgggtttgcattatctgcccttcaggttgacagcccctctatgcctgccatctcccgtgcctgctctgacagaaagcactattgagtgtcatacaactctaataatgtatccatgaatcaccttgcaattccagaggtgccccagagccatcacacattaaaatagtttatttgtttccagtccgtaatattcttaaaacaaaataacattagctttagtgcctgttcacaatacaaaaccaaaccaaacaaaactgaaaaggaaaaacataaaacataaaagacacaatttgtcaaataaattatttgttcttagtagtatcaaaagtgcaaaatagccaccttcctctcagatctgcctccaggtacagctatcctttctaacaatggcagcagattctgtcccgccgttgttttcaagggcacgtggacacgtggacacagctgacatttcatccgcatcctcttcttaacaacgatttacctgtttacttagttacggtgctaggactgaagaccacggagcctccccaagcactacacaagcactctcacgccccgccccagtctgggatcatttgtcttatagcccaagctggtctcacctgctcatgctaaggatgacccccaagtccggattttcctgcctctgcttcccgactgctgggattacaggcatgtgccaccacatctctgcatcaacatttaagggattgtacctaatttccgccccccccccgccccccgccccatcactggggatcaaatcaagaggatcacatactccctaggcaagtgctttaccgctgagcttgagccccagatggtcttctactttgaaaaaccaaaccaacccaaaccaaaccggagaggctgggtatatcttctagtccctagctgaagcaaagcagacggctcagatctattttttcagcaaacacatcaatggtggctgcaaatgaggagactgacccttctgaaaacgccaagcaaactgttttgggtgttggcaagtgacagggagagtggcctcctccaatgtctcaggcagcttattaacttgggttaggccaaccgcaggtgatcccagcagcagggagagggcaccccacagactgactggactttcccccagctactgaacatgactcacaggctgccttgagcagatacccactcctcacacagcannnnnnnnnnnnnnnnnnnnnatatagctcatatttgacacaaaaataaacaattcatagaaacaacattcaggaagaaaggcttgtatctgtcaaaggtagacttgtggtgcgcgcctggaatcccggtacttgggaggctgaggcaggagggccttgagttggaggccagcctgggctacatagtcagactcttgttttaaagcaagcaagcaagcaagcaagcaaatcaaagttgcatgatgtccttggtagatacccgtctccatcgggtctgcagggattatgccaatcccgtccccactcctctctacccccttgaatggaaagacattttatcttcttggtacagttttgagaagagaacaaacatctggggagtttttggttttcagaaattacatgtcaagggatttgaccggttccagaaacgtaaagacaaaaatctatcaatgagttaaaacaaactcataagaggaacccagccataaaaatagaggaagaatgaaaaaaacccatctgtgtgtgagacactgggggtggaccccaggctttgcacttgcctggcaagtgttctaccccagcttatcctcagcctccaggagccaagactgccttcaccctttctagctgggccaggcacacgagaaccatggagaatcggcatgtactgctagaggggcagatggaagaatgaagcctggcagtgttttctttactttttaataaagctaaagactctttgaaaactacagagttcctgggttcaaataatttctcacttaccactggagctcagtgtttaaagtagtcaggatccgaggtgcttggttcaaagcaattacaactggagaatactcactgagtgaatgtccggtccctgatttgtgcccttccctttacaaaagggcacttgcttgacagtagaacacatcatgtgtgacagttgtccaaactcccctcatgggttggctctaaaaacaagggtatgcccttgagcgggcgagcatgatccggccctgagctcaaggtgcgtggagccaggcgaactggagctgatgggtgtgatctggcagcgggaagcagcaataagggaaggaggaaacagtgaagcagggacgccagaaggaggatgctagctagctgcctactgacaggagtccggacaagtctccgctcacagtcacaagagacgacctgaagattcagctctttggggacaacaatgttcaaaatgcaattgtcagagaggtcaggttccttggtatgaagacacacctggcgttttactggagagcgaggcaggaagggctcctgcacctagctcttggtgggtaggactaagtgctgccatcttaaatctactggctctatagcagcttatctatgttcagagaacaagatcacaggatatggctcctagtatcaaactctaaaacccagaagcaaaaaggcctctggggacaggtcagcagctcagccactccagtgctggcaaggcagacaccctggctgtgctggtgctgacagagtgcggtgagggaaggggacgggcagggaagtgcacgcagggtcacagggctctgcgcctccagccagtgctcaccctccctctcggtcgggagactaaatgtgaatgctgcaccttcaccccctgctcacccctttcttctcaaaaccatgcttggccgactgttgtgggggatacccccaaaatatacttctcactgcttgctcccagaagcacaaccacatagaaaactgcttgcacactaggcctcttttgaagacggaggacctagaagccgtggtggcttcccgtgttgagagcacacaccttggcagaggccaagcaggggccagcaggagcctgctgcaggggctgggggagaggtgagtgacccaccccatgagacaggctcatgaagatcctgaggttggtccaggcacggctcagggtcaagccctgggtttctgcagtgtaaggacaggggtgtgagcacgttatagggacagcagagaagaggggctgggcagtctactgaagtagtgcggcattcatccaggggagaaaacccgaaggggaaggaagatgttcatctagtggtcaaacctgcgtgctttactcctaggtgacagaggaaaggtcttctagccatggctctagaagagaaatctacaatggagactctcttaaaatccctgttcctggggcccgctatcctctggaggcctcgctcagtccagctcaggccacgacgggatgtagaacctctgcaaggagccttccagcaggcgctccatccacaaggacaacttgctcagcttgcctttgaggggcttggggccaaggccacaggaaggcttccctcgggaggagtcagggtcacaggaggccacagtctcctcatccactgtctttagtggcttgaaaaggcagaaatacttcttgtgaccgttcagggccagcacgtagccagtgtagtctcgttccataaagtgcttgtcatactggtttgggatcggggccgcatcctgagcaaactctagcaaatactccagccactcccggtgtttgtccagtgtcaggaaggagaagtggaggctgctgctcctgtgggaagagcagatgagggttcagaaggttccaggagttctgctgcaggccactgaggagaacagtgccagcaccctagacaaggctgaacagccagagagccttgtgctggctgcagcctggacttacgaaaggatgtatgtggagctgggggtggggtggggtggggtgcatggacatgagagtcaagggagagtagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacacactcagaaacacacacacacaccccacctgcttacccggtgaatgtgtagacttccaaagcaaacttctgcaggaggcttgtcttagtggaattggacaggatcaggaccacattcatgtgaccaggcctcaggcgtaccaaattgctggtgtacgtcacatctgtgagttcagtcacctccacaaagcctttcttaggaatcttgctgtggagaaatatggaaaactttagacattttcaggatgcggggagcggaaagcagtggaagccactgtggcagggcatgccataaccctagcatctagggggtagaggcaggaggacgggaagcttaaggcaagcctcaattatgtggggagtctgaggatagcctgggctaggggaataaataaatatgcaaactcctccttaggtctccaaaacaaacacaaaaccagtgaatctgagagcgcctggcctgactggatctgcctctcagcactgactaggactcatggggctgcagggtggccctggtccacagtagcccttcttacacagctttcagtccagtgtaaaggtgactacagatgagagccatggaggccatacatgcttagtctgtttttaactcggacaggtctcttgcagtaatgagtcacagggacacgctaccccagcttctggctcacgtatcacctcccttgtgtttctttctcttcctgctttcatgcctgagctgagactgcaaatcacatgacactcagattattagtagtcctgtatctacatgtgtagagggtcttagtgtaccccagtcagcagtggcttttcccttattctagatgcctgggaatggagagtgtgttctgaacttctttttttttttttttttttttttttggggttttcgagacagggtttctctgtgtagccctggctgtcctggagctcactctgtagaccaggctggcctcgaactcaaaaatctgcctgcctctgcctcccgagtgctgggattaaaggcgtgcgccaccacgcccggctctgaacttcttttttaaagattttattatatatatgtatatatatatatatatatgagtacactgtagctgtcttcagacacaccagaagagggcgtcagatcccattacagatggttgtgagccaccatgtgattcctgggaattgaactcaggacctctggaagagcagtcagtgctcttaaccgctgagccatccctccagcccatgtactgaacttctagaggtccagaaggtcacaacagtctggaactccagctctagggagatctaatatttctggcctctgagagtacaaacctacacacagacacacagggacacaactaaaaaaataacaaatacaaagaactcagaatgcctgagaatagaagtgctttggatgtctggattcccctcccattttataatgtgtgcaaatgtgcaagtaagacatgttgaggagggtcaaagcacatttatgtctgttcacacacctcagtctgaaggtgacttcacacagactgtgggtacacgtgcacttgctgtgactgtgactccccgatgaggcacacaactgtttgctcttttctgggatgagtctcaatatgtagttctggttggcctggcactctatataaaactcgcaggtatccacctgcctctgcctcctaagtactgggattaaaggcgtgtgccaccatgactggctatttcagaacagtacatgtggccttacactgctatccatagttgtccacttcaggttattttagcatgggggctcagtgagtagcacatgtgaggccctgggttccataccccgcattgcaactccctcccccaaaccaacagccaggttttagaggcaggcaaggaggcctctctacccatctcggtaacgctctacgaggctgagggcagggtgtgctgtgtgggaagaacctgctgctctctttggtgaagctcggctcagtcttcccagccttctcggggacttcctctttgtctgcagggtgcgactctcgctcctcatttgagtcactaaagcatggaaacagaagttactttcctttctaaacaagaagggcagacatggcctggtgggctggcccctgggtacctgaaagcctggaccatgaccgtgccgaagaggatgaagagggccgagaagatgagggacagcaggggcatcatctcccgcctggaagcaaaggcagctgtgagcccacaacctcgggatctggctttcagccatgagcctacaaccgccaggatctggctttcagccatgagcccacaacctcgggatctggctttcagccatgagcccacaacctcgggatctggctttcagctgactcaggagaaaaaggtcccaaaccacacttctctcacaccaagaaacaagagcacaagacaggctgtttcgagggtgaagaagtggggggtggctttcggctgtgtctaatacattctgtacgagaggatacaggaagcaactctcggacggacactgagggactggtggctacagactctagggaatgatctcagacgctgaatgtggccagaatggcagatgtggcccagatggacagggaacgtcacagtcagcttcagctgtcaactgaacacagactacagtcacctggcaagagggaacttagcgggaaagttgcctccattagcctggcttgtggacatgtttgtggggagttttcttgattactaattgatccggcagggcctagcccactgcgggcaggcagtcctggggagtgtaggaacagccgcttagcaagccagcaagcagcattcctctgtggtcttggtttgtaagccaaaataaaccttctcctccccaagctagttttgggcatggacagacatatttatctgtgcgtgcacacactgtgctgagtggccgacacagccaagagtgaaggaggactagtaccagccctgctgccagggaggccagctggggtgatcttcccgcccagcaggaaggacctatcagcaaatggtaagaagcaaagcaaaggcagcagaagtcggttatcgggctgtgtgagctcgcctacttccagcagccaagtgcacacaaatccaagcgcgggcttccaggctggctttgacaaggaaaagaaacccacagcgtcctaccagttactgtgaagcaggctctcccagaagtccgagaggtagtcagaaacagagtagagccaccggaggaaaaatacctgtgggaggaaacaggcagtggtcaatcccgccctgctcccgccccgccccctcacactgccccacccctcctgctggcccattcttctggaccctgatgctcacaggagccagctcgtcagtcaggtcagggagcacagcttctgaagacagaaatgctggatccttccgcagctggtcaagataacccaaaaggacgaacttatcgctctcactgccggtccagggatcctccagggttttgaacaccaccctccccgctgtgttcctcctttccaagatggacacctgagagaaaaaaagaaagaccattaagagtctcaaaagcaacaggatataacgacaccaataactccagccccctcccccccttcctgggaggctgaggctgaggttaagaggatcaagagcttgagcccaggggctggagagatggctcagaggttaagaacactgactgctcttccagaggtcctgagttcaattcccagcacccacatggtgctgggaccatctgtaatggggtccaatgccctcttctggtgtgtctgaagacagcaacagtgtactcatataaaataaatacatacataaatgagcccagtctggacttacatagtgtatcttgtcaaaccgtgagctgcagttgcctgcgctttgtcccagggaagatggtcaaaagggcctcatgaggtcactaactaagctaatgcataaatcctgtctatggtgtttgtaagaggctttgaggtctttctgacaaaaagaatccttagtattcaaactcactgtgcagctgtgaggatgagcctgaacttggctccatctcaccagcatccctggataactgtgctgggaggaactcagccttgtgtatgtcagccaagcattctacaaactgaactccacccccatcccaggagttagtgaggtttgagatgagctctcattttgtgacctaggttggccttaaatgcctcggctcaagagatcctcaaaccttggccttcccagaataattttttgttctttaagaaatttattcatggaatgggagaagtggtcttgcccagggtacaccaacagtcagccctgaaaacatactgtacaggtagtattatataaactgaacaggttatatttaggaatgtgtgtgtgggtgtgtgtttgtatgtgtgttagcaatagcaatcaataaaaagaggtcatgaatttgacagagagtgttcttaatcactgagcaatttttccaactcagtttttgcttacttttgatactgggtatcatgtagcccaggctgccctaaaatttccttcctgcctctacctcccagtgccaggtttacaggcatatccactacaacagaaaaattataaaaaataaaagcagaagtaattacttttatggtgacattcctaagcttttgtcaaaattctaagcctctttttcttcccatagactttgtgtaacagcttctgcctt

SEQ ID NO: 962 - DNA, 1467 bp, Mus musculus
aagtccagatctgggcaggtggagaaacccttggggctttggggccctctcagcctctttgatcccagtgtgtccctgccctttgaacgctgcaactgagggctggcacactgtcctggttgggctcctcaataggcggcatgctgaggctgctgaggtccagctgggcccgcggcttggggtctggggtggccacttggcgtccctcagcggggctctttcgtcctgggtgccctgggatccgccaggcttcaggtgcctcagataccccacaccaccagtcccccagctctgagtcaccggtacagccggtgggggtgggtgtctgttccatgatgcgcctgcccctgcagtcctcccccgaggggctggacgctgctttcatcggtgtgcctctggatactgggacttccaaccggcccggggcaagatttggaccctgtcgcatccgggaggagtcactgatgctgggggctgtcaaccccagcacgggagctctccccttccagtccctcagggttgcagacctaggcaatgtgaacgtcaatctctacaacctccaggacagctgcctgctgattcgagaggcctatcagaatgtcctcgctgcgggctgcattcctctgaccttgggtggagaccaaacaatcacatatcccatactgcaagccgtggcaaaggagcatggcccggtgggtttagtgcatgtgggtgcccacaccaacaccacggacaaacctcgggaggagaaggtctaccatcggacacctttccgccgaagtgtggatgagggactgctggacagcaagcgagtggtacagataggcatccggggctcctccaggactctggatccctacagatacagtaggagccagagtgtcttttgcatggtcaaagagggagtcaacaggggctttactgaagttcagaaaggcttccgtgtggtcctggctgaagactgttggatgaagtcactggtccccctgatggcagaggtcaggcagcagatggggggcaagcctctttatatcagctttgccatagatgccttggatcctgcctatgccccaggaacagggacaccggaaatcgcggggctcacccctagtcaggctctggagatcatccggggctgccaaggcctgaatgtggtgggctgcgatcttgtggaagtctccccgccgtatgatctctctggtaacacagccctcctagcagctaacctgctgtttgagatgctgtgtgctctccccaaagtgacaactgtctgagtctgtgttcctgaagacaaaacagactatgtcatgacagagcctcaaggacttgtgagccagcagtgcaaggaccaaagaaagctttctgtgaaatgtcaccactggctgcaaacaaggacaactgggacactaacccaaacagctcgtgtctccttccttccctcctaacattaaagcatttcatttttat

SEQ ID NO: 963 - protein, 395 aa, Mus musculus
TLQLRAGTLSWLGSSIGGMLRLLRSSWARGLGSGVATWRPSAGLFRPGCPGIRQASGASDTPHHQSPSSESPVQPVGVGVCSMMRLPLQSSPEGLDAAFIGVPLDTGTSNRPGARFGPCRIREESLMLGAVNPSTGALPFQSLRVADLGNVNVNLYNLQDSCLLIREAYQNVLAAGCIPLTLGGDQTITYPILQAVAKEHGPVGLVHVGAHTNTTDKPREEKVYHRTPFRRSVDEGLLDSKRVVQIGIRGSSRTLDPYRYSRSQSVFCMVKEGVNRGFTEVQKGFRVVLAEDCWMKSLVPLMAEVRQQMGGKPLYISFAIDALDPAYAPGTGTPEIAGLTPSQALEIIRGCQGLNVVGCDLVEVSPPYDLSGNTALLAANLLFEMLCALPKVTTV

SEQ ID NO: 964 - DNA, 32865 bp, Homo sapiens
gctcactgcaacgtctgcctccctggttcaagccattcttgtgcctcagcctctccagtagctgggattacaggcatgtaccaccacgcccagctaattttttttttttttttttttaagtaaagacgggtttcgccatgttgaccaggatggtctcaaactcctggcctcaagagatctgcctgtcttggcctcccaaagtgctgggattacaggtgcacaccaccccactgggctaatttttctatttttagtattgatgggggtttcaccatgttggccagactggtctcgaactcctgaccttaaatgatccacccgccttggccttcaaagtgctgggattacaggcgtgagccactgtgcctggcttttttttttttttttttttgagagggagtctcaccctgtcacccagctagagtgcagtggcgaaatgttggctcactgcaacttccacctcctaggttcaagcaattctcctgcctcagccccccaaatagctgggactacaggcatgcaccaccacacccagctaattttttgtatttttagtagaggcagggtttcaccatgttggccatgctggtctcaaactcctgacctcaaaggattggcccaactcggcctcccaaagtgctgggattacaggcttgagccaccgtgcccagctgataagtgtgtaactttataggcaaagtgaatagaatactggggattttgacaagctttaatgtcacaaagattttttttttttttttgagttagagtctcgatctgttggccaggctggagtgcagtggtgtgacctcagctcgctgcaacctccacctcccaggttcaagcaattctcctgcctcagcctccggagtagctgggattacaggcgcctaccgccatgcccagctaatttttgtatttttagtagagacagtgtttcaccatgttggccaggctggtctcgagctcctgacctcaagtgatccacccgcctcagcctcccaaagtgctcagactacaggcgtgagccaccgtgccaggccacaaagattctttgcttggccaaactttagcaccccacctggctttttggctataaattcccacttgccatgccgttgtaaaccaaatagtgtctgagacaggtctcagacaagtttattttgccaaggttgaggatgtgtctgggaaagacacaagctacagtggtatctgtggcctgcgctctttcccaagaggattttgagaacttcagtatttaaacgggaaaattgggcaggaggggaaagaggacagtcaattgttcataaaattattcagaaaatccacattttacattaaataacctaaacatagagtagaggaagaagtcaaatatgcgtttgtctccaggttggcggaggtgggggtcgggggaatgatccccagtcttatctttgtcccttacttgtgaaaataagctgttaatttacattgtcaggatgagggaggtcacctggggagatatgtggcctctgtcttgcagctacctgtttaggaaccaaaaaaagtgcaatgttttacatactcagttcccaagcttaactttttcctttggcatagtgagtctggggtcccgggattttcttttcctttcacactatattgggttgagagtccagtcgctctcctcaactacaagattccattgcagtggtcactatacctatctcaagggtcctgaatatttttccttaccatgctttaacaaggatcattagatacttttatcttttttttttttttgtcagggtctcgatttgttgttcaggctgcagtgcagtggtgcaaacacagctcactgcagtctccacctcctgggatccagcaatcctcctacctcagcctcctgagtagctggactataggtgtgcgccactgtgcccagctaattaaaaaaaaaaatattttttttttagagacagggtctcactatgttgcccaggctaatttttttctttttcttattctttttcttttctttttttttttttgagacagagtcttaccctgtcacccaggctggagtacagtggcgccatcttagctcacggcaacttccgcctcctggattcaagcaattctcctgcctcagcctcctgagtagctgggagtaattacatgcacacgccaccacacctggctaatttttatatttttagtagaggcagagtttctccatgttggccaggctggtctccaactcctgacctcagatgatctgcccacctcggcctcccaaagtgctgggattacaggcgtgagccaccgcgcccggccaggaaattttttcctttaacagatgaaagcattctgaacatgctaaacaatatatttttatttagggctaggggacaaagaaggtgaagatgagtgttgaggttgtagcaaggcgaatgagtgtcacagaaagcccccagccaggcagcctggggaggctggagttgcggcaggatcatttctgagcttccgcaagcacagacaagttcagcgttgacaccttctgcagagcccttacctcaccattcagcaggccaaatggaatcaatccatgcagacagctgaaatgcacacggtgttttccccacactcaggctgtcagttttgttgactgagatactcatcaccccagagctgcttttcacagttctagaagatctgttcaatcattcattcactcacaaaacatttattccttgtgttttacaaggtactgcccttggaggacacccaaaaggttgaagtagatattggaaattatagtttactagatgggtacttctcaaccttcttcctgtcatggcatacatagaaaatgatacaatttatatctctcactgaagttaactggggggagtttggatccctatcagatttggtgaaaaaaattgatgttttctacatattgtataattatgatttggaaaaaaatcaaattattagggaaagcattaaatattgagctaatataatacaaaaattaatacaaataaatacaaataaataataaatacaaaaattagccaggcatggtggcgcatgcttatagtcccagctactcaggaggctgaggcaggagaatcactttaactcgggaggcggaggtagaagtgagccaagatcgcaccactgacctccagcctgggcgacagagcaagactgtatcaaacaaaaaaaaaaaaaaaaaagagatggcgtctcacatctcgctgtgttgaccaggctggtcttgcactcctgggttcaaacaggtcctccctccttggtctcccaaagtgctgggattatagtcatgagtcactgtacctggccaagttttagcttttctgtgaaggtagctgtttaatatcaggttttgttttgttttgttttgtttttttgagacagagtcttgctctgtcacccaggctgcagtgcagtggcgcgatgtcagctcactgcaacttctgcctccggagttcaagcgattctcctgccttagcctcccgagtagctgggattacaggtgtgtgccactgcacctggctaaattttttttttttttttgagacagagttttactcttgttgcccaggctggagtgcaatagtgcaatctcagttcactgcaacctccacttcccaggttcaagcgattctcctgcctcagcctccctagtagctgggattacaggcatgtgccaccacgcccagctaattttgtatttttggtagagacaggatttctccatgttggtcagactggtcttgaactcctaacctcaggtaatctgcccgccttggcctcccaaagtgctaggattacaggcatgagccaccgtgcctggccaattttttgtatttttagtagagacggggtttcaccatgttagccaggctggtcttgaactcctaacctcaggtaatctgcctgccttggcctcccaaagtgctaggattataggcgtgagccaccgtgcctggaccaatatcaagttttatgcttgatatttgcgtatttgctacatggaataataatcagaacttttaaagaatgatctcttcaaattcttgatacccttgagctcaaggaggtaatacaaatcctaaaataaatgttaaattcaaaaatttacagaagttgaaattgtcttttctttcattaacaaatgtacaattgaaatttcttgtgataacatgaatggatttttattttttattttatttaattttttttttgagacagagtctcactctgtcacccaggctggagtgcagtggtgcgatctcgtctcactacaacctccacctcctgggttcaagtgattctcctgcctcagcctcctgagtaggtgggattacaggcgtgcaccaccatgcccggctaatttttgtatttttagcagagacagcatttcaccatgttggtaaggttggtctcaaactcctgaccttgtgatccgcctgccttggcctcacaaagtgctgggattacaggtgtgagccaccgcacctggccagatttttatttatttatttttatttttatttttttgagtcggagtctcgctctgtcacccaggctggagtgcaatggtgcaatcttggctcactgcaatctccgcctcccgggttcaaacaattcttctgcctcagcctcctgagtagctgggattacaggtgcctgccaccacgcccagctaatttttgtatttttagtagagatggggtttcaccatattggccagactagtctcttggtcaggctggtctcgaactcctgacctcgtgatctgcctgccttgggcctcccaaagtgctgggattacaggcgtgagccaccacgcctggcccaatctggatttttatttatttatttagagacagattttcactctgttacccaggttggagtgcagtggtgcgatcatggctcactgcagcatctctctacctcctgggctcaagcaatcctcccacctcagtctcctgagtagctaggacaagaggcatgcatcaccatgcccagctaacttttttttagattttttcgtagagataagttctcactatgttgcccaggttggtctcaaactcctggtctcaagcaatcctgccatcttggcctcccaaagtgctaggattataggcatgagccaccacacccagctaaacacatttttctttttttgagacagggtttctctctgtcgcccagctgcagtacagtggcactatctcggctcactgcaacctctgcctcccgggttcaagtgattctcgtgcctcagcctcttgagtagctgggactacaggcgcctgccaccatgccccggtaattcttgcatttttagtagagatggggttttaccatcttggccaggctggtcttgaactcctgacctcaagtgatctgccaccctcggcctcccagagtgctgggattacaggtgtgagccaccacacctagctgaaaacatttgatagattctaattctgtagtttgggatggggtccaggaatctgaattttaacagacactccaggaaatcgatgtaaatgtttctcacaaacaatactatgaaaccactgactgaagctagcagttctcagatgttttcgcttttttaaatctcaagactcctttacactattacaattattgaggccaggtgtggtggctcacacctgtaatcctaacactttgggaggccaaggtgggaggatcccttgaggagttcaagaccagcctggacaacatagtgagaccctcataattacaaaaaaaatttaaaaaatattagccagttgaggtggcatgagcctgtggtcccagctactcaggaggctgaggtgggaggatcagttgagtcctaggattcaaggctgcagtgagccacgacagtaccactgcactgcagcctgggagacagagccagaccctgtctctcaaaaaagttaaaaaaaattactgaggatctcagaaagcttttgttatgtgggatatatctgttgatatatacaggattataaattaaaacaggcacacacacaacaaagaaaaaaaggctgagcacagtggctcatacttgtattcccaacactttgagaagctgaggtagcagtattgcttgcatccaggagtttaagaccagcctgggaaacgtagtgaggcccaccatctctttttttggtttgtttttttgagacagggtctcactttgtctcccaggctggaacgaagtggtgcaatcacagctcactgcagctttacctccctgggctcaggtgatgctcccatctcagccttctgagtagctagtgagaggtgaagccggctgggcttctgggtcaggtggggacttggagaacttttctgtctagctaaaggattgtaaatgcaccaatgagcactctgtgtctagctaaaggtttgtaaacgcaccaatcagcactctgtctaaacagaccaatcagctttctgtaaaatggaccaatcagcaggatgtgggtggggccagataagggaataaaagcaggctgccggaaccagcggcaccaagctggtcggggagtcttccaaattgtggaaacgttgtttgtaaaccttgttcttctgctctttgcaatagctcttgctgctgctcactctttgggtctgtgccgccttcatgagctgtgacactcaccgtgaagttttgcagcttcgctcctaaagccagcgagaccacgaacccactgggagggacagcaactctggacgcgccacttttacgaactgtagcactcaccgcaaaggtctgcagcttcactcctgaggccagcgagaccacgaacccaccgtgaaggaacgaacaactccagacgcgccgcctttaagagctgtaacactgcaaaggtctgcagcttcactcctgaagtcagcgtagaccacgaacctagcagaaggaagaaacttcggacacatctgaacatctgaaggaacaaactccggacacactatctttaagaactgtaacaccgcgagggtctgtggcttcattcttgaagtcagcgagacaaagaacccaccaattcgatacactgggaccacaggtgtgcaccaccagtcttggctaacttttgtattctttgtagagacaggatttccccatgttggccaggctggtctcaagctcctggactcaagccatgtgcctgccttggtctcacaaagtgctaggattacgggcatgaggcaccgcacccagtgagaccctatttctacaaaaaatacaaaaattagctgggcatagttgtgtgcacctgtagtcctagctacttgggaggctgaggcagaaggattgctcaagcccagggggtggaggctgcagtgagctatgactgtaccacagcaccacagccttcatgacagagcgagacttctatctcccttaaaaaaaaaaaaagttcagggtcttttgagggtgggcttctactgaacattggacatgtggagctgagggctggggtggagcactgcaggcagacagaaaagcatgaacaaaggaaaggaggcaagaaagtgggggctgaggcagctgaccatgggctggaggaacaagcccgtggagctgcagaaggggaaacacaggaagaattggctccaggaagcattaccgggcaggcatatgtatggtgatactagtgagagtgagatcagctggaaagctggggtgggaaggcctggaccagagtaacagcagaggaaatgagcagaaggcttgggggcaggaaaccatcaggacttcttaaatttgggggcgtagagcaggatcagagacagggaggtggaaagtcgctggctgaacttgcagcccaccccaggtgctgtcaagcatccaggtcagggttagaaattggtcgcctggagctcagggctgggatttgggcttgtggttgacctgcctatgggtgaaagtcatcacctccgtattaaaagggattgccagccgagaaggagccacgaaggtggaaggagaccaggggagtcccagtcaagaggccgcctgaggaacgtttcaaggagagagggtgctcagcagtagtggatgttggggacacctcattggaacgcctggcacatagcggacactcaatatttgtgagctgaatgaaagaaaaacccggagtaagaacatgatacattcaggacaagcaacatgaaagaaatagcagttgaatttgggagtcaagagaataactgagaccctttaagtggcataagggagaaaaaaaggaaaaaataactgagagattgttgcatttgttccagaaaatggctgggacctgccccaaggccaacactaagcactgataattgaccattaggaaactctgtcccgacctgcagagtggaggctccactccagagtggaggctggagtggtgtggggtttaatgtgcaacctttttttttttttttgacagagtcttgctgtgttgcccaggctggagtgcagtggcgcgatcttggctcactgcaaactccgccctcccgggttcacgtcattctcccgcctcaggctcccgaatagctggtactacaggtgcccaccaccacgcctggctaattttttgtatttttagtagagatggggtttcaccatgttagccaagatggtctcatctcctgacctcatgatccgcccacctcggcctcccaaagtgctgggattacaggtgtgagccaccgcgcctggcctaatgtgcaacctttgtgtagaggttgcaacgtaaatgcaaatgtgagccttttccattcaatctcaacatttagagatcagaaaaaataatatatataatactgctaaatggctcacataattccattacaaatcacttctttctttccacgtgtgtttttctttccccttagaaataaagaggatgtaacaggttctctggcactgtgaccttccttacagcttgcctgtaagtcctttatttatttatttatttatttatttatttatttatttatttttgagacggagtcttgctctgttgcccaggctggagtgcagtggcctgatctcagctcactgcaagctccgcctcccgggttcatgccattctcctgcctcagcctcccaagtagctgggactacaggcacctgccaccatgcccggctaaatttttgtacttttagtagagatggggtttcaccgtgttagccaggatggtctcgatctcctgacctcgtgatccgcccgcctcagcctcccaaagtgctgggattacaggcgtgagccaccgcccctggcctctagtccttttttaacaaggttatttaaaaagactttactggccaggcgcgatggctcacgcttgtagtcccaactactcgggaggctgaggtgagacgattgcttgagcccagcagtttgaggctgcagtgagctatgattgtgccactgcactccagcctgagcaacacagcaagaccctgtctcaaaataactagctagctagctaagtagctaactaactttactgcttcttgagattcctatccctggacatttaaaaatacattatttaaaaaaatgcatttcctatttttctggcttagagaaagatcattttccttcatatctttctggctttaaaaatattactctggggtggctgctgtggctcacacctgtaatcccagcactttgggaggccaaggtgggagaatcacttgagtccagaagttggagaccagtctgggcaacacagtgagaccgtctctataaaaacaaacaattactctgaatgggagaagaggctgctgaaggccacagtggggagcagggcgcagacacccctggcacagtgccggccagtgggcacccccagcctgactctatttgccagaggctgaagtccagaggggttgaggggagagcacggcaggtcctggggcccctcccccgccttgatcctagggcgcccctgacctttgagccggctcgggttccggctctggcgcgtgcacactcgcctcgccgttcgggaccagccagatcgcggcggcctcgcgggcggtttggtcggtgaggtcttggccgcgcgcggcaatgctgaggctgctggcgtccgggtgcgcccggggcccggggcccggcgtgggcgcgcgtcctgccgcagggctctttcatccggggcgccgccagagccgccaggcttccgacgcgccccggaaccagccccccagccccgagttcgtggcccggccggtgggcgtctgctccatgatgcgcctgccggtgcagacctcccccgaggggctggacgctgccttcatcggggtgcccctggatactgggacctccaaccggcctggggcgaggtaaggccggaaggacgggggccgggtacacgtggagggactgcttgctggctgtcgggcatggaaagcaccgagacaggcgcccctgctggccccgggtcgagttggaagctggtggccggctccaaaatgccccttatggtttgagatggttgatttacctggaccctcaataagcaaaccccagggctcaacatgggcgtggcctcccacatcttagtgtcatcattggtcaagaagggattttggccggcccggtggctcatgcctgtaatcccagcactttgggaggctgaggcgggcggatcacgaggtcaggagttcgagaccatcctgaccaacatggtgaaactctgtctctacaaaggtacaaaaaaaagaaaaaaaaagccgggcatggtggcgcgggcctgtaatcccagctactcgggaggctgaggcaggagaatcgcttgaacccgggagacggaggttgcagtgagctgagattgcgccactgcgctccagcctgggcaacagagtgagactccgtctcaaaaaaagaaaaaagaagggattctggagcctgaaccttctctgtgtccccatcctggggccttgctgggatggctgctgtggattcctcccctctcctctccccagcttacagtggcaggtgacattgcatttgagagcagaaactggctgccccttccccaaatctgaagatgtcacctgactcaagaaatgctcaaatgaaggcaattttcctaggatcaagtcggaggaagcaaaattcatcttcctagttattgaacgtcagcaatttctgattcagctcagcaacactatatctgaccgtactgatctgaattatgaaagccagcacttattaaatgtctcctaagtgcaaggtgctttgcatagattacctcatttaatttttactacagtgcaaggtaaatattttacaaattaggaaactgagactcaggtagatcatgaaattcactaatgccatttagtacacttatttagtctcttcgatacatagcctagatcggtgattctcaagtggggcggttttgcactccggggacatttggcagtatctggaggcgttttgggttgttacaccttggaggaagggtgctactggcacctagtgagtacaggccgggatgctgctaagcattccattatgcaatgccgcgacacggaatcatctggccccaaattgctgaggctgagaagccctggcctaagcaaagcctgaaatctctgcagatgatggctgacaggatgattcttccttctgcagattcggacctcgccgcatccgggaagaatcagtgatgcttgggacagtcaatcctagcacgggggccctccccttccagtccctcatggttgcagacctaggcgatgtgaatgtcaatctttacaaccttcaggacagctgccggcgaattcaagaggcctatgagaaaattgtagcagctggctgtattcctctgaccttgggtaatgtcagtctgcaagagccagagtagttccctgcactcagggtttacttatcctgtactcaggggcttgagtacagctacttctcccctgcaagccactgcaaatgtgcagacagtaggaaagagagcattgtaatttatttattttaatccctggggagagaatatttcacgtgtgtgtgtatgtgtgtgtgtgagacagtctcactctgttacccagactggagtgcagtggtgcaatctcggcacattgcaacctccacttcctgggttcaagcaattctcctgcctcagcctcccaagtagctgggattacaggcgcccaccaccatgcctggctaatttttgtatttttggtagagtcggggttttgccatgttggccaggctggtcttgaactcctgacctcaagtgatccgcccaccttggcctcccaaagtgctggggttacaggcatgagccaccgcgcctggccaagatgatgtttctaatgactttatttgcgaggagaactgcaaagagggtgtttttgtcctgctcagggtctacatcaacctatagggcagctttccccttatcctcacccctgacccactctcactttttctcttgttcacaaatacttaaaatgacagggatcttttcctaaatatccaaattcatttttgccaagttagagagcctagcctgcatggcatagtgggaggagtgtggtttcccgatggcatggtttgaagtctcagctgcacttctccctagcaatgttgctgtataccgtgcttgatgcttcacaccctcacctgtaagatgggaatgatcacagtaacacctactcactgcatgatgtgaggggcatataatgaaagtgcacatgaaatgcccagcatcaagcatggcatatcttttttttttttctttttttttgagacagaatttcactcttgttgcccaggctggagtgcaatggcacgatctcggctcactgcaacctccgcctcccgggttcaagcaattctgtctcagcctcctgaatagctgggattataggcgcccgccagcatgcccggctaatttttatatttttagtagagacggggtttcatcatattggtcaggctggtctcgaactcctgacctcaggtgatctgcccacctcggccttccaaagtgttgggattacaggcgtgagccattgcgcccgacctatgcatggcatatctgaagcttcaataaatgttaactgttattattatcagaaagaatactttcctaggtctgtgctgtccagtaaggtagccactagccacatgtggctacttaaattctttttttttttgagacagagttttgctcttgttgtcccgcttggctcacggcaacctccgcctcctgggtccaagtgattctcctgcctcagcctcctgaatagctgggattacaggcgcgtgccaccacgcccagctaatttgttgcatttttagtagaaatagggtttcaacatgttggcaaggctggtctcgaactcctgacctcaggtgatccgccgcctcagcttcccaaaatgctgggattacaggcgtgagccaccacgcccggcctaaattcaaattaattaaaataaaatattcagtttcttagtcatattagctacatgtatgtcacatgtgtgtcacatgtggatagtggctaccatatgggccagtgcagatagaacattgtcatcatcatagaaggttctattgaacagagctattctaggcattttcctagaatactctgaaaaggcaattcctagagtagctcttaacttgtctaatttcctcttttatttatttatttttgagacacggtctcactctgtcacccaggctggagtgcagtggtgccgacatggctcgctgcaaccttgccctccctgggctcaggtgatccttccactccagcctcccgagtagctgggtctacaggcgtttgtcaccatgcccagctaatttttgtattttttgcaaagacggggtcttaatgtattacccaggtggaccttgaattcctgggctcaggcgatctgcttgtcttggcctcccaaggtgtgagccactgcgcctggtctatttttatttttattttttagagacgtggtcttgctgtgttgcccaggctggtctcaaacttctaggctcaagctatttatttatttattttattttattttttgagatggagtttcacccttgttgcctaggctggagtgcagtggcgcgatcttggctcaccgcaacctccgcttcctgggttcaagtgattctcctgcctcagcctccagagtagccgggattacaggcatgcgctaccatgcccggctaattttgtattttcagtagagacggggtttctccatgttggtcaggctggtcttgaactcccaacatcaggtgacctgcccgccttggcctcccaaactgctgggattacaggcatgagccaccgtgcccagcaagctattcatttttttgagatagtgtcttactctgtcgcccaggttggagtgcagtggcacgatcacagcttactgcagccttgacctcccaggctcattcagcatcctgccattctataagatcttactgtagctgtggttataactccccccaggctgaaagggtgaaaattgagttaagattattcagctgggcatggtggctcatgcctgtaatcctagcactttgggaggccaaggcgagtggatcacttgaggtcaggagtttgagaccagtctgaccaacatggtgaaactccgtctctactaaaaatacaaaattagccaggtatggtggtacacacctgtaatcccagctactcgggaggctgaggcaggagaatcgcttgaacctgggaggcagaggttgcagtgagccgagattgtgccattgaactccagcctggacaacagagcaaaactacatctcaaaaaaaaaaaaaaaaaaaaaagattattctatgtaatcctccaattcactttccagatgttttcttcttcctctttgcaggtggagatcacacaatcacatatcccatattgcaagcgatggcaaaaaagtaagtctcaaatggcttgggcccagcaagatttcaaaagccagaagctagggaatgagttatttgctgtttggtggcattaggtgactgctgctggctcaggttatgagctgcttctggggatcaaaattaaggttgagctccaggtgtctctgtcagtcagcagctagaagccaagacaatttattattaacagttctggccaccctcccttgccctagatctctcctggtatgtgtgctcagcattttcaacttgcttctgtttttggaagatgagcctctagtgaaatacacaacctcagttaacttcagtttctgttttgcttcaatggccaaaaacaaacactgacaggcacaatggtggaccttgctgagaggcccttgtttcctcctgaaagggcacctttctcaatcaaaagactgatttgccagtagtggaagtctacccaggattggccgactttggctaatttagtttgagaaagagacagaaggacccgggtggagggtggcagctccagaatgtgtctgtggaagcacatgtgggtggcattctggttggaggtgggagggtgcaggtctttgctcaaagctgcatttattcctcacggatttggatcagatgtttattttgggtggctggcaggggttgatggaggttatggagagagctggattaaagcttcctcttcctcggttggagaaagggtgtgtcttggtttagttaagccttcagccaagctcccctgtgccaccacccttgattctcatcctgtctctaagtgaagcaaattctgggtgataggtgtgggtggcagccaaaacatgtctatttcctgcctgacttctgtgagtttattgttcctctgagatgcaaagtgatctcaagaagacaggaaccagttgcaaggcagaaaacggatgccaggtctcccctttttggctgtgaattgtcaccaagttttggtggcccgaagggtggctgtgctagggccccacagggagggttggcctctgagctgccctgttgtcatcaggcatggcccagtggggctgctgcacgtggatgcgcacacggacacgaccgacaaggccctaggagagaagctctaccacggggcgcccttccgccggtgtgtggatgagggtctcctggactgtaagcgtgtggtgcagattggcatccggggctcttccacgaccttggatccctacagatacaaccggagccaggtgacagaccgaatgccccccacccttgcccctcaaaatgtcttcctctccgttgcctcaccagtggcagccagggattgagcgggggctttactaatcaagtctgaagcagggatacaaggctgagtttgcatcatcaggggcataaggagcataggagtgaggaagttggtttatgggccatgggaagtctatcgctgggcgggggagacaagcagaaatcgaccaacccctcggacggtgctggcttagaagaggggaggaggccgggcacagtggctcacacctgtaatcccagcactttgggaggctaaggtgggtggatcacctgaggtcaggagttcgagaccagcctggccaacatggtgaaaccccgtctctcctaaaaatacaaaaattagccaggtgtggcggtgcgcacctgtaatcccagctactcgggagactgaggcaggagaattgcttgaacgtgggaggtggaggttgcagtgagctgagatcgcgccactgcactctagcctaggtgacaaagtgagactccatctcaaaagaaaaaaaaaagaggggaggaagtccggacccaagatgagttgccaccttcttagttctggtcctcgtaccctctaggcagaatggctctcagatagacgtgtatgacaagaccccaatggaacagacccaaatcccttgcttttagagcgtgccaaggccagtcttctggacagagcaattcaaaaggtgctagcgtgagctgctgtttcccactcttgctttagcaaagcttctctctgattccaactccatcagtcagctttgaccctgcttccttaccactcattgtccctcccttcctcacctgtaaaataggatagttccctcttcatggagatggagggtcaagtgtcatgtgcacacagagctgagcatggggctggcaaacaggaaatgccctgtaaatgctgccagacagaaacctcagtccctgtctctgcagggcttccgggtagtcctggctgaagactgctggatgaagtcgctggttcctctgatgggggaagtcaggcagcagatgggaggcaaacccatttatatcagctttgatattgacgctctggatcctgcctatgcgccagggacagggacacctgaaattgctggtctcactcctagtcaggtaaggagattccaccagtgaagatcctgggggtggagacacttaacacccattttcctgggacttgaagcgaatctttaggaatcaggataggatttttgtttgtttgtttgagacggagtctcactctgtcgcccaggctggagtgcagtggtgcgatctcggctcactgcaacctccgcctcccaggttcaagcgattctcctgcctcagcctcctgagtagctgagattacaggcacatgccactacgcccggctaatttttgtatttttagtagagatggggtttcaccatgttggtcaggctggtcttgaactcctgatctcgtgatccactcacctcggcttcccaaagtgctgggattacgggtgtcagccaccgcgcctggctgccaaggtaggattttaagagcagagcacctaggccttttctgttctctgggctgaggataagtttgaataccctcttactgaagggtgattgattttggcaagggccttcatttcctatctgggatataatagtcccttattttgtcctttatttgctcttcctgccttcagttcatctgtcatgaaaacaacagttcataggaacaacattatagtatcctctcttaagaacactaaacttggccgggcacggtggctcacgtctataatcccagcactttgggaggctgaggtgggtggatcacgaggtcaggagatcgagaccatcttggctaacacggtgaaactccgtctctactaaaaatacaaaaaaattagccgggcgcggtggcgggtgcctgtaatctcagctactcaggaggctgaggcaggagaatggcatgaacccgggaggcagagcttgcagtgagccgagatagaaccactgcagtctggcctgggcgaaagagtgaaactccatctcaaaaaaaaaaaaaaaaaaaaaaaaaaaaaaaaaaaaagaacactaaacttggccaggtgtcgtggctcacgcctggaatcccagcactctgggaggccgaggcgggtggatcacaaggtcaggagttcgagaccagcctagccaagatggtgaaaccctgtctctactaaaagtacaaaaatcagcccggcacggtggcaggcgtctgtaatcccagctacttgggaggctgaggcaggagaattgcttgaaccctggaggcggaggttgcagtgagctgagatcgtgccactgtactccagcctgggcaacagagcaagactccacctcaaaaaaaaaaccaaccaaccaaccaaacaaaaacactaaacttggccgggcgcagtggctcacacctgtaatcccagcactttgggaggccaaggcatcaggcgggtggttcacctgaggtagggagtttgagaccagcctaacatggagaaaccccatttctactaaaaatacaaaattagccgggcatggtggcgcatgcctgtaatcccagctactcgggaggctgaggcaggggaatcacttgaacctgggaggctgaggttgtggtgagccgagatcatgatattgcactccagtctgggcaacaagagtgaaactccatctcaaaacaaacaaaaacactaaacttatctttttagggttaaatttaaataaaagtgcatacaacgggccaggcgcggtggctcaggcactatcctcagcactttgggaggccagggtggatggatcgtttgagcccaggagtttcagcccagcctgggcaacatagtgagatcccatctttactaaaaataaaaataaaaattagtctggtgtgctagtgtgcacctgtagtcccagctactagggaggctggggcaggaggatcaactgagcctggcaggtcaagccttcagtgagccgtgatcataccactgcactatagcccgggtgacagagaccctgtctcaaaaataaataaataaataaataaataaataaataaataaataaaagtgcatgtgatggcacaattacctgccaaggtaagctcaagagttttagaaacacccaaataaagctccaataatgtgtgctgggagtaaatgcacgggggcagaatggttatgactagaatctccccaagggcaggacctatgtattgttccctaccttgtccttggagcctaggacagtgcctaatacaaatagtaggcactcaaagacatttgagagtaaatgaatgaagactgcttaaacctaatcaagtaccttacatcctctaagatcttaaaggagggtggccataactctctctcttgaaatggctgtaaccatcctctcttctcatgagggatttctgaaacacattcctcatccctctgcttagcaaccttctgggcttttcacctgcaggatgggaaccctttcagacaaggtcactctcttcccatcagtctccctcacttactctgtcttctggccacatcttactacctgaacttttcccatcttggtgcctttgcctgtgtttttccctctgcctggcctatcccttgaactgggtatttccaccttggggaagccttacccacctctccaggctattacctatgctgataccattctgggcttgctttccttgaagcccttggtgcatgacattgaaacgattggtttccttgtctccatcaccacaccatgcagccctgaggagcagggactgtgtacgcattatctgtttctctgggaggcctgccagtgtgcctggcagtcaacaaatgtttatggagggaaagccaattccaagtcaaagggtggcgtgggctgggaaaagctctactgggtgcttttcactgtaaatgattaccactgtggacaactcagtcttgatcttgaataggctctggagatcatcaggggttgtcaaggcctgaacgtgatgggctgtgatcttgtcgaagtttcaccaccgtatgatctttctggtgagtaagcaaagagactgagatccatgggcagccggtagcttaaattacacgaagctagttaataagtagaaaatggggccaggcatggtggcccaagcctgtaatcccagcactttgggaggccaaggtgggcagctcacctgaggtcaggagttcaagaccaatttggccaacatggcgaaaccccatctctctaaagatataaaaattagccaggtgtggtggcacacacctgtaatcccaggtactcaggaggctaaggcaggagaatcgcttagaacctaggaggcggaggttgcagtgagctgagattgcgccactgcactccagcctgggtgacagagcgagactccatctcaaaaaaaaaaaaaaaaagatgagtcccttatatgacttggggaagcagctgagcatgtccaatggtgaagaaaacacacctattactgcacaccttacaaacatgagctcattaaccctaacaaaacccccaggaggtagttaagtatcattagcttgcccaccaatcagcagaagagaaagaaaccagcctgtagtctagtgacagggtggcccaatccccgtctcctttgatgtttcattgcaaagtgaattctaaagcataaataatatatgttaatatttatcaaataggaacttagctggttaagatcttcaaagcagacgccatcccaataattttaatgtagacaaacttatggaattaggcctatcgacctcagaggatagataatacagtacacatcattattataggttctcctttgggaaaaatctgttctcagagtaaacaaagaactttctgaattttaaaatatgattcccaaatgatgcttgatggaggcagagagcctgggcaagcgtgttcacagctggcgggcaccctagaggggtgcacaagacagggctctggaaaaggaggcacaaggggaagagaaagctgaggagtcccaaggcttggctcagcgggtcgtctgcagggtattcatgtgaggttttactttttcttagggaacacagccctgctggcggctaacctgctgtttgagatgctatgtgctctccccaaagtgacaaccgtctgagtcttgtgctcttcaagacaaaacagattgcgtcgctgacaagttctcaagaagaacttatgagtaagcagtctgagaactaaagagtttatgccaagaaaactttctgctgaaagtgtcattgctggctgtgaagtcgggataatcagtagaattctcacccaaacagcaacatttctaaggaacttggattaattgggggaaaaaaaaaggagtacttgtactgctttgattttttttcctttgatgaaagatggaggataaaggggaagtgaggagaatttctttcaagattatctaaacattagaaacatgacatttaaaaaaactatgaaataatactgtataagcattccatatttctatatcttccttttaaacatttttttttttgagatagagttttgcttgtcacccaggctggagtgcaatggcatgatctcggttcattgcaacctccgcctcccgagttcaatcgattctcctgcctcagcctcctgagtacctgggattacaggtgcctgccaccacgcctggctaatttttgtatttttagtagagacagggtttcaccacattggccaggctggtcttgaactcctgacctaaggtgatccgcccgcctcagcctccttaaagtgctgggattacaggcatgagccaccgcacccagccgctttttaaaattttgatgatctgcttcctagagtattgagtatcttcctttaaactacagctcctcctcggacgctgcagtgagctgagatcgcaccactgcactccagcctgggtgccagagcaagactccatctcaaaaaaaaaaaaaaaaaatacagcttctcctatgaggtgcttagggctgcatcttggttttaggaccactgtgaacgtaagtaaaaagtataaagtaacacggagagcctaatgaagaaacttcttgctcagaggcctagaagggtacacaaaatgtcttctaaactagaaaacctaaggctggacacggtggctcatgcctgtaatcccagcactttggggggcggaggtgggcagatcacttgaggtcaggagttcgagaccagcctggccaacatggtgaaaacccatctctactgaaaatacagaagttagctgggcgtggtggcgcgtgcctatagtcccagctactcaggaagctgaggcaggggcattgcttgaacccgggaggtggaggttgcagtgagctgaggtcatgccactacactccagcctgggtgacagagtgagactccgtctccaaaaaaaaaaaaaaaaaaaaaaaagcaggccggacccagtggctcacgcctgtaatcccaggcctaggcgggaggatcacctgaggtcaggagttcaagaccagcctggccaacatggtgaaaccccgtctctactaaaaaacaaaacaaaacaaaacaaaacaaaaaaaccccagaaaacaaaacaaaactggaaaatgtcagctgggcttttttttttttttttttttctgagatggagtctcgctctgtcccccaggctggagtgcagtggcccgatcttagctcactgcaatctccgcctcctgggttcaagcaattctgctgcctcagcctcctgagtagctagaattacagtcatgcgtcaccacgcccggctaatttttgtatttttagtagagacggggtttcaccatgttggccaggctggcagctgggctcttaatgttacttattgtaactcacttcctgtaagactcaatctactcttcaagttgatgtaccctctatgactgtaattcctgaaatctgcagttatgctgtggtgatcttaagcgtgtcttgagttccatgcaaattcaattctgttgataatgtgtccataatcaaatcatcatcttgcaatgcaagggctaccccataattatcagacattaaaatagtttatttctttttccattctgtaatcttaaaataacatcagcttcagtgcctgttcacaatacaaaaaaagtcaaaaaacaaaaacaacacccaaaacataaaaaagaaacaatttgccaaataagttatttgttcctaagagtatcaaaagtgcaaaatattcaccttcttttcagatctctcccaagcataattatcctccttgacaaactgaacagacagattcagcagctgccacactgcacttgtttttaggggacaatgtcagacaggtggatgtgaactacagttcctctgtaaagatgtttggcatcagcttttaaagaattctagttaacaaaacaggtctgagtatgtgcttccaatctctattcccaaacaaaggaaatcactaaaaaaacagatcacacttctttttataacagaaaaatatttatgtaatgatggcagctgcaaattgattgggatgttaataaataaaaaggaacaagtatcaacaagctgcaaatgaggaagaaaccaacctacctgaaaactacaaccaaattctcatggctaataagtgatggcagtgagaccatggcccctaatggaagttagggcagcctcacccactgaaatgttgtttagttggagctgatagcctcagtgttagataaaaattgtgcaacacctgagcaacaaattttttttttttttttggaaattggcatgtattctgcaaagacttgttttaggccagttttaccccatctgctaaacgcaatgcatagtctgtatcaaccagaagaacccatctctaaaaacatcaatgttgatagtcaaagaccactgtgttagaaccaaaatcaggtcttgtatgattacatacatcagacagagcaatggtggcacaggctgagcatgacaatggctcatatgtttgacgcaaaagtaaacaaattcatggatgcattcaggaggaatgccttgcatggacaagggtaaagttcaatttaaaataaaagctccctaatattctcatagggcaccagctctaaaccggtctgtagaagagcttttgggctgaaacatctgccaggaacattgccaatcccatcactaccttcatttcctagtgcaaatggaaggtgcagctgtttgaaggtgctttttaaaagatcaaaagatgacttgaagagataaaaatgtttaaaaatgaacaaatctggcatggtggctcatattgataatcccagcactttgggaggccaaggtggaaggactgcttgaggccaggagtttgggaccagcctgggcaacatagcaagacctcgtctctattaaaaaaaatataaataaatacacttggagagtttttggttttcagaaattaaagtcaggaatttcattagtacagaaattaaaaataaaaacctactaccaaaccaaaagaccactcatataagcaatctggccataaaatacctagaaagtaatattgaggactgatgtatcaaggagccaaatgaattccttgaccatttctagttggaccaggtgccatgagatacagcattcagaggaagtgtccatttttagaggatcatatggaagaatgaagcctggcagtgatttattttttaataaagctacagactccatgaaaactacaggaattcctggccttaaataatttattacttaccaatgtagctcaagatttaaattattcaggatccaagtggcttagtttaaagcattaagattaaagaaatactaacttagccgggagtggtggctcacgcctgtaatcccagcagcactttgggaggctgaggcaggcagatcacctgaggtcaggagttcatgaccagcctgatcaacatggagaaatcccgtctctactaaaaatacaaaattagccgggctaattacatggtggcacatgcctgtaatcctagctactcaggaggctgaggcaggagaatcacttgaacctgggatgtggaggttgcggtgaaccgagatcgcaccatttcactccagcctgggcaacaagagtgaaactctgtctcaacaactaaaaaaaaaaaaaaaaaaagaaatacttagtaaatgtcccatcactgattttcacccttcacaaagccaccaaaggcaccttgctttgacatttgaacggaccactctttgaagctgtccaaactcaaactcagaaccactggtcattctgccctgaaaaataaaaggtatgctctctaactggctggtatgaggcaccctggggtccactatacctggagctcagcacgctcaggtgctgatggccagtctgaccccaatactggtgaagcagctctaagttaagagtgaaaacaatgaagatgagacatcaaaatacagcccagaagtggaaagtaagccttttgcaaaatgggagtctagaacaaatcttggctcacttcctgcaaaagatgacttgaagagacagcacttttagggtaacagtgttcaaaatacaattgttgagaaattttaagttccttgatacaaagacatgtttggtattttactaaagagacactattgaagagattccttaagcctgactcatagcaggtgggaataatttctcttcagtttaacatctactggctttatagcagcttatctctacgttcagagaacaagattacaagttatggctcctaatatccataccctaaaatcgacagaggcagaaaggcatctgaagacatacatgtcaacggctcaaagtcatcacagtacttctcgctgtgcagacccctcccctggctaccagcagcgctggggcggcggatgggatgctcacagcgtgtctcaaggctgcatcgcttcagccactgctcagcctccctttccttttcttgagaactcacatgcagaactcccgtttattcctttccttttcaacctgtggccaacaaactgttgttgggggatacccccaaaatatacatttagccacttactcccagaacaaccagtaaacgtgagattgcttggaaaggggcctttttccagatgcggggctagaagctgccgtgggttgttcagagttaggagcatgcgccatggcagcagcacagcagggccgggattggggaaggggccaatgacctggcctgcacgacaggctcatgagggtccgccagatgccgcttgcagggtggagccctgtgcttctccaagacacaggacaggagggtggggtgagcatgggacaaggacaagaaaggaagaggggatgagcagtctattttcaatggtgtggcattcagtggggaaaaataacacccagaggaaaagattttcatctaggcgattcaaactggtggtgtttttcattcctaggttagaacaggacaaaggaaagattcttctagccatggttctagaagagcaatctaaaatctatactctgttcattgtggtagtttgagtcctgaaaatacctgttcacaggggcatgttaaaaagtctgaagagttcaaatctctttggaaaatcctctcagtctagttcaggccatgatgggatataaaacctctgtaaggagccctccagcaggcgttccatccataaagagagcttgctcaactttcctttgatgggcctggatccaaggccacaggaaggtttccctcgagattcacccaggtagagggaagagtcaacatcactgcacgaccctatggcttcctcctcttcgactgtcttttggggcttgaagaggcagaagtatttcttgtggccattcagagccagtacataaccagtgtagtcacgctccatgaaatgcttatcatattggtttgggattggagctgcatcttgagcaaattctagtaagtattctagccattctctgtgtttatctagactcaggaaggagaagtgtaggcagctgctcctgtaggaagaagagaattgaggactcagggcatttcctgacacatttaattgctgagaaaataaataccccagtgagacttaaaataataggaaaacgctttgtgttggatggggcctgaacacagagaaaaagaaggccttctgtgggagccagtgcctctccagcagctgcgacacttcaatcacccattcccccatcgcttgctcggtggaacttaacattgctcttctggaaaatacacaagggctagagaacagtaactgaaagggctcagggaataacactgagttcaagcttttctgttcagaaccaacaaaacacgaagtgaagtgggaaaagaggtccctgtcgcaatggctcagatgtctggattggaaaggtcacagccagcatcttgctgtatggatgaagccccacaagaccaaagagaaaagcgtgcaatttcagtgtgcctgcctctctctctctcacacacatacatacatgcacacacacacatgcttacccagtaaatgtgtagacctccaaagcaaatttctgtagtaggctggtcttggtagaattcgacaggatgaggaccacattcatgtggcctggcctcagacgtaccaagttactggtgtatgttacatctgtgagttcagttacctccacaaagccttttttaggaatcttgctgtggagaaatattgaggagttaagatgctgtcaggatagggggaaagccgttactttgaaaagaaacagctgaaagaaaatgctatgttctaaccagactaggtatgttattcactattcttgagtctaacacattggtaggatggggatggcctgacttggtaatccctgacctacaaacagcctttctgtgctgcttttctttttctttttgagataggttcttgctctgttttccaggcttgagtgcagcgacatgatcatggctcactgcagcctcgacctcctgggctcaagtgatcctcctacctcagcctcccaagtagctgggactacaggtgcctgccaccacatccagctaattttataagttttttgtagagacagggtcttgccatgttgcctaagctagtctcaaaccctgggctcaagcaatcctcccacctaggcctcctaaaagtcttgggattacaggcgtgagccactgtgccctgcttgatgctgcttttcaggtgcagaagttgctctaggacagaatgaagaagacaactatcattcagtctatgttctttgtctcggagaccctggcctcttgctgctgggtgtgtgtgcgcacaagactggttacgttcattgacatttacagggataaaccacgtcctgcttctggctcacctaacacttgcctgataggcttctttccttctgccttcattatgaaatctaaggcatctaaacacctacagggtcttagtaaacacaaatcacagtgacttttccctgtagccacagtttacatgggaggaggtgcatgagagttcttctctacactctatgttccaatgctgcgttatcagatgacaggatctggggggcaggtgccggggaggtgagtctggtgttttgttagagaaacctgctgttttctttggtgaagcttggctcagttttcccagtcttctcttgggcttcctctttttctggagggcttgactctcgctcatcattagagtcgctaaagtaagaaaaaaggagttttacaaaaaaagtgtcaacaccaaccatggtggtgcaccgagaagccacaggacatttacctgaaagcctgaacgatgacagtgccgaagaggatgaagagggcagagaagatcagggacagcaggggcatcatttccctcctaaaaccaaattaacaaactattagctcaagttaaaatttcttctctccagctaaaaaaagataaaataaaaatcccaaaccaaaaactcttcacaccaataaacgcttactaatttcaggcaaacagagcttttcttggcgggtggaggtggtggaggggaaggtagagattgctcagtgttctaattcacagacagcttattctaaaagtttgattttgtatctcagtataataggctatgctcaataagttctgcatgaggaaacaataaaagggataataaaggacttaaggtgtaaacatggaagaattttctgacattgtggaattatttcctcaactttactgatttttttctggccagaaaaattcagatgtagcccagaggggtggagtagggagataaaattgatctttcaagatttcatctaggactggtgttctgaaattttatgtacctaccaacacccatcaaaggctgtcatttgtcaggtgctgtgttgggtgccaggaatcacaaacacgaatgagatgtggttctgtccttcaggggctcatggtctcatcagtaggtgggagtgggtatccctcttgaggttaattcactcattccttttacatctatacactggactccacgtgtgtcaggccctgtgctgggcaccagaggttccctgatgaagagacagtcccaggctctgctgcccagaatggcagccatgggtgatcctttcctagccagtgggaaagggtcagtcagccaatataaaaaaagggaagtggccgggcacggtggcacacgcctgtaatcccagcactttgggaggctgaggtgggtggatcacctgaggtcaggagttcgagaccagccttaccaacatggtgaaacactgtctctactaaacatacaaaaattagctgggcatggtggtgggtgcctgtaatctcagcttctcgggaggctgagacaggagaatcgcttgaacctgggaggcagaggttgcagtgagctgagatcgtgccactgcattccagtctgagtgacagagtgagactctgtctcaaaaaaaaataaaaaataaaaaatgtccgggagcagtggttcacacctgtaagcccagcactttgggaggccgaggcgggtggatcacctgaggtcaggagtttgagaccagcctgaccaacatggtgaaaccctatctctactaaaaatacaaaaattagccaggcatggtgacaggtgcctgtaatcccagctactcaggaggctgaggcaggagaattgcttgaacctgggaggcggaggttgcagtgatccccagattgagcctgggggacaagagcaagactttgtctcaaaaaaaaaaaaagtaaaaaataaaaaaaagggaagttactgaaagaaagaaaaaggggaatagaaaatgtgtaaacgttcttccacttgccccatcaagtgtaccttgaaatttaataatgatgaactcttttcaaaagaaaaacagtgatatcagtattaacagagaaaaagaaattcagcctggcaatatccctaccagttgttgtgaaaaatgctatcccagcagtctgagatgtagtcagaagcagagtagaaccatcgaaggagaaaaacctatgtagagagaaaatggatgatggtcaggactaaagccggaagggagagtccctctaccctgcaacacagtgctgctgctggacctctgctctgagcagaaatccgccaccagcactgtgtactcacaagccctcctggtgtcccacccttcccagccccgatgctcacaggggcaagttcatcggtcaggtcaggaagcactgcttcagaggacagaagagctggatctttacgcagctggtcgagatagcccaagaggataaatttgtcactctcactcccaatccaagggtcttccagggttttatacaccacccttcctgctgtgttgcgcctttctaaaatagacacctggaagaaaagtagagaaaaaacatcagaagtttcaaaagcatggttaagttacagttgtttgcttttttttttttttttgacggagtcttgctttgtcgcccaggctggagtgcagtggcgtgatcttggctcactgcaagctccgcctcccgggttcacgccattctcctggctcagccttcccaagtggctgggactagaggcacctgccaccatgcctggctaatttttggtatttttttttttttttttttttttttttagtagagatggggtttcaccatgctagccaggatggtctcgatctcctgacctcgtgatctgcctgccttggcctcccaaagtgctgggattacagctgtgagccaccacacttggcccagttgtttgttttttgagacagagtttcgcccttgtctcccaggctggagtgcaatggtgcgatcttggctcactgcaacctctgcctcccaggttcaagcaattctcgtgcctcagcctgctgagtagttgggactacagacaggtgtgcaccacaccagctaatttttgtatttttagtagagatgaggtttcaccatgttgattaggctggtctcaaactcctagcctcaagtgatccacccgcctcggcctcccaaagtgctgggattataggtgtgagccaccgcgttcggcctaagaaataacttttatggtgactttcctaagcttttgttaaaagttaaagctcttttttctcaatagactttgctctataaccttgacttaatattaatggaaacctttgttttttagagagattttccatgattgcgaaaatgatgaaaagtcagaggagaatttcttgtttctgtaggaagtgatgacaatgcaggagaaaggcaggagagatcaaccaggatgaagttaaagaggcagaggggggcagaaatttccagagcacattaccagtggcctaaggatttgtaaaatctaggatctaggatgctgcaagaccagacttgccttagtaaaaaactggtgaaaagcactgatgacctttaccgttcactgatagaaaacatggtttctgtgggggcctgaggctgacatccagaatgtaaaaagaccaggtcaaaaactgttttaagagtaggctttaggccaggagcagtggctcatgcctgtaatcccagcactttgggaggcgggaggattgcctgagctcgggagtttgagaccaacctgggcaacatgtcgaaaccctatctctacaaaaaaatacaaaaaattagccaggcgtggttgtgtgtgcctgtggtcccagctatgtgggaggctgaggtgggaggatcacttgagcctgggaggtcgaggctgtaatgagctgagatcatgtcactgcactcccagcctgggagacagagtgagaccctgtctcaaaagaaaaaaaaaaaaatcaagaaaaaggaaaaacaaaagagtagactttgaaaataggcttcagagtttcagatttcctagaatctgtattcaacactctcaaggaagaaggaaacagaatcaagtgccacatggttatgaagagcctgggatgaggagagactctgtggcttaccgctgatttcccttgaaacgcctcactgtctggtagtaaggtgtcggcaaactcctgctgccgattgctgtagacatgcacaaatctca

SEQ ID NO: 965 - DNA, 1729 bp, Homo sapiens
tgacctttgagccggctcgggttccggctctggcgcgtgcacactcgcctcgccgttcgggaccagccagatcgcggcggcctcgcgggcggtttggtcggtgaggtcttggccgcgcgcggcaatgctgaggctgctggcgtccgggtgcgcccggggcccggggcccggcgtgggcgcgcgtcctgccgcagggctctttcatccggggcgccgccagagccgccaggcttccgacgcgccccggaaccagccccccagccccgagttcgtggcccggccggtgggcgtctgctccatgatgcgcctgccggtgcagacctcccccgaggggctggacgctgccttcatcggggtgcccctggatactgggacctccaaccggcctggggcgagattcggacctcgccgcatccgggaagaatcagtgatgcttgggacagtcaatcctagcacgggggccctccccttccagtccctcatggttgcagacctaggcgatgtgaatgtcaatctttacaaccttcaggacagctgccggcgaattcaagaggcctatgagaaaattgtagcagctggctgtattcctctgaccttgggtggagatcacacaatcacatatcccatattgcaagcgatggcaaaaaagcatggcccagtggggctgctgcacgtggatgcgcacacggacacgaccgacaaggccctaggagagaagctctaccacggggcgcccttccgccggtgtgtggatgagggtctcctggactgtaagcgtgtggtgcagattggcatccggggctcttccacgaccttggatccctacagatacaaccggagccagggcttccgggtagtcctggctgaagactgctggatgaagtcgctggttcctctgatgggggaagtcaggcagcagatgggaggcaaacccatttatatcagctttgatattgacgctctggatcctgcctatgcgccagggacagggacacctgaaattgctggtctcactcctagtcaggctctggagatcatcaggggttgtcaaggcctgaacgtgatgggctgtgatcttgtcgaagtttcaccaccgtatgatctttctgggaacacagccctgctggcggctaacctgctgtttgagatgctatgtgctctccccaaagtgacaaccgtctgagtcttgtgctcttcaagacaaaacagattgcgtcgctgacaagttctcaagaagaacttatgagtaagcagtctgagaactaaagagtttatgccaagaaaactttctgctgaaagtgtcattgctggctgtgaagtcgggataatcagtagaattctcacccaaacagcaacatttctaaggaacttggattaattgggggaaaaaaaaaggagtacttgtactgctttgattttttttcctttgatgaaagatggaggataaaggggaagtgaggagaatttctttcaagattatctaaacattagaaacatgacatttaaaaaaactatgaaataatactgtataagcattccatatttctatatcttccttttaaacatttttttttttgagatagagttttgcttgtcacccaggctggagtgcaatggcatgatctcgtggctcacgcctgtaatcccaggcctaggcgggaggatcacctgaggtcaggagttcaagaccagcctggccaacatggtgaaaccccgtctctactaaaaa

SEQ ID NO: 966 - protein, 352 aa, Homo sapiens
MLRLLASGCARGPGPGVGARPAAGLFHPGRRQSRQASDAPRNQPPSPEFVARPVGVCSMMRLPVQTSPEGLDAAFIGVPLDTGTSNRPGARFGPRRIREESVMLGTVNPSTGALPFQSLMVADLGDVNVNLYNLQDSCRRIQEAYEKIVAAGCIPLTLGGDHTITYPILQAMAKKHGPVGLLHVDAHTDTTDKALGEKLYHGAPFRRCVDEGLLDCKRVVQIGIRGSSTTLDPYRYNRSQGFRVVLAEDCWMKSLVPLMGEVRQQMGGKPIYISFDIDALDPAYAPGTGTPEIAGLTPSQALEIIRGCQGLNVMGCDLVEVSPPYDLSGNTALLAANLLFEMLCALPKVTTV

SEQ ID NO: 967 - DNA, 49087 bp, Mus musculus
  misc_feature (1)...(49087): n = A,T,C or G
tactatggccccagagctaacaagcaatgatgccagtcaccccactccaccccaccccacagattctgtgtcactatgtaactcaggctggctttgaactcacagaccctcatgactcagttctgaaatcctggtattctaggtatatgccaccatatcaagctggcaatttagacataccacagcaagggcataaaatgctcctttaaatgaaaaggtaaaagttcatcaaaggtatgtatgcattgagagagggggaggggaaaacaccatagtgtatgcagggttcagtattatctgaggttacaagacaccctttagagatcttggagtgtatgtaccctagccatggttatgtgaagcctagtgtatatatttttgattgcctcacagtacttaaaagaatgtacttttgtactgtgtatgtactgggcgatgtgtgagtgtgtgcacttgccacggtgcacatgtggaagccagagaacaatctgtgcgtcctaaggatcaaacgcaggctgtcaggtggtaagtgcctttacctgctgagccatcttgacagcccacctcacagcgctgtgttggcatggattgggattgacttgactttttaaaactgagtaggacaagttcaagcatttgcacaaataaaataggaaaatgagctgcacaaacttatcatctagaaggaagaaatgtgctagaaggaaaaactaaataggacaaaaggacacagcgcagtgcacatgagcaggtctatatagaacggcacaaaaaatacacaaacaaggaagtgacggcagaggacagctgagtcataagggacaaactgcaatcactggagacgagcagagacagcacagcggagaagtgaagctgagcaggactgtgcctggtggtagcgcatgccagccactctgagagggcatcatggaggcctgcagtagaggacagaggtagctgggagcccaggcaggcaggaaactcatctattgtctttactttattctgtgtgcgatacagacactgagttctagcggtaacggccatgtaagacactaaagagatgacttgctagtgtgagagaaacacagtccttttgttacatgtagaacaggatcacgggaaaggctgggagggaaaagcccgcccaaaggggcttagtaatgtaggacttgtggtcagaggggtcctgacggtgcagagggcaacgaccacacctgactaagcctgaaggctggctcctactaccagctctgtctacaggagcagaacaacctcgagccaagctgtctacctgaacttagtcccccttggcagtcttctggggtcactgtgagaatccaatgtccacagaggagactgctctgttactgcttctgagacaggctagacaccaaaggaagttcttagtaaaagagaaattggattgagtcatgataccagatggctttcattctcaccactgactcaattctgaaataattatatttcagtatggtaattatgatccaagctatataaacacactgtaaacaccaactctgaacagatgaaaactcccatatgtaaaaaggtagtgactgttgtaggaagagcttggagatgaataggaatgaaaatggaaaaaaaaattaaaatgtttctcttctagcttctgataagagtaaatgtttactacaaaattcaaatgttttaaacacttttcgtgccacacagtattttcagcctactgcgtatctgtacttttgagttttaacaggatgagtcactgggaacagcatttagatttggatttggggggaaaaaaaaaaccagaactactaggtacccatttcagcacttaaaaaatattacagtcacatttaatttttgtaaaaagagccggccagccagtcctgacctaggcttttaacaccaacaaacaaaacaggcagaagcaggtagatctgtgagttcaaggtcaatcatgtctacagggccagttccaagacagctagggctacacagagagaaagcctgtgtatgtgtggggagggggtggggggggggacaaacaaacaagcaaaaagcaagacaaaacaaaacaacttcccccacatggatacacacacatcaaggactagcaaacaccacaagggcctgccacagagtcaggtatagtagtgcatattggcagttccagatacttgggaggccgagataggaagacgacatgaacatgggacttggagaccactctgaacatcacaagaccccaccttgagaataaaaacaaagctgccactcataattgagggacagaaggaatctcagtgcaggagatctgaggactgagcgccttatcctgcacccaccccaaggaataacttttgttttatttttttctaggtaggtaggtagatatgtatttatttttattttggttttagacaggatctttatgtagccctggctgtccagaaatttgctacataaaccaggctgacctccaattcagaaatctccttggatctgtctcccaatagcagcgataaaagctccaagtaacagtttttagttctaatcagttatcattaagaactaactgcatgggctgcacgtgtaactcagcagtagagtgtgcctataggattcgtttcctattaacatacagaggaagaagcttcacataactaaaattcacccaggtaggttgggactgtacgtgtaacgcagccgaccatgaagaggccctcagttcaatcccaggaactggaaaacaaaacaaatcaaacacacacacacacacacacacacacacacacacacacagacacacagacacacacgtaggttgaacatcccactatagagcattctatataaatgaccttaagctttaaaaacaactattattaaattattaaaagcaaacctggtatggtggcatatacctttaatcccaacactgggaggcagaggagtgggcctctgagaagtagaggctagcctggtttacacagtgagaccccatctcaaaacaaaaagcaagcctaaagcttgcaaatgcacacccataattctagcatttcgaggctgagataggaggactgagacctttgagaccctgtctcaaggagaacaagaagtgcacgaagaagccagggacattgaacaactgaaaatttagcagtaactttctcccttgcatctttagtttgtatgtatctgaattttttttaaaatttatttatttattatatgtaagtacactgtagctgtcttcagatactccagaagagggcatcagatttcgttacagatggttgtgagccaccatgtggttgctgggatttgaacacgggaccttcggaagagcagtcggcacactgagccactcagaaatccaactgcctctgcctcccaagtgctgggattaaaggcgtgcgccaccaccacccagcctgaatttttaactgatggtttaatttgccagaatgagaaagtacattacacttttatgactgagtcccacgggaatgtagaataaatggacccaaatggcacgttactgaagactttttgatcactgtttataattatcctcagtaaacttaggcttctcacagcccatctttctctcgcagtgttatttctgcctctgtggctttgatatttcatagacttggttgtaaatctcattaggacttgtttttattcagctgcaatgctgtagagtggctagcacttttgaaatcttgtctctggaagcacacacatctacctaaaccttattaacttgactctgaacaaaataacaaccccgtgaagcacagaggcaaatttacttgcatttatccatcgaagctaaacaaaaacaaaagccacaaaacacaacccccttaaacaaacaagcacctaactgattaactaaaaagctatgttttgacatgtggtgtgtgtgcacacttgtggaggctccaggctgatgccctccttcctttccaccctaagcattgagacgggcctttcacttgaacctagagctgtcattgctagtctagcatttagggggtgctggggatccaaactttggtcctcatgctctcatggtaaaagttttcccaccaagacatctatctctccagccccctacttctaaatgctgtactctaataccatattactaaagaatatttaaaagctgggcacagtggcacatgcctttaatcccaggaaaaagcagacagatctcagtgagtttgaggtcagtctggtctacacagtgagtgccaggacagctagggttacatactgaaaccctgtacagaaaaaaacaaaaacaaaacaacacagcaacaacatagcaaccacgagtccccaagttaacccccagcactaaaataaagtattaagaactaatttcaggggctggagagatggctcagaggttaagagcactgactcttggttaagggtctgttcttctgaaggtcctgagttcaaatcccagcaaccacacagtggctcacacccatctgtaatgagatctgacgccctcttctggtgtgtctgaagacagttagtgtacttacatataataaataaataaatattttaaaaagtttttaagaactaatttcaaatttaagtaggatatgacagtacatgttattaattctagcactttggaggcagagacaggaggatatctgtgagttcaaggccagcttggtatacatggtgagttctaggtcagtcagaactacacaggaagactgtcttgaaaaaaatttaaaaggcggagggagtatgctcagagattaagagcactaactgctctcccagagatcctgagttcaattcccagcaaccacatggtggctcaccaccatctgtaatgggatctgatgcatgtatgtctgtgtgaggatgtcagatcttgaagttacagacagttgtaagctgccatgtgggtgctgggaattgaactcaaatcctctggaagagcattctccagcccttgcttaggatttttaacattccttatgccagaggattcattttccccgagtatccatttctttatcatctatctttggggctgaaaactgaacttggagcctaaagctattcaccaagtttctctacttccaagcaaaaagaatcagggtcatctgtactccaggctagtctcacagtcaaagatgacctgatatccactcctaagtctcactcttctgatgggattatagatgttggtcactaggcccaacttatacagtgatggaaactgaaccgagggctcccggtgtgctagctaagccattatactagctacattctgagccctagtgcacaaaattctaaaaatcacaaaatcacacactaaagcctcatttccaaaggtcctagtaggcctgaaaagtaagaactcactgagaacaccagagaattttctaaggtaatggaaacatttcctatcttggaggtaagagttatacttacacagataaacactggtcaaaactcactcttttagccaggtatggtagtgtatgcctagaatccttggcaggaggatctgagttcaaagccagcctgggcaagatggtgagtttgagattgagttggtctaaccaaatctagtataacccccaaccaaaaacaaaaacaaaaagcaggaaagtggaaaggcctgaatagaccaaaaggtcaggcctcaattaattttatagaaagagaaatttaaaacctcatcccacactggacttgctaaaagctgaggacaggggcactctcatgtaaatttacaggaccagtttccaccctagtgtcaaaggtagacagaggccctcacaaaccccaagcattccattgttattctgatgctatttatgagagtcattctaagagatcaggctgtcccacccctggagaaaaagccagaatcctgccatgaggaagaacacatcaagtcaggctttgcctggacagggaggagggatggcagagtgaagaccacctttctgtatttttaaaactcttcagggatgaaaaatacaaagtccttttaatacagagtgtttttctctactatcttaagcctctgctactcatttgcatgaacagtaaccacatgaagaattccagctgagtaaactcttctgttgacttaccagatcggacactctaagattttctgcatagcatgaaggacattttgtacttcttgaatttggacggcagataaatccatttcttccagttccagtgaacttttaacacaaatttaaaaacacatgcaattaaactacattaaagggcttttaaatacagtagcttaccttgccaactttctttccctttttgagacaagatgtcatgtaacccacactggctttgtaccttatgtactcaaggctagtcttaaacctctgatcctcctgcctccacccacttagtgctggaattactgaaggtaagtcacccccatccatgctttttggaggagttctcacgctgaagcccacacacatctggaaataattatgcagcccagattagcctccaacttgaagcaatcgccctgcctcagcctactgagtacaggtgtttaagctactgcaccaggcttgtcatttctaaataagaaaaatttaaatttggagtgctttagaattataccaacagttgatgaaaaaacttcactaaaaaacaaaaacaagggactaataagatggctcagcagttaagtaaactcactgctcttccaaaggttcaattcccagcatccacacggtggctcacaaccatctgtaatgggatccaatgcccttttctagcatgtctgaagacagtgataatgtactcacatatataaaatgaatggaactgtttaaaaaaaattcttttaaaaactccaaaaccggactggagagatggttcagcggttaagagcactgactactcttccacaggtcccgagttcaaatcccagcaaccacatgatggctcacaaccatccataatgagatctgatgccctcttctggggtgtctgaagacaactacagtgtacttacatatagtacattaaaaaaaacaaaaacaaaaacaaaaaacaaacccaacccgggggctggagagatgactcagcggttaagagcactgactgttcttcctgaggtcctgagttcaaatctcagcaaccaagatggtttacagccatctgtaatgagcttagatgccctcttctggtgtatctgaaggcagcaacaatgtactcacataaaataaataaataaatcttaagaaacaaaaaactcagggtctggagagatggttcagtggttaaaaatatgtgcctcttcccagcacccatgtcagatgtctggaacgctacatccaggtcagaacctctgcacacacatacacataattaaagataatgaaaaatgaatctttaaaaaataaaaatttctccaggcagtggtggcacatattcttgatcacagcactgagagtcaaaggcaggcagatctctgagttccaggacagcctggactacagagtgagttccagaacagccagggctatatagaaaaaccctgtctcaaaacaaaacaaacaaacaccaataaatcaacagataaataaaattcttagcagttgctctttgtagctagcaatctaaattctctactctttgatatgaaagccttccttgggtcacttcctttcttcaaggaaaaaaaaaaaagctaaaatggagtgactggacagaagtgatatatatatgaactttccccagagtctggtgttctttttcttgcttagaatcaaaaccagtggtgtcatacctatagtttcagggactggagaagttgaaggaggaggatggcttggactcagaagttcagcagtctttttgggctagtttggggaggccaaaagatcagatatggttgtttcaacctgtactttcagcattcaggaagtacaggcaggaggatagagttcaaggtcacctagagctacacaacccaattacagaaggccctgtctcacaaactctaaaactagctgagaatggtagtggatatctttgaccccctcctccccagagacaggggcaggtggaggagtgtttaagaccagcctgttctattatacacagctccaagccagccagagctaatataaatgagactagactctgtctcaaaactaatcaactacccagcattcaggaggcagaggcaggtggatctctgtgaattcgaggccagcctggtctatagagctagttccaggacagccaaggctacacaaaagccaaaaccaaaccaaaccaaaccaccaacataaacgctaaccaaccaaacaaaaaagaagcacacatattattttaaaagtcgccaaaaggaacacttaaaaactgctaaagcgtctccaccctacctcttctggatgtttccctgttaaggctctctttaaacacgtcttctctgccaacagcattcattactattgccattcccttatgtacttcccttctagaaccttctgtgaaatgtactcgggtctagttcttcaggagtttccctccacaaactccgtttttcccccctcttccctgccacacttctgcccgcctttcctctcatcctttagcccgcatccgtatacaaccttcaagatacgattacagccagaactccccctcgtagatcctttgccctcttcctcacagctgcccccgggaatgcacaaactgcacccttcccaagagtcctgtttgaaaacgtctgggaccctttggttccgccccaggtactttcctaatcagtaaacacccgtctccaccagcagcttcctgcctttcatatgagtattccggggtaccctttctgttcctcagggctgtctcaccttttctccgagaaaaaagatccgtacttccaagcgccgaggacggagaagccccaagagaggtgctggatcctctggctgcacgggcagcggccgcgcagccgcaattacaatctatctaaaattcccgcgctctccgtcgccaaggaaaccggccgcttggcgcctagcgctagcctttcggaacacaagatccagacacgtcagcggaagggaagggaggagcgagttgggggggggggtgctgaaactgtttctgggtttgcgattggctacctagtctttttttttcctgtatgtcgtcactagaaagagacggaagagaaagaatttcgaggtttctcttaggcagccccttcgcatctacgcctgcttattacgtcacagtagttctgtacaaagggtgggaatcgctccctgaggccggaatatgagcgcaaggtagtgcccaaagcagttgcaaaacgaggtctcatccctccctcagccttcctgccatggaagtctccagtttcggtaaataagagacttgtgtaagaagaactaccaattccagcatgcattgcggaacgaaaggccttctccacagcatctcttggaaagtgtagtcttacgggaaaagagcttctcacaccggaagcaggcacgagtaccacaggaacccagtcggtacagcggagacctcctcgcagttatgcgtcttagctgctatgaatcgcagcgttctgtgttcgtgttttgtgcacagaaaatagactaaaaggagctgtgggttccaggaagactacaattcccgtccagccccgcgattctcgggtaactagtccgccaatgtcagtgacctgggaaaagcagagggtggccaatcggcttgggaaagggaaatccaaccagctgacttctgcgcgctagttccgcccctcggcctgggtgtttgttattgttatgcggttcagagagcttctgtccctcccttgccaacgcagcactgaccaatcggtagagaggttattttgaggggcagatagaaagagccaatcatcttgtggaaaactccgggaaacatgggactaggcccggtctctgtccgccatgttagattcaccccgcagggatagcaggcgagctggccgcgaacggtccttgcactggccactggcaagcgccccccgtgggcggaaagctggtaaggaagctaccactgttacctagaagtaggggcacgccgttcttagagtgctcggggaagttcaaggggaaaatcttgcaaagaggagtgactttccgtgttcaggggcagccagtcttttcagtgaccagatgagggagtcgcttgggttgtcatcgatagtggggggtggatactgcctgagggagacagttcatggcttagaagggccagtttctgctaagaaaaggtctcgatcccccccagaacataaagagggcttcgatggtggtgacactcactgtcctggggacatggagttccgggaaaccattactggaagactgggattaagtctgcgacaagaaaggacatacatcttcctcattctgtccctttcctatttttaaggctctattgaaggaagatatcttgagctaggaccttccaaattagaaaggcatcgtttttcccgttatgtcaaacacccacctttcagatgacacattttaaaactcaggttgcttgtgccagcttctggtatagaaaatgaagttcagattcccaaattggctttattaaaattatttgtcggggttgaaaaataatcacgtgaggaaaagctgacttagccacatgaacgtgagtcaataggtatgagtttacagtgccatttaggaaagtgcaggcttaggcccagctacctgactgctggaggtaaaccttcaggtatagatgtggttaactgtacttttgatattttcacaagttcaagatgattgctctggctgaaagaattttcacacgtaagccctttatgaagacctgtatattggccagctaaactagaaccgcctacttcctgttttctcccatgggcagaacagctggttgctccaaagtatggaaactaattcccacttgtgtaatttcagaacggggaagaatagtttccttccagacagaaaagagtggaagagtatttcttgaagttggaaagtgtgtttcacaatttttacattttggtcactttgtttttctggtttaaagaaaaaacaaacaaaccaaccaacttgaacgtgctggggagttgctggggagttgatgagccagcgtctgcctaaattttacagctcctaagaaggaagaattgcatttcaggtaaatgcatgctggttgtcagcagggtgggtgctagagattagcattagcttggcatcgaagtcaattctagataaagacaagtgatgggaaaaaatgaataattgagtatataaaatagtcagaattaagaatacaaggttcttttgtttcaattatttattttgaaaccgttggtgtttttgtatgtctgtaggagggtgttagattcccctggaattggaattacagacagttggaagctgctgcacgggtgctgggaattgaactgggttctttgggggggtgggggggggggaggctgagccatctctccagccctacaggctcttaaaatgacagttgtatccatagtacaacactctgaaggcagaagcaggcaaatctatagcaattgccaggccagcatgggctgcggagtgagagtatgtctccttcaaaaattagtaaataataaactagaagctatcttagtgaaataaagaattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccataattttattaaattcctttggtaacactgtttaaggtcatcaaaaatagtattgtttttatagattaaacagttgaagctcagagatagtgtttctcacagctctatgactagtctgtggtggaactgtgtcctggaaccctgaagtcttcccgccccatggcctcccttcctgtgacattggaaaagtctaggacttaattcttgtttgcctcttgtgtgtggagcagaatctggccctttctagatgcagatttaaaaatgtgctgaatattttaagaggtgacctttttttttttaatgccagtgagtttacttgtagcgttaaacaacttaaactaccttttcccctaaagtcacagatcatcagtaagcaaagtccttcattaaagtcaaaccgactttaataatagataagtgattaaagaattaccagcttcttaggtgtgataatggtgggttttacattttttttctcataaatatttacgaatgaaaggatgaatattttgtcaagagagacattgtcatgagacaagggtgtagctcagtggtagagtgattccctatcgtctagacatctgtattccatttgcagccccccacacacaactgaaaggaaggaatactggataactaaattagctcccagttggatattgtggaagctagctgataggtccaaaaggactcagcaagttcctttctttacttttatatacctttaaaattccccataagtgattgtaagaggttctggtagattgttgttgttgttgctgctttgttttggtgttggtttgtttgcttgcttattttctggagacttagtgttcattctgtaacccaggctattcttgacctccttacctaaaattggaaattccgtctatttgtactccccaaggcagagcccttgtctgtgttaatccaccttgctggattacgctacagatgctcaactatccaagcactgaaataggcagtgaaaaatcttagagacctaaaacatgtgaagggggtttttgttgatgtggataaaatttaaactcgttcaacagccgtttaccctccccacagcccacctctttaatcctaaagataggatctcattgtttcctaggctgacctagaactcttggacttccattaccatcctgcatcaacttctgagtaactgggactacaggtgtgtgcccaacttggcttttctctctaacatagaagttctatataagtggtagctataacataagtgcagatctttatagcagtatcttgagcattagtgtctttatttttgagaaggaaaaatcctgtgtaacagtgagatttgtagaaaacacattactagatagtaatgtcatcatggggacattgtctgtcttattcactatgatcttccaagtctaacttatatatcagagctgaagcctccgggtgggtttttaatcccttcctcttcctttcatctacctgtcctctcagctccagccagacagcatggaaccacaggttactctaaatgtgacttttaaaaatgaaactcaaagctttctggtttcggatccagaaaatacaacctgggctgatgttgaagctatggtaagtaccgctttgttctgtttctcagtgggttatacacagatatttttcaaaatgtagctattttgagcagtttattttatccatttcctggaccttttggaaaatcattttttacagggaatttggtattagtagagaatatgtacaaggaaaaaaggaagaaacaattatgttcctttaaacatctttaaaattacatatattaatttttttgagagagagcaaaaatctgggacaattttgggagttggttctctcttgtatgaggtaaaatgatattttcagtgaattagggtttagagacattctggggataagttaggctgtccttccctgcagccaggccgtagtgggtgttgtctgactggagagcaggcgcactgctgtgtttgttacctgacgaggatgggatttgtgttttgcaagaccggtcagttgctttatcgctgggtcaaaggttggatgtctcagagctggcagaaagcagcgcagctcccatgggtgcccatgcagcagcttctctgctccgtgctttggtttagtgtctttcatcttgctttgccctttgtactcttctggtttgtgggttgccatggtcaatgttttcctacttgggcatctgtgtttaatgtaaccatttttggttacaaatatttctttacctggtttatctatgtgggtaacttcagcaggaaggacattttagaaaggggccttccagtgtgttacagtcgttccctgtcttccagcagtttctctccatcctgccctaggcaggtggctattgaggaagcagtggggtcctgttaaatgatctgagcaccagatttctttctttctctagcagctgttgggtgagttggcagcttgcccttttttttttttttttattggaacttgttttgttttgttttgttttgtttcgcttgagtagccctggctgtcctggaactcactctgtagaccaggctggcctagaactcagaaatccacctgcctctgcctcccaagtgctgagattaaaggtgtgcatcaccttgcctggctggaattttttttttttctttttttaagatttattttatgtatgtgagtacactgtcgctgtcttcagacacaccagaagagggcatcagatttcattgaaaatgattgttagccaccatgtggttgctgggaattgaactcaggacctctggaagagcagtcagtgctcttaaccactgagccatctctccagcccggaaatttttaaattatatcctacatgtgcagttcacgtcttctttaaatagccagagaaaacagcccgaggaacttcccacatttccatgttcatgcggttatctggtagggtcatacagtcttctacatcttgcttttcttgcccaacagtatattgtagctgtggttcctcgtcagtagacacagcaatcttagtcttttacagctgagtccacggtgttcttagtattgctggacgatgtggataggaccattacttactgatttccccaccaaggttttctttcttttcccattataaaatagacaggacctacatctcagtatgagtaacttatgtgtggttctatagagtagagtctatccaaaggttgtgtgtgtgtgtgtgtgtgtgtgtgtgtgtgtgtgtgtgtgtgtgagagagagacagatagggactggagagatggcccagtgattaagaacactggcagctcttccagaggaccctgttggatttccagcacccaggtggcagctcaccgctcgctatctgtaactgcagtctcagaacgtcagccatcctcctctttcctttgcaggcagcgcactcatgtgatgcacaggcatatgtgaaggcaaacactcagatgcatcaaatgaaaagcattttcatagatagtgccaagtggtccacagaataattataacaatgcacagaaaaaatgactcaatgcctagaagggtgttctgttttttattttgtggggccggaggtcaaatgttggaccttctacatgctggacaaacattctgccactaagttttgttccttgccctgaacctttgacaacactgaatattacaacttcaaaaaatattcatgaccaggcgtggtgctgcacacctctagtcccagtatttaggagacagaggcaggctctgtcttagactctgtgagtctaaggccagcctgatctacaaagtgaattccaggtcagccagagctgttgaacagagaaacagccatgtctcaaaaaaaaaaaaaatgttcacatcttaataatgtgtcagatgtgtctctgtttacactgtttggctagaggtaaggttgaatatgtttatatatttattaggcattcctatttcctcttctgtatattttgtgcacatttttacttgtattactctgtaaggtttttgttcgtttttgtaagtctctctggctgttctgaaacttactctgtagtccaggctggcctcacacacacacacacagacatccacctgcctcagcctgctgcatgctggggataaaagcttaaggatgtgcacagctgcactggacactggattattcctcctgctatcggttttcatgagtgtgtgtgtgtgtgtgtgtgtgtgtgtgtgtgtgtgtgtgtgtgttttacaagttttacccctttatctgttaactcttacagatgttttctcttagtctgttttaagttatttttaaaaactatattaaggtgttatgtacgttggtgaagggctcagttagcatttccaaagctctgcattgaatccccagcatcacagaaaaaaatgaacataaggggctagggagagggctccttgggttaagcccttgccacacaggtgtgagcaccagtgtttggattcccagcacccatacaaatgtaagtgtgtgttatggcctgtccatagagggcatcctgggagcaaattggctggctagccagattggggagctcttggttcaagaggttttgcctcaatatgtaagttggagattcatgggctgctatctgcaggctgcaagagtggtcttggaaaggcccacaagtttaccacactactggtggcttaggcagaatactctccggctccaccattactgctaatgcatgtaatgtttggaaagttcatattcaataaaagaaagtcaaaatgattcatcttatatagtgagatacactgagccaattgtttcatttgcaggtaaaagtttcatttgatctgaatactatccagataaaatacctggatgaggagaacgaggaggtaaagtgtctgaacgccattgttagagatttacaacaggggccttttctaaagtgctaaggagcttaaagttcagaataaagcccattttagtggcttacacctgtctttccagtacttgggaagtttaacccaacctggactttaaaacaaaagactgtctcagagacccatagggaggtgggggggggggggacgaaagaaaaaagttcatagtagtttaatctcatttgcctagtagtttaaatgtatttgctagttgcatacttcatgaagactatgggcagggaggcaggggcagatggatctctgaggccagcctggtctacagaacaagttccaggacagccagggctacacagagaaaccctgtctcaaaacagcaacaataataactattggcatctgatctggagttgagaaatgggaaagcaacatgaagactatcagagaaagaacctacaattatagcaagacttgacatttagtttatgatgatggtggagctaaatgggaaccctttatgaagtggttaaagtgcgctagactagcagtactgtatatctggtatgtcgtcatctttattttcccttaaggaagcagaagttctgagaggttagaaagcttgcccaaaggcacaaaagtactgaagtagggggcccagatcctgggctcctagccctacactatgctacgtgttaataccactaagataaaacagagcacattatttaagcagtagtaggaatactgaccacctgacctgggaatttgctaagagaccgatcctagtcaacaaaatgctcaggtgatgagacttagaattcactgttgctttttttctcttcatagatatccatcaatagtcaaggtaagttcctgagaaaaaccttgttagctttacttaatatttgcctgacatgacatctttaaagtccagtactgaggaggctgaggcaaggaggatccttggtttaaaggcactctggacttcatagtgaaaccctgtttcaaaacaaattaatctgtccgatgagatgtttccgtttaaaccatgctttgctctaacatacgttttagaatagaatttggtatactgtaaactgaagttgtacccagtcatcatctgtagcattagttttgtaggagagtctttttttcttattgaggcagggtctcagggtatcttcggcttacttctcactcagtgtgtagcctaggatgacctggaacctccagctcctgagtactggattacaggcttatgcttccacccccacgataggcagtactgggaatcagacttagtgcctggtgctttctaggcaagcactctaccagcccagctacatcctcagcctcacaggggacttttattgtataccaatgtttttaatagaagatagtacatttgtatgggtcataaggacaggtcttatccaacatggtatttaagatgctgatcttctaaaaatgatacactgctagtttgtcacatgcaactcgttctgctggtattgcatttgtttttgacctggcatatatgtgaatatcaatgcacaggcaagtcatgtccgtgtttatcaggcagttggttgtagtccatattgtagtccccacatccttatgtgaaccaggtaaaatgatagtcttaacacagtccaggaagttcactgaatcttaggcttcacaaagcatagtcagaagatttgggttgatattttgtgcttagaaggctagagcagcacagagggacttgagaggaagatgctatgtagtagcttctcttgtcactggattgcgttgcaataacttttccagaggagatgccacaccaagtgggcaccaacaacagatcaaagtataatctcaccaaagtccaacttggtggaagcagtgagtttgttgggctttcttgcagagcagagttatatgtacaagagtgtgggaggacgcaaacagctagatcactgcaagatcccaccccatcgtattttgcaatcttaccttatcatagagacctgcttttagccatccttcaattctataaataggctatcatctctcaagacctcttgcagctagagaaaggagtggaatctcaggcaagggtcttctgacaccccagtgggagtaacaatagctccattgccagagtcctggctaacactgtgctctggttgtcatagctataggggaagaggccaggaatgaaatcttattatgaccagaaggaagagcaccatataataataagggagtccatatatgaagattctaagaatttgaataggattttaagaataaattatatatttttaaggagtttaacattgatataaaatatatacaggtggctttaaaaggttacttggggggataaactatgtatcatttcacagttgccaccctacacaccctgcctctgccacttcagggtaaaagtagctgtcatgtatagcaagagttttcaatacaatacatcagtattaactatagtctttgttttacactggaactataggattagccaagtatggtgtgacccttctgtaatcccaacacacaaaggattgtaagtttgacattatcctgagctacatagctagactcttccacaccctcaaaaagcaaaaaactgtagggcagatgatattcagtgtaatttgtaaaactagtcaaaaaaaatgacttttgttttgtttttgtccctttaggtgaatatgaagaagcacttaaggtaatgtttacttcatattattttcaagtaatttgaaaaatacttattgaaacctaaactcccctggaaagtactaagaatagaatgactcccgttagttagagagtctgtggtaagtagggcaaatgactcagcagcaggcagttcctgctacagttcaggtgatgtgtcatctcactgcgggacttaatgccaccatcttaaaaagaagcctcaggggttaagagtactagctgatcttctaggttctaagttcaattcccagccaccacataaccacatggtggcgtggctcacaaccatctgtaatgggatctgatgccctcttgtggcattcggtgtacatgcaggtagaacactcatacataaaataaaagaggaaaaaaagaaagcagcagcagccccggacatggtggttcacttctgtaattccagcactctggaggccaaagtgcctggatcattgagttcaaagacagattaggctgtgtaataggatcgtttgagcctagtttagggataacctgggcaacataataaaacccagtttcaaataaaatatattgtgtacaggaaattttaggtgatttttttttcctcttttgcaatgatgcgctcagcccctcatgcatgctctacaagtgctcatatcccacctaacaggactctcaggctgaggtaaaggaaaacagctatgaggcagaggggctggactcttagctgttcagtccctaatttttcttaaacattttatttatttatttatttatttatttatttatttatttattggtttggtttttcgagacagggtttctctgtgtagccctggctgtcctagaactcactttgtagaccaggctgaccccgaactcagaaatctgcctgcctctgcctcccgagtgctgggattaaaggtgtgcgccaccacgcccagtttcttaaacctttatataccttcatggaaaccaaacagcgtattggggtttccataatactttattaagaagatgttcttcacaaagatacaactatttgannnnnnnnnnnnnnnnnnnnggtagggaaagtgagtgcttagctatagggaaaagctttaagtagccatgattactatcagtctggaattaatttgttttttagaaagttgagattagcattaatgtcttacagagaaggcagttaacaggtaatacacacctcactcagagggtgaagcaggaagatcttgacctggatgccagccaggacaacccaggcgaccccatgtcaaaacagaaaacaaaataatttaagaagagcccagtagatggcaaaatctcacctaacaatttcttcacattttaacttaaagccctttgtagttaatattcttgataaacatcaggctagatattaatgtagaggttgactatctttatctaaaatgcttggaaccagatatgcttcaattttttaaaatttgatttggggatatttgtacattcataatgagatgtcttaggaatgggtcccaaggctaaatttgaaatttatttgtttcatatacactttatatagcctaaaggtaattttctatagtatccttagtatacagtatgatcataaaatgccaggtgctaattttttccttgtggcatcacgtcagtacctcaaaggttaagtttaattaagcatgcctagcctgttcacttagaaatgcaaacaaggagccgggtgtggtggcgcacacctttaatcccagcactcgggaggcagaggcaggcagatttctgagttcggggtcagcctggtctacaaagtgagttcaaggacagccagggctacacagagaaaccctgtctcaaaaaaaaaaaaaaaaaaatgcaaacaagggctggtgaaatggctcagcgggtaagagtactgactgttcttccaaaggtcctgagttcaaatcctagcaaccacatgttggctcacagccacatgtaatgagatctgatgcccagtgcatccgaagaccgctacttatgtataataataaattaaaaaaaaaaaaagaaaagaaatgcaaacaaaaatagttaactatacttctgtattttggtgctttgacatttcatttggaaaaggagaatcacaatttttttattttattttattattttttttttatggtttttcaagacagggtttctctgtgtagccctggctgtcctggagctcactttgtagaccaggctggcctcgaactcagaaatacgcctgtctctgcctcccaagtcacaatgtatttttattttgtaacatgctcttgtaacacacttttagatggctaacattaagcaaggaaatcagctacagatgcaagtccacgaagggtaccatgttgtagatgaagcactccccaaaaatgtggtagaaaaccaagcggctgccaggacagggaagaagccacttgcacattattcttcactggtgagagtcttgggatcagacatgaagaccacagaggagcctgcaccagaggtatgaagaggatgggcctatctgaccaactctgaccctacatctcattgtctctcctataacattcgaatggtcatcaaagatttgggcaaagaggctggggaaatagctttgaaagcacaagactgtgagtttgatccccagaacccatgttaaaaaagcaaaaagctggaaagatgacttactgggtaaagacctgttgtgtaagcatgagtacgtgagttcaaatccccgcaattcacaggcatagtgtcatgttgcaaccctgatgtgtctgtaatcccagtgctcctatggcaagatggaaagagagacaggaggatctctgaaagctgacccgccagctaccttggcatgtgcagtagtaaacagtagaaaagggctctgttgcacacaaggtggaaggcaagaaccaacacccagtgctgtcctctgattgccacatatgtgcccaaactcacataaaagccatgtgtcatacatgtgtaatctcaggactgaagaagcagaggcaggaggatccttgggacttacagcctagttggctgttccaagccagtgaatgagtcagcctcagaaagatttttttttaaaggtgcctgaggaataacacttaaggttttgcagcctccacgtgcacacactgtacactcacgtataaagatttggctgtttttgaaactagcagccttgatttacttcaagagaaagggaagaaactagaatacacattttgatttgtattctttcacaaaaaaaaaacaaaaacaaaaacaaaaaaaccccacacatgtcacatgcttttgacatttgattaaagaaataatacattttagaaaaatttagaaaaagtaacttctcttgtattttctcccagcaatgttcttctgctccttgtgacacagaccagcctcaagacaagcccccagattggtttacaagctacctggagatggtgagtgtcctctctgacctgggtgttagcagcagtgttggcacaggtagaaagctgaacccagatgactgcagcctctggtgcaggggagtggcagctgtgacttctgacataaagcagatgtagtgaaggaagttctaacctgcctgaagcatcataaaagttgacgatccagttctacgtatgtgagggagacagacagagtctgtgcttcaaaaagacacagtaacagcattgtcccaaggaagaatcagcttccatgagaggaagagacctattacatttctgtgcattcctccagcagccattagccatgttcttgagttaacaccagaaccaggaaaccagagctatttcttctcacttttcctggtgctggaactgagttttcctaccttgtgttctgcattgtagttccgagaacaagtggttaaggaaacggtggagaaacttgaacagaggttgcaggagaagcttgtcctccagaagccactcctgagttcctcacccacagaagtctcaatgcctatttcagaggaaaccctgtttttgccagagaaccagttcagctggcatattgcttgtagccactgccagaagaggatcgttggagtgcgctaccagtgtaggtaagcagttcctgggcaggggcagccaccaactagcattctgggaagtttaggggaagctgtacatcttctttctccagcataggtaatgtagctttgatttacaagcacaggataatagcgggaactgttgagagtgctattcagatacgcatttgggttaactgaatcaggcagattaagttctgtcagtcaaaattaggtcactaaggatagacagccccccccacccttgccccgttcaaaacgttcttgtatcttacttgtttctataaactatttcatggaactaggtatgagagggagttacttttctcattttacaatgaagaacttaaaccttggcatagccaagtggcaattgaaagttaccatccagggctggtgagatggctcagtgggtaagagcacccgactgctcttccgaaggtccagagttcaaatcccagcaaccacatggtggctcacaaccatccgtaacgagatctggcgccctcttctggagtgtctgaagacagctacaatgtacttacatataataaataaataaatctaaaaaaaaaaaaaaagaaagttaccatccagctggtgatggagccagtataaagcttaaactggttcattgctctctacttcagggacttcttgctgcatagtttttactatgttggtcttttcacacagcctatgcccatcctacaacatttgtgaagattgtgaagctggaccatacacccatgacactaaccatgttttgttaaagctgcggagacctgttgtgatatcctctgagccatttttctactccaagtattccgctcctcgtctgcctgctgctttggaacaagtcaggtaaagccacacgcttgtggctgctcatttatttggcttcttgactctgctgacacaaagtattattgttgaaaatatctgagtgggggctggtgagatggctcagtgggttagagcacccgactgctcttccaaaggtgcagagttcaaatcccagcaaccacatggtggctcacaaccatccgtaacaagatctgaccccctcttctggagtgtctgaagacagctacaatgtacttacatataataaataaataaataaataaatctttaaaaaaaaaaaaaagaaaaagaaaatatctgagtgggctgaagaggtgtctcatggtaagagcacaggctgcttttaccaaagaccttggttcacttcccaacatctactttggcagctcacaacagtctgaactccagttccaggcgatctgacacacgtttctggcttttgtgagcatcaggcacacgtgtacactcatacacatgaattaaaaataaataaatctatcttaaaaatctggcaagatgcctttaatcctagcactcacaagacagaggcagccagatctctgtgagttcgaggccaacctgttctgcagagcaagttccaggacacaaaaagaaaccttatctcaagagaaaaaaaaaatcagatgtaatccccagcactcagaaccatcctgagtcttagccaggctaagctatgtagtgagtcagtctcatagcaaaagaagagtgcaatggtagtgtatagtatcacaaaattattaatagtctccttgttccttctcaattgatgtgtaatgaaacaattgtctgagactcatcaaatggaaatgatgagtatgaaagaaattaagaaagtagatgctgggctggagagatggctcagatgttaagagtactcactgctcttccaaaggtcctaagttcaattcctggcaaccacatggtggctcacaactatctgtaatgggatctgatgccttcttctggtgtgtctaaaggcagcaacaatgtactcacataacataaataaataaaatcttttttaaaaaaagaaaagaaaagaaagaaactagatgcattgttgacatgattgcagtgccaaatgtttcaaggcattcattcattatcccacaggctccaaaaacaggtggacaagaactttgtgaaagcagaaaagcaaaggttgcgggctgagaagaaacagcggaaggcagaggtcaaagagcttaaaaagcagcttaaactccacaggaagattcatttatggaattcaatccatggacttcagagtcccaagtcccctttgggccgacctgagagcttgctgcagtctaacaccctgatgtaagtgcaaggccagggctggggtgtggcttcccatccagctctctgacacaggaatgttaacaccctttgtttacctattgtgtctcctagcacccactgttttaagcttcccattgtcttccaagctggttcaggagttattttagacactcagctttgatgcctcattcagaaagcaagaaactaacaaggcttagaacagggataattcagacttttctggaggcagtctggcagggttggaaccaagaagcaagtctccagttatatttatgaacacttgtaattaccctatatttatggacacttataatcaccctttaggcagcgtatctttgttttatgacctggaatttgatcttgtgtgtgtgtatgtgtgtgtgtgtgtctggacatgtgtgccttgacatgctggtgagatccattctcttcttcgatctttatgccttctgaggattgatcttaggtctctgagcttgcatggcaagcacctttcccagctgagccttctcacaggctcaacctaaacagtgttagtatttaagtcaagtgtattagtacacccttctctgtagtcacagtgtggcatgtttggaggccattacaccagtagcaagtgactaagcatctgcatctctgtccaggcttcctttgcagccctgtgccccagttatgccaacactcagtgcagcatttgtggatgagaatttgcctgatgggactcatcttcagccaggaaccaagtttattaaacactggaggatgaaaaacacggggaatgtgaagtggaacacagacacaaaggtacgttttccctctgagggttaagacgcggatgtgcaatagcaaagggcgcacctgacaagcatcctcctgttcctttcagctcaagttcatgtggggaaacttgactctggcttctacagagaagaaagatgttttggttccctgcttgaaggctggccacgttggggtcgtgtctgtggagttcatcgctccaaccttggaggggacatacacttcgcactggcgtctctctcacaaaggccagcagtttgggcctcgggtttggtgcagtatcatagtggatccttttccttcctctgagagccctgataatgttgaaggggacaggatcagctcaagcaaagctgacgatttctcctgtgagcaagaggtgagcacttgggccattggcccaggcccaggttatttcctcagtcataggaatgtcaggcttgtgacacgtgcttatattgtagtccatgcacttcggaggctgaagcaagaatattgcaggctcaagactagttcttgctagggactgagagagggacctgaacgtaaaagaactcactggtagcttgttattcttgcagatttcccaacagtttactgtttctgaattcccatcagtgtgtcagaatatagtatagttaacttctgaagagagagggtcatttggatggcagtttcagaagttcctgtctgtgattaggcagatccagtgctttcaggcctctagactggactgacaacatacagcatagcaaaaacaaacaaacaaaccagaaaacacacttaggccaagatgacaagagaaagaggaagggaccagacctaaggatctcatgtaaggctacacctgagaaacattcattgtctagtaatgcattgcttctagagaagctaaagctaatataagccttttctttgcttacctgcctgcctgcctgcctgcctgcctgcctgccttctttccttccttccttccttccttccttccttccttccttccttccttccttccttccttccttttcaagacaaggtttctctgtgtagctctggctgtcctagaactcagtctgttgaccaggcctcaaacttgatccacttgcccctgcctcccaagtgtgggaattaaaggcatgcaccaccaccacaggctctagggggcaggcttttaacatggggtttatgggtttactcctctatacattattatgctggtatttggcctagtcctcaaggtgtttagtgtcgttagggttccggtgcaggcagtcccagaggacttttgtctgtaatggtgcttgctgcaccaggaaaagaagggtaacctgaccgggcgtggtggcgcacgtctttaatcccagcacttgggaggcagaggcaggcggatttctgagttcgaggccagcctggtctacaaagtgagttccaggacagccagggctatacagagaaaccctgtctcaaaaagaaaggcaacctggcctgctgctaaactcctggtagcgtttctccttaacactcatctcctagagtatccctgagcccaaagacatcttcatctgcctgttgcttgctgcagtctgtcgttacttttttgttagtggaacagactgtactgtttgaacttagagctaaccagtgttaatttcctggtttgggctaactgtactttcattaagttgtagaggatggtaggtgaaagaacagtatgtgaactctttactgtttctgcagcttttctagacgtcccaaataaaataaaaaatgtaaatgtagaggttctgctatgtttttattttaggggtgaccttgtcagcctggtgcttgagctctgttgaggtcctaaaatatatcccgattatttgtccctataggaagcttttcttctagctgaagaagagattccattgggtgaggtgacaaagcagacagaagggacaggagccagtgcctcacagaagacaagacgcgctgccagtgaaagggagctgtacattccatctgtggacctcctgactgcccaggtaagcagtccgcgctcggagggacaagggcagagagagtgagtcctgacaaatgagctttcaccttgttactgagaaggtgctgtagccttcatggtcctggggagttagagatgggcaggctggatccagtatctcatgaggataagatggtgcgtggagcaagtttctaaactgtttgcttctgagtgtgaagctcaggcttgtgcttccccatggcttccctccagtggtcttgtaagcttagcctgcttcactcacctgcccactgtctcttctcccctgccagttagagtttgagaacaccatgttcctgtttaactcttctagtcacttggttgaggggggacatgaatttaaatagaattgaatccaggcaatgtccaggagacctgatggtccattcaggaaagagcatggctcccacttgtgctgcagacacctttatttggccatctctttttctaggacctgctgtcctttgagctgctggatataaacattgtccaagaattggagagagtgccacacaacacccctgtgggtaagattgtcacttcactcatcttgtttaggtgttggcattacacggtctcttcttggtctgctgtgcagcgctagaggacgaggatccctcccattttgtgacagtgaagttgtacccatagtccatctcctcctttccctgtcgtctgtcagtgccacagtacacgtgtgtaagggctgccgtactgtaaagggaccccttcttcattccctccctttgttcctttcttcatagttttgtatattggctttgaccttgtaggccatgtacttgtttgtgactcagctttgatgagccagagctagttgcgttcctggtgagctagaaaagttctgatgacatgacagctggtggagcatatttgggtttattttaaccctgcaggaagcaagaaacctacaaactgctgcttctggacacttgactgtttatgatgtcatgctttctctcggttgatggttttcctgtcttcattctccagatatgactccctgcatgtctcctctgccacatgacagtcctttaatagagaagccaggcttggggcagatacaggaagagagtgaaggggcgggatttaaagcacctcctggtaaggggttaaatatctgtaaagcacgtgccttccctttccatccacctctcctcacacgtccattcctcattacctctacctcagcaaatcgatgtcccatggcatccctcgctctctacgtctcatgacagcaggggcagctcttcccccacccaggcttaggatgcactgactggtgagagctctcagctcttcagacactaagtacaggcaggctttgtatgtctttcagattccactgtatcagcaaagaggaaagctgagacccctgcttcggtcgaagaaacagaagaagacctgagtgggacccaatttgtatgtgagactgtaattcgatcccttaccttggatgctgctccagaccacaaccctccttgcaggcagaggtccccacagagtgagtgtccctagattccttgctgaggagggaggaaggttaatcttggtgggcttttgacgatgctggcacgcttactagagcaccgagaacaaagaagccaccctaactcgtttctgtcctctctcaggggaattacagctgtattccaccgagggacagcagccacttgtgctgcctggattctgcagaaaggattcttcctgtaagttgacaggatgcctcagcaaaagcttccattggcagctgagtcttctcctttctcgcaagggcagcaatctgaaaagtgggaggtaacacaagaatgccaggctgtccccagcattaagttctaccataaaaacccctttgcagttctggagagtggatgtggatggagaacttgtcttacaagctcggggagctcagctccatgtccagcactcagtaaaacctcaggtgttgtggcagaccctgtctcaaaagtaaggtagatggacagacatttataaatgcctttaatcccagaattcctggtgcaggtgtaggcacatctctcttaagtttgaaggccagctatgtagtgaaacaccatttcaaacaaaagatgtgggaatgacttctagggaactacacccagtgttggcctcctctctggtcttcagacagtctcacttatctacctgcacacttgtgcactaacatgcacaagaccttcagaacagactgctagtatcaaattgatagagccagttccatatgtctcaataactatccaaaaaaattcagtttctagtgaatcataataataccaaattcgagccgggcgtggtggtgcacacctttaatccagcactcgggaggcagaggcaggcgaatttctgagttcaaggccagcctggtctacaaagtgagttccaggacagccagggctacacagagaaaccctgtcttgaaaaaccaaaaaaaaacaaaaaaccaaattcaagggcttgggaagatagctcagtgggtaacagcccttactctttaaacgagacctgagtttcaatcctcattacccacctaaaagccaaacacagccctatcttcctgtaaccccagcatcagggaactgagacaagtagatccccagagctcactgccagccagcttagccaaaatggccagctttaagttcagggagagccatgaggaagacacttgatgtcctcatctgacctacatgcacacattcaggtataatcagtatatatcacacataccaaaaaaaaaatgaaatttgacctgcatatacctttaaatgtgattttcctatttttgcttaaagtgaacatgcacatgaatgcttttttttttgtacatacaaatagaagaaaggtgtggagggataaaccagttattcatagttactgctctgataggatcttgaggcctttctacccactcctaagatttaccagtgttctcatcagactttatcacttctctaaggtaaaggaaagcaagcagacaacatgaagtgcttacgacgagtcctttttctgccactgatagctagcctacgagtttgttttttttaatttaaaaatttatttattattattataaataagtacactgtagctgtccccagatgtaccagaagagggcgtcagatctcattacgggtggttgtgagctaccatgtggttgctgagatttgaactcatgacctttagaagagcagtcagtgctcttaaccactgagccatctcatagccccccatagcttatcagttctgatggagctttatctcagtcttaactttcacaataaaaagaaaaaaggacagtaggattcacagtgctcattggaagcctggctgtttgagcccacacacctgtttctgttgacttcccatctatttgttttggcatcgtcttgagacagaatacagtcatggctctagaaacagcccattcctctggttctttccactgtgcccgttgtgctagctcgtgatccacggcctcttccctcacggtggttacttttattccttagtgaaatttgccttgcctgaagaaggaccgcgtggagatgagagggaggagattgtccacattgttgaggaagaagtcgttgaggaagaggaggaagtccaagatgaagaagtccaaagtcagtcttctgcttcctctgaagattatatcatcatccttcctgagtgctttgataccagccgccccctgggggactccatgtacagctctgcgctctcccagccaggcctggagcgaggggctgaaggcgaacctgggatcgagtctgggctggaaccaactgaggctagagagagactcccagagagggagagccagccacaggagcagagcatcagcgacatcctcacaacctcacagcctctggacacggtgcctctagtccccgaggtggcaggacttccagcagcattgtccaggtactgctcagcacctcagcccccctgttctccagagctggaatgaccagcttcatctccaaacctttctttttctataatctaaacttaggtgaataaaaattatactcagatttctcagcacttgtaaatttgagatttaaacaaatgtttgttttagttacccttacttccctgaacatagactgtctactgacttttttataaaaaatctttaaatacaaacatctctgggatgatccctttatgttttgattcttaagttgagtaactgtaacaaaaatgtgggtgaagggctggagagatggctcagcggttgagagcactgactgctcttccagaggtcctgagttcaaattccagcaaccacatggtggctcacaaccatccataatgagatctgacgccctctcctggtgtgtctgaggacagctgcagtgtacttacatataatgaataaatatttttttaaaaaaatgtgggtgaggatttgtcagctccaaggtttgcctggtgagtgtgagggcctgttcagcagaaaagctcgaatcttccatgtgctgctctcacaggcagagatatgtattaagtaacttacagatatataccacgtctactggagctgggtcattgtctctactattcgtatagaaaatgtgagagccctaaatataataaagagtgctcaggaagggagaggtgacctgaatgaagccagtttctctagctggattgtggctagagaggacatcagagagtggaactcagtccttctgaccttcacactgccagattcacacatgatgggatcagcagccacgctgctgcactctcctagtgcttgtggctactcttcagctcaccttcactgttctctctttctaaaggagcgccccttgtggacagtgtgagtcatcaggagtggattcaccaggagtggattcaccagctaccatgcacgaagttcccccagcccctgatgacatnnnnnnnnnnnnnnnnnnnnnnnnnnnnnnnnnnnnnnnnnnnnnnnnnnnnnnnnnnngttctctgtgtagccctggctgtcctgaaactcactctggtctcgaactcagaaatccgcctgcctctgcctcctgagtgctggggttaaaggcgtgagccaccacgcccggcctgggtttccactcttaagcctgttgcagaccttgcagaggtgggcactgtgctgtgctgggaagagcagccttggaagccagccagctccagctccagttttgcttttcctcacagactaatgcggcagctcagctggtttgtgatgccttcaggactgcgcccttattttaggtctcaggactgtagaactgtgaaggagtcaggaggtccccactcaaggtcacttcctcttccaaaaaatgcccaacctaaaactctgcgaactaacacatcagggttacaggattagagggttatttttctactcaatgatgtccccagcatttctagacaatttgtcttcctctgtgacttaaatcagccacagacctttctaaaacttaaaagaggaaaagaaaggagaaaaaaactaaagacacccccattaacttgccgcctgccttgataatagcttgtgggtgctgcagctaaccaacagctcttttgcttttagagcccagaggctcaacaggactcgcaaacagcagacagaggagctgtgaccactcaaggtaacgaccttgtgaagtctcttcttgagaaacaggaagacatcccagcattgcttctgcttgaatgagcctctgagagcaggtggcgagcaccttaaatgagcaccttccaagcacaggaaggagcaccctcattcctccttgttcttacgtctgacacttatgagcaccaccggcagagagctaaagctcatgcttaagtgcatcactttttagggattaccctgaaatccacctcacctgtaatgcccaagaagacaagcaggccaagccccaggtgcatctagctggttttcttacataccgctgcctctctggtccctgccgtctcagatcagaatccagaaaaatcacatttcctttgccaggttttctctgagatgtacagacagatggctgatatccaggtgtgcccatgaccacattaattttcagctgggatggaaaactggcgtagtaactagggtgtgcgtttcctgcagtactcaggtcttctgccagccgagccagagccctgcagcaaaccaagatctgtagctatgaaaacatttcattctctctttttacatctgattttttttttcttttaaggataccttatttttctttcgagattatcacccacattatcttgtaaggtcatgttttattaggggagataatttggttttcctctgtaggcaccacaatgggagcagcattgctggaggactggtgaagggggctttgtctgttgctgcctctgcgtacaaggccctgttttctgggccaccagtcactgcacaggtcagtgtgtggtttcttttccttaacttcagcccccaagtcaccagtgcaaatggcagtccttctgtctggattggcaattaacatggcaaggactatgtgtagacagtctctttaatgaacacacagcctgcccgccatttcctatcattttaattaattaagctactctgggaaaaacaggaaaagaacctaagatttgttgaagactgcatgtacaaagttgctgttctacaacaacgtagtggacatactacgggataataagacacacattcctgtcaaacaactgtagggaattggcaaagtatatacatttccaggacaggataggacactgtgctagtgcatctccacctactgggactgaggctcttgggagttagtatctgaagcacaaagcaagtgtaccccagaaaagtaatgctggatatgatagcgctcacctatattcccagctactcaggaagcagaaaaattgcaagttcaaggccagcctgggctacatagtaaaaccttttttcaaaataaaatttgagaatataaaaccataaaaaggtacaaatgtagtttagtaacagtagaactcttgcttagcaccctaggttcagttacaggtcttgtcttctcctttggagatagagtagtgtagctggaagagttgtgagtgagcggatgatggattgatctgaagaggagaaaagaccaactctaagtgcgggggttttattctaagacatagaaggggagggttgttgtgttgttatgggtttgtttgtttgcttttggaacagagtctctacatatctctggctgtcactgtagagcaggctagccttaaacttacaaattcatctgcttctgagagctgggactaaaggctctacacctccattaacaggaaagagataggcgcgtgaggacctgccggtgatttaagtgattagcaaaggagtgcaaggataaagctcaggctttagcctaggtactcagtatcacgcatctcagtgaataaaggtgcttgctgccaagccgtgacacccggagttccgatcccgggaaggagagaactgactctcacaagttgtcctctggcattcacatgagcaccccacacacaaacatacagtaaaatgcataataaactgggcgtggcggcgcaagcctttaatcccagcacttgggaggcagaggcaggtggatttctgagtttgaggccagcctggtctacagagtgagttccaggacagccagggctacacagagaaaccctgtctcaaaactaaaaaaaaaaaaaaaagcataataaatacacccccaagtaaaacaagtttattacttgccagttttcttaatgttgaatttacaacttatccaggttaaaagtaaagtcatgcagcatgcagttggctgtgtacacctccattacagaggatggatttgacctgaggctgaagtttgagagtcatttacatacaggttctagcaggagctgtgtgattggataagattatccaggaaaaataaaaggcagaagcagccttttaagtatcaaagcaacaggattctactaaaacagaacttagaagaaacagggccactgctgcaacttggggaggtttataagggatcagtagacagtgctaaatgctgcagagagctgtgacctaatggtgaggaatttgacaattcaagtatgccttgctagctacgtgggggaaggaaggtaaatattagtctacatgtctacactaggcagaaggtggtgtttataaaagagacttaaggttggcaagcctagcagtgaaacatgttatcagtacaaatgagaggaaagatttctgaggtagtaatggtaaagagaaaaaaatgtgccagacgtgatggtaccatcctttaatctcagcacttgggaggcagatagatctctgtgagttgggggggggggggggggttgttcctgtaaacgggtgttagcttcctcttaatgagatcacttctgttttgagagtaaaaagtcaaaaagactgcccaaaatataatttcacaagtctacgcccatcttacttgctatctggtgaggttctgtctcaagccatcctcaggaagtctctcttgctcatatttgctcattaccactattttatgttaaagtcttcgaggcttctcgtcatcttgctcttcaattattacttggctgaagaatgggtggttttgtttgtttggggttttggatacaagggctcattctgtagccaaacctatgttcttcctccaagcaggaatcgcaggtgtgagccactgtgcctgagcgcgctgctttcagaaagtcctctgaagcatcctctgtcaccctctccttcagttacgcacacacatagtcagcagcactgtcaaccccattgacttgttagggaaacaggaaagttgtgcccttgcatctgatcacccaacactttgaataaggaggaaacactaggatgacagtgtaatacagatttgcaaagaagcaaattatatagaaaaatgtctccttgtctctgcacagcccatcgtttctgaagatcagaccacagccctgatggcccatctctttgaaatgggattctgcgacaggcagctgaacctaaggctgctgagaaaacacaattacaatatcctgcaggttgtgacagagctccttcaagtgaataacaacgactggtacagccaccgctattgaggactgaccttgtattaaataactgcctgccgctcagaggtggtctctctgctgtcattgagtgtgggtggaagcccttgcttgctttttaatctgatgaatctatgtctctgaattgtcaaaacagtacctgttacagtattttttggagcaaatcaaaggccagaacttaaattttcactgtagaaatgggatggatggtaggaagacagttttcaactcagctggacagaactctcgccgctgtagtccgtggaagcgagtaacttggacttccttagatcgcttttccttctgcttgtattgaaattgagtattttcctttggttcatgtggatgtttttaatgggctgttaaatattagtttggtttttgttttttaaagattaaccttgaatgtttccaagaattattcacctagtttctataaccaatcgcaagcctcatagctacataaagacagcagatcaagaaagtcatgttcctcaaagacttagaaatgaggaacactttgctttcagaaggcctagcaggaacctggaaggacaggaggcattcgggttaacccacagcacccactgagcagtgtctgtcaaagtaattttgcataaattttatttaaggagaatcctgggtagtgtgaaatattttgctaatcctatggggggggcacctgttacagaaagggaaagttagtagtcgtccttttactgactgtcacagtggatcggaaggacaagcatgtgcaaatactcatctcagtaaggtcgggtgtgggtgaaaggacacagaactgctgctgactttccgaatgtgtggaatccccttgtgaggtatccagccctagaaagccgagaacaggaagtaatgctttggggctaacccacagaaaggttagtttaccattagaatagatgggaagaaggctctgtcaagagttctaggtctcatttagtttataaagggaagctttgggtccagatggtgaaagaaaaggcaacacaacactaaagattttattcatgtttgagaaaaggtatctgaactccagctcaaaggggatagttaaaatagtattatttaacttagttggtatttataataaatggcgatcttaattactcataatatgtttatttacaatctaactcttgaatgcttctaaataaaccacaattcaaactgcaagccaaccaagctgtttattgtttaaaatgttttcctggggtttggggtagaggcagagccccatgatgtgagaaattgggtatatttggagggacctgtccatctaggtccagtttttcgttccgttgtacttgcacgtagcaacttaaaagaattgtgaatacgtgttatttgaaactcgtacctgaactagtttggtcctggcgatagcaacatttgtcctgtgagactcgcagagccggaagtgtcttccagtggcctctcaggaggagagggcggggcgggagcgaggggcggggccgagcccggcttggactccgagcttgtgttaaatgtgcagctcccgcagtttcgattttgctgagggcgttgtcacctggtaaggcgtccctgggaccccatctctttacccttttcaaagcaagaattcagagacgtttgggcttactcagcgcccaacacgttgttgcccaaatttgactaacggccagtgaggtgggatttaaaatccttcctcgatgaaatcctaccttttccttccttgcctaccatagcagaatcccctagtagagaggacttgaccctcccggtagacaagagtccctgctccccactttcaacacattgactctctctggtctccgctgaattgagctgttcaactccaccctaccctagaggcccttctccccaaaggagcattccagaaaacccaatcttggagctgagcagagcctggaatcccagacctaaaccaggtgagtaagggtctttattttagcccaggaagatgtgagtatcctaaggagttactgcgtcattcaagccactactcagggattgggggcaaagttcagatttggccttgaccttgccttaggaagaacagactccgaagtctcagaaagcaatgaatggatcaaggctccctcccagtccagtttcacagggtttcttagccacagctctttttttttttttttttttttttttttggttttttcgagacagggtttctctgtatagccctggctgtcctggaactcactctgtagaccaagctggcctcgaactcagaaatccgcctgcctctgcctcccgagtgctggaatcaaaggcgtgcgcaactctgaccccttaagccctgcttttccagccaaactcccgaatagaaagaagcctgccttctacactcccaatcagatttcaggcctatctgctctgggatttctacagagtaatcacttgattagaaaagacaaaaggacccttccataataggaagctgtgcttcccgctcctagtcctacccagcttccctgtctttaaaataaaggacagctcagcttttcctggtttaaaaaaaaaaattctacattcacttgcagaaatcccttaaagtgaaataacttctgcttttctttgatttcctctgaattgaactcttacttaaaaaaaaaaaaaaaaaaagagttccaaggcacctcccaaactgttcttccctaagcaaaagcttcttagataatggtagggcttcttggcaatcttaaaaacttaaaacctcacatcagtgctaacaggttaatagctctgaaccttgttttatttctcattagtgaaaaattccgctggactatgggtaaggcagtctcccagctcacctctcggaaggatgaggacaagcctatcctacctgataacccagccatggccagccaggctgccaactacttcagcactggtagcagcaagccagcacactcctgtatgccttatgaaaaggctgctagttccagctttgtgacttgtcctacctgccaaggcaatggggagatcccccaaggtgagtagcccaaggctctggaaatactctagaaaccagggagcgatccggatctgcccctccacatctcctggagtaggtagacctctcctacgtatgcagtctcaggctggccaagaaggacccaggtcctgctgtggttctattccccagctcctagaggaaagtttcgtgtctgtctgttcctcaagccagtgtcttgggatttgggaagttaaaaatgaccttttcaagccaagcgtggtggcgcacacctttaatcccagcactcgggaggcaggggcaggcggatttctgagttcaaggccagcctggtctacaaaatgagttccaggacagccagggctatacagagaaaccctgtctcggaaaaaaaaaaggacctctccaaaggaacagggccacctctgactttgtagtgactcagtgtgtctcatacctggttatggaagtcccattcctctccgagctgaaagctgggctgtcaacttcaattttgacagtgctcccaatcctgccatgggacagaggcatcgtgctcctggcactgcaagatggagtggaggggcgcttgagggaggctggcacaggaaatgtttgtcatgggcactccttggcattctctctctctttctctctctctctctctctctctctccctctgcagagcaagagaagcagctggttgctctcatcccttatggagaccaaaggctgaagcccagacgcacgtgagcttcatacatcccttaggggctgccttacctgtctcccctctttagatctcccggtttgtttggtttttttccattggttttcatctagaagcccgagtcttactgtgctcaaacttacactacattcgtgtttccaaggattgtttgtttaagaatgatagtaatagtattagcggctgggattgtagctcactgatagtgtgtttgcttagccaacatgcacgaggccctgggtttgatctttagcaataaaaagccaatgccatagttttgctaattaactttgtttcataatgtaggtgacatatgttaaaatatcatgccccgtaaatatgtacacttatatgtcattcaaaatataacataatataaggcagcatggatcatagctaagggatagctaaggccatttcatggctgtacaagtccttccaagagagaataaatcgccctggttgccgctacttttgctattgcagtttatgtttctttctacgagagattgaaaacaagctgctcagatctctgttctggaccactttggaacctcagaagcagccctgggcttcagtgtggtgcccatgatcctttatgtggtcagcatccatttaccatggatccccgtaacctcctccaaagaccctcagcttctacctgagagctgttgcccagcctcctccccagccactgtactaaaagtacatctcccaagagatggctcagcaggtcaaggtgcttgctctctagtctataacctgagttcaaactccaggcctcacatggtgtcttagtcagggtttctattcctgtacaaacatcatgaccaagaagcaagttggggaggaaagggtttatttggcttacacttccatactgctgttcatcaccaaggaagtcaggactggaactcaagcaggtcaggaagcaggagctgatgcagaggccatggagggatgttctttactggcttgcctcacctggcttgctcagcctgctgtcttatagaacccaagactaccagcccagagatggtcccacccacaaggggcctttcccccttgatcactaattgagaaaatgccatacagttggatctcatggaggcatttcctcaactgaagctcctttctctgtgataactccagctgtgtcaagttgacacaaaactagccagtacacatggtaagagcaaactaactcccacaagtgtccctctgtgataaaattagaaacaagcagtgcccctcataaaatgctgagtcctgtctcttttaattcatatctctgattgattagcatgggtaaatggtatcccattcaaagaattggctttagttaaatattaaaactcagagctctcaaataatcgtggactggtttctagtagtgaccatagcactcgctgagatgttgttgtgtgccaggaacagttgttttttcctctgtggaccataggaaattctatgaaatacagttatctccacttacggacatcctgggcttttgaagaggttagatagtgtcactgggcattatgtcaatggggatagagagttggggtgaaagccaggttgcctgccttccaatcctgttctgaaccacagctagagagctaagtgtgcagttgccagatgatgtgaaagagaacgtgtttgggggtcttgagtcccctccaggtttctttggtgttcagatttctctcttcctgctttctttcacgcaggaagctctttgtgttcctgtcggtggccatctgcctgctgattttctccctcaccatctttttcctgtatccccggcccattgctgtgcgtcctgtcggcctcaactcttccacagtaacctttgaagacgctcacgtacagctcaacacgacggtacgtggtagccgctcctcatttcacccctacgttcttctccaaagcaccaccatgtagcctaaggggtagataccaaggacctcgtggtatgcagaccattctgaggcaacatgagctccgtagtagatcgtatggaattgggactccgaatcatggagggtcagaatctggaccagatcagtcataggaaagaacagggatgtccaggagaaaaaaatggagagaaacagagtagggtaaaactggatattggagggttagagaaatggtttcgcagttaagacctctggctgttcttccagaggacccaggttcagttcccagcacccatacggcagctcacactgcctgtaatccggttccgagtgatttgacatcctcacacggaaatgcatgcagccaaaactcgagtgcacataaaaataaatctttaaaaaaaacaaaacaaacaaaaaaaacctggccaggtggtggtggcacagacctttaatcccatcacttactcaagagacagaggcagacagatctctgtgagttcaaggccagcctggtctacaagagtcagttccaagacagtcagggctacattgagaaaccttgccttgaaacacacacacacacacacacacacagatcctgagccagcagctttgatgggtagattctcactgtgttacctaagttgggtcttaaattcccaagctcaagtgatctcagcctccagactgactgggactgtaggggtacaccacagaacccttaaaggtgacccctgtcattaagagccttcagagtcctttgaaactgaggcccaaaagggtggggtgggactcaggccaaagagctaggctgatgcagctgcttgtgctctccctaccatggggtgccatcgtcaccgtttctttcctgaagttggaaagtcggttgcgcgttatgttgggacaaacacgcaaaggaacatttccttaaagtggacacaggagagaagatgttctgctaaagcaagcacatgaaaggacaggtatgaaggatacttggctaacatgtaacacacatgtgttggtctaccttgcatagttgagctgcgtttttcaggacgctataaagagaaacaccaaagccaggtggtggtgcatgcctttaatcccagcacttgggaggcagggtcaggtggatttctgagttccaggccagcctggtctacaaagtgagttccaggacagccagggctatacagagaaaccctgtctcagaaaaaaaaagagagagagagagagagagagagagagagagagagagagagagagagagagagaaacacccaaaaaaaccttgtgctggtgtgctgccatttctagccgcttctgatgactcactaattagctgcatgtgctgaggcaaggcgtgtggaggacatgtgatgtttggagggtgtaaataggactggacagagatgcggaggctgagctaggcttgctggtacagctagttgtgcaatgcttgtgggtcacaagtcttcgttgatcttcacttccctgagagaggcacagcagagcttgagctgaggctgaggcctggctgtctctgcgaggttgtcgtgtcgccgctgttgctaacctgactactgaactggactgctagtgtatccgtgaagtgcgtgccagtagatagagctgccgctgctgacctatgcactgaactgctgatttccagacagcacggatgggagttgctccaaagagcctttctaaactggtccacatcccccatatcctttgttttccactacttctggtggatagtgggctacaagggaggttaacgtgttttaagaaccatcatttaagggctggagatatggctcagtggttaagagcaccaactgctcttccaaaggtcctgagttcaaattccagcaaccccatgttggctcacaaccattcgtaatgagatctgacaccctcttctggcgcatctgaagacagctacagtgtacttagatataataaataaataaataacatcattaaaaataagttttgagccgggcgtggtggcacatgcctttaatcccagcactcgggaggcagaggcaggcagatttctgagttggaggccagcctggtctacagagtgagttccaggacagccagggctacacagagaaaccctgtctcaaaaaaaaaaaaaaaaaaaaaaaagttttgagggctggagagctcagcggttaagagcaccgactgttcttccgaaggtcctgtgttcaaatcccagcaaccacatggtggcccacaaccatccgtaatgagatctgacaccctctttctggtgcatctgaagacagttacagtgtactataaataatatataataataaataaatcttttttaaaaaaggtctgaaaaaaattttaaattatgcttttccttgctgtcacctccagaatgtcctgaacatcttcaacagcaacttctatcccatcacagtgacacagctgacggccgaggtgctccaccaggcctctgtggtaggccaggtcaccagcagcctccgcctgcacatcggcccattggccagtgagcaggtaacgtccctcttcctggccagccctctacacaggcatgtaatgtggtgacggagaggggccagcctgaggtacagctaatcttgtgcccctctgcttgacagatgccttacgaagttgccagcaggattttggatgaaaacacatagtgagtgccctttggtctcctctctccttaaccagctaaatagtcactgaagggctgctgaggtaaaggtgtttgccaccataccctgagtttaatcttccagtcttgcatgataggaagagaaagagaacccactcccacaagttgtccgttgatatccagacatttaccattactcaagtgtgcctacacgcaatgtttcttgctttttgagacaggatttctctgggtagccctggctgtcctggaactcgctctgtagaccaggctggcctcgaactcagagatccgcctgcttctgcctcccaaatggttggattaaaggtgcaagccaccactgcccagcaaccaaatgtatttttaaattttaaaagtatccactttctgattaccggtttcctggttgcttcagactcagggacccgcctcaggcctgccctcttgtggctaggactgcaatatgcaagggtaaaagtccacattctcttcctgttgggcctagattagaatgacagggtgcaattttgttaatctttatgtgaatcggactctttgaatccctgtggaagaaaaatacctagttttctgccaagaagaggtcagggtgtgcttgggccaataacgtggatggccaggtgaccaggctcatcctagagaataagagttaggagtgacatcttagaggcttccgatgggaggcaagaaaactgtgccttgtgacttgtaagtctccttggagtttcctgaccacctgctcactgtaaaacaaagttcaatgttctctctctctcagcaaaatctgtacatggccgaaaatcagagtccaccatattcttttgaatatccagtaagtatggcgtggaactcctgtgtccccactcccacttcagtctcgacttagccatattacacagggtaaagaaagagcacccggtaactgatatcgtctttgttagctccagagattagggcctgttccagatcttatcttacacaggtcttgcttaggcgccctgcctggagcttcgggaacacaggtggggcagctgcctcagtatcttggcagagcaggtagccgaaggaagtgggagggaggtccttagggagccagcctcacacacacacagtagagccaggccaaagctgtccttcccctctctgattttaccacaagccctgcttcctctccaggggttctctgacctgctccttcctaagccatccgcaacagctgcccttcgagagctttgaatatgtagactgcagagaaaacatgtccctgccccacctggagctgccccgcccagcctgatctgtctgccgcccctggactccaggcacctgcaagctgatctgcagctcagctccgtggagctcaaggaaagactgtagggactttgttgaaggaaaagtcctgctttgggccctgccttcccctaacaccctcagcacacagagcttctgtaacaatgtcatagtccctgagtcctcagacctccccactcccccacgagtcgcttctgatggatcttacccatggtctgtgtggggaggaacggctaccttggcgttgtcttgggactgagcatgttggttacccagctccgccagggtgggtcttcaatcgcaacgaagagaaagctgtagttttatctagactttgcagcatggatgaatctttttcaagctctcctcccagtaataagtggctttggggatatccagtgctgtttccaaggtctccttgggtgactataaatgttctcctgtactgtcttgctttgatcatgtgataatgagggtaatagactacttctctcagtaaatggtagacaataaggtcctcatcctcccaggttcggaatactatccctggcttccaggaagggagatttacaccatctaaactcttctctatagactggctccaatgctatcttcacagcagaaaccaaggagctgaggagaaaccatcgggtgtaccctagagcaaaggcagagccagttgcaaagatatttattaaaggaaagtttctaagcccaccatccagagcccatgtgagtgcacacaggtaagacaggcagtagagcaggcccaggggcagtgttcagaaagcatgaaggacataagctgttgataccaggccaaagctgtggggctctcatggattctctgcatcaggcccaccctctgctgtcctctgggatgtgactgaagagtgacagattcaccagaatttccttccttgcctgtcactacactgacgccaaaccacaggtaacccccagttttctactggactccaggtggagatatgatgtctgttgccggagagcagaaatgtgtgttctctaaagctagctagcctctgccctccagacaggtgcaaaggcgaagggcggtgtggttggggaaaattgaatttgaagtgagaagaatgcaaggaaatggtggtaactgagctgggtaactagcctggggctacacagagggagaggaagtcttgtctgcaccaagttttccctcctgggtagccagggctaaggtgtacaaaccaaaggagacccagggaagtcaagctgagattagagtgtataaaccatcaaatgtaaaagatttctaacaataaattgttctttagccgaaggaaaaggggcattcctggacagaaaaacaaggggtgctggtgtaccaacatcccacgaagaatctgtgtgtgcatgcttgtgcgcatgcttgtgcacatgcgtgtggaggtcagagcactttcttgggtgttctttgggtattgctttttttttcttt

SEQ ID NO: 968 - DNA, 4435 bp, Mus musculus
cgccatgttagattcaccccgcagggatagcaggcgagctggccgcgaacggtccttgcactggccactggcaagcgccccccgtgggcggaaagctgaaaaaacaaacaaaccaaccaacttgaacgtgctggggagttgctggggagttgatgagccagcgtctgcctaaattttacagctcctaagaaggaagaattgcatttcaggctgacctagaactcttggacttccattaccatcctgcatcaacttctgagtaactgggactacagctccagccagacagcatggaaccacaggttactctaaatgtgacttttaaaaatgaaactcaaagctttctggtttcggatccagaaaatacaacctgggctgatgttgaagctatggtaaaagtttcatttgatctgaatactatccagataaaatacctggatgaggagaacgaggagatatccatcaatagtcaaggtgaatatgaagaagcacttaagatggctaacattaagcaaggaaatcagctacagatgcaagtccacgaagggtaccatgttgtagatgaagcactccccaaaaatgtggtagaaaaccaagcggctgccaggacagggaagaagccacttgcacattattcttcactggtgagagtcttgggatcagacatgaagaccacagaggagcctgcaccagagcaatgttcttctgctccttgtgacacagaccagcctcaagacaagcccccagattggtttacaagctacctggagatgttccgagaacaagtggttaaggaaacggtggagaaacttgaacagaggttgcaggagaagcttgtcctccagaagccactcctgagttcctcacccacagaagtctcaatgcctatttcagaggaaaccctgtttttgccagagaaccagttcagctggcatattgcttgtagccactgccagaagaggatcgttggagtgcgctaccagtgtagcctatgcccatcctacaacatttgtgaagattgtgaagctggaccatacacccatgacactaaccatgttttgttaaagctgcggagacctgttgtgatatcctctgagccatttttctactccaagtattccgctcctcgtctgcctgctgctttggaacaagtcaggctccaaaaacaggtggacaagaactttgtgaaagcagaaaagcaaaggttgcgggctgagaagaaacagcggaaggcagaggtcaaagagcttaaaaagcagcttaaactccacaggaagattcatttatggaattcaatccatggacttcagagtcccaagtcccctttgggccgacctgagagcttgctgcagtctaacaccctgatgcttcctttgcagccctgtgccccagttatgccaacactcagtgcagcatttgtggatgagaatttgcctgatgggactcatcttcagccaggaaccaagtttattaaacactggaggatgaaaaacacggggaatgtgaagtggaacacagacacaaagctcaagttcatgtggggaaacttgactctggcttctacagagaagaaagatgttttggttccctgcttgaaggctggccacgttggggtcgtgtctgtggagttcatcgctccaaccttggaggggacatacacttcgcactggcgtctctctcacaaaggccagcagtttgggcctcgggtttggtgcagtatcatagtggatccttttccttcctctgagagccctgataatgttgaaggggacaggatcagctcaagcaaagctgacgatttctcctgtgagcaagaggaagcttttcttctagctgaagaagagattccattgggtgaggtgacaaagcagacagaagggacaggagccagtgcctcacagaagacaagacgcgctgccagtgaaagggagctgtacattccatctgtggacctcctgactgcccaggacctgctgtcctttgagctgctggatataaacattgtccaagaattggagagagtgccacacaacacccctgtggatatgactccctgcatgtctcctctgccacatgacagtcctttaatagagaagccaggcttggggcagatacaggaagagagtgaaggggcgggatttaaagcacctcctgattccactgtatcagcaaagaggaaagctgagacccctgcttcggtcgaagaaacagaagaagacctgagtgggacccaatttgtatgtgagactgtaattcgatcccttaccttggatgctgctccagaccacaaccctccttgcaggcagaggtccccacagagggaattacagctgtattccaccgagggacagcagccacttgtgctgcctggattctgcagaaaggattcttccttgaaatttgccttgcctgaagaaggaccgcgtggagatgagagggaggagattgtccacattgttgaggaagaagtcgttgaggaagaggaggaagtccaagatgaagaagtccaaagtcagtcttctgcttcctctgaagattatatcatcatccttcctgagtgctttgataccagccgccccctgggggactccatgtacagctctgcgctctcccagccaggcctggagcgaggggctgaaggcgaacctgggatcgagtctgggctggaaccaactgaggctagagagagactcccagagagggagagccagccacaggagcagagcatcagcgacatcctcacaacctcacagcctctggacacggtgcctctagtccccgaggtggcaggacttccagcagcattgtccaggagcgccccttgtggacagtgtgagtcatcaggagtggattcaccaggagtggattcaccagctaccatgcacgaagttcccccagcccctgatgacaagcccagaggctcaacaggactcgcaaacagcagacagaggagctgtgaccactcaaggcaccacaatgggagcagcattgctggaggactggtgaagggggctttgtctgttgctgcctctgcgtacaaggccctgttttctgggccaccagtcactgcacagcccatcgtttctgaagatcagaccacagccctgatggcccatctctttgaaatgggattctgcgacaggcagctgaacctaaggctgctgagaaaacacaattacaatatcctgcaggttgtgacagagctccttcaagtgaataacaacgactggtacagccaccgctattgaggactgaccttgtattaaataactgcctgccgctcagaggtggtctctctgctgtcattgagtgtgggtggaagcccttgcttgctttttaatctgatgaatctatgtctctgaattgtcaaaacagtacctgttacagtattttttggagcaaatcaaaggccagaacttaaattttcactgtagaaatgggatggatggtaggaagacagttttcaactcagctggacagaactctcgccgctgtagtccgtggaagcgagtaacttggacttccttagatcgcttttccttctgcttgtattgaaattgagtattttcctttggttcatgtggatgtttttaatgggctgttaaatattagtttggtttttgttttttaaagattaaccttgaatgtttccaagaattattcacctagtttctataaccaatcgcaagcctcatagctacataaagacagcagatcaagaaagtcatgttcctcaaagacttagaaatgaggaacactttgctttcagaaggcctagcaggaacctggaaggacaggaggcattcgggttaacccacagcacccactgagcagtgtctgtcaaagtaattttgcataaattttatttaaggagaatcctgggtagtgtgaaatattttgctaatcctatggggggggcacctgttacagaaagggaaagttagtagtcgtccttttactgactgtcacagtggatcggaaggacaagcatgtgcaaatactcatctcagtaaggtcgggtgtgggtgaaaggacacagaactgctgctgactttccgaatgtgtggaatccccttgtgaggtatccagccctagaaagccgagaacaggaagtaatgctttggggctaacccacagaaaggttagtttaccattagaatagatgggaagaaggctctgtcaagagttctaggtctcatttagtttataaagggaagctttgggtccagatggtgaaagaaaaggcaacacaacactaaagattttattcatgtttgagaaaaggtatctgaactccagctcaaaggggatagttaaaatagtattatttaacttagttggtatttataataaatggcgatcttaattactcataatatgtttatttacaatctaactcttgaatgcttctaaataaaccacaattcaaactgca

SEQ ID NO: 969 - protein, 994 aa, Mus musculus
LGLQLQPDSMEPQVTLNVTFKNETQSFLVSDPENTTWADVEAMVKVSFDLNTIQIKYLDEENEEISINSQGEYEEALKMANIKQGNQLQMQVHEGYHVVDEALPKNVVENQAAARTGKKPLAHYSSLVRVLGSDMKTTEEPAPEQCSSAPCDTDQPQDKPPDWFTSYLEMFREQVVKETVEKLEQRLQEKLVLQKPLLSSSPTEVSMPISEETLFLPENQFSWHIACSHCQKRIVGVRYQCSLCPSYNICEDCEAGPYTHDTNHVLLKLRRPVVISSEPFFYSKYSAPRLPAALEQVRLQKQVDKNFVKAEKQRLRAEKKQRKAEVKELKKQLKLHRKIHLWNSIHGLQSPKSPLGRPESLLQSNTLMLPLQPCAPVMPTLSAAFVDENLPDGTHLQPGTKFIKHWRMKNTGNVKWNTDTKLKFMWGNLTLASTEKKDVLVPCLKAGHVGVVSVEFIAPTLEGTYTSHWRLSHKGQQFGPRVWCSIIVDPFPSSESPDNVEGDRISSSKADDFSCEQEEAFLLAEEEIPLGEVTKQTEGTGASASQKTRRAASERELYIPSVDLLTAQDLLSFELLDINIVQELERVPHNTPVDMTPCMSPLPHDSPLIEKPGLGQIQEESEGAGFKAPPDSTVSAKRKAETPASVEETEEDLSGTQFVCETVIRSLTLDAAPDHNPPCRQRSPQRELQLYSTEGQQPLVLPGFCRKDSSLKFALPEEGPRGDEREEIVHIVEEEVVEEEEEVQDEEVQSQSSASSEDYIIILPECFDTSRPLGDSMYSSALSQPGLERGAEGEPGIESGLEPTEARERLPERESQPQEQSISDILTTSQPLDTVPLVPEVAGLPAALSRSAPCGQCESSGVDSPGVDSPATMHEVPPAPDDKPRGSTGLANSRQRSCDHSRHHNGSSIAGGLVKGALSVAASAYKALFSGPPVTAQPIVSEDQTTALMAHLFEMGFCDRQLNLRLLRKHNYNILQVVTELLQVNNNDWYSHRY

SEQ ID NO: 970 - DNA, 60381 bp, Homo sapiens
  misc_feature (1)...(60381): n = A,T,C or G
ttatttttaagacagcttgtaaccgtatgattcggttgatcatataaatggggatccggtatccccacgagccatcttgtgcctaagtagcaggcccataatactgtatgattctctcagggggccatttatcattgtttcaatttcttatagctatgcttttcacgggaagcatagacagggaagcccaggagttctcctgtttttatggacagtaggaagaaagatggtttaatagtgccaataacacaactacttgtcaggcagcttagtgtaggctctatgtccacatatccagtatagcccagtgggggctgtccagtcccggtgggattctgggtgggcctaaacggtctgcaactttggaaatttactgaatggatttttctctgtgtggtttgaactccaccatgtagtcttcctacaggaagggtgaagtccttctccactcttgctatatagtattgtctaatgattgaggcttttaggacccagaaattatcagggtgattcttttgagctgggaattcatcaggaactgggtctgtaggtactaattctcgggcttcccatggccattgatctgctattacagttcctccacatacataacatgaagtgacagtgagagactgggctacatgctcggctaattgcaaaaacaaatttcttgtttttcctggaaattctgttattggcacatttagttcatcatagaaagtttgaaacactggctcaagagagcatttgtaaacttctcctcgaaccaagatatttactcggggattcagtccagccccattgattcctaaggtcacacgctactcttttttccagcgaggatcaaggggattggttattactagctctaaggggttacattgtcccttagcacaggaagggccatttttttcctttctgaaggtggactggatccttttcattttttttaaatccaagtggcctaaatgacacaagaccagtatttacatttatttccacacagtcctaatttatgacagatgtacttattttctgccatatagcctcttttctaattaagagaaccacactttattcctaacttattactattaatgacagcacaggcatcaaattttaaggtgacttgtttgggcacccctttttcttctgttttggctaacactttactcatatcatttatgagcccccaccagtcctcagtccttaatcttattttaaaaaccgtggtcatgggaggctcagatgggtcataacacacatcaggttggtcacttcctgggctacataccttgtacagaataacattatacaaacaagttatttttagagttccagtacacttataataaccataaaataataggactgtagcaaccttttgtcctacctcagtgacttgatgtatacactggaacagtcctcagtctgaggaaggtcagttgaagtccttactgtaaaagtccaaattttaaggaaaatgagttccgcaatgagttttctcatgcttcggccgtgcgtggaccagtcagcttctgggtgtgactggagcagagcttgtcgtcttcttcagagtcactttgcaggggttggcgaagctactcccgtccacgtacccctcacagtctactgatgtttaaggatagtctcggaggttgggcctgctagaataaactgagtccaacacctctacacagttatgttcaactaggctctctgataccaggagcaaggtggtggggtttagggtgttgcaaacttcagtggttatgtggggattttcacatagcaagctttggtacttggttaatctagcatttgttaaccaatgaggtcctttggtagtcattaaagttaccacagcatggggggcctttatattcaggttttgcctaagggttagtttatctgcttcttgtgctaacagggcctgttgctgctagggcccttagacctgggggccagcctttggaaatcctgtctagttgttttgagagataggccactggccttggccagggcctcacagtatgggttaaaactccaactgccattttttctctttctgacacatagagtgtaaagagttttgtcaggtcaggtagcctcagggctgggaccaacatgaggttttcttttaactcatgaaaacctcgttgttgttggttgtaatagatgtagtttatctaatctacatttttattaactgtcacccactaaaatattgacttaaatcctgcagctatttgatttcaagctttaaattgatctggtattcttcgtgggactccaattgcatctaaatagacatgagagtcgaaagacccataaggggcttctctcgctttacaatgtctttctttttttccttctggttgatgaaatgccagggtgaaagggatagccaattggactaaagtacaagtgccactccagttatttggcagagtgcccagtaaaggtccaccacaataccaccacacatctgctcggggatgaacaagggctgactgattgataagctcttgaaaattcttaagctaactgcatcctttcaggtctccaaggaacgctaagtttcctccctgttgtgagagacatgaagtgaacttagtgttgggagatggaggatggatggccctcgggggctgacccgcagggtgctggactttgggatatagcagagagagcttggcatgacttattaatacaggctgtagaatcctggaaaagagctaccaggcagcccacatctggtcgactggaggaccaccttagtggaaaggggacaatctgggcctctggcctgccatgtgcacaagcataacaattgcttttgtttaacgtgcagatggaatatttgatgcattttaaccaggcatttgcatcttggtatcctgtcttcattggtaaagtttgttttaactctttaacttctatgatcctctagtaaaacgaatgtatggttttaggaaattacaaaaactggttggggcagtccattcttgctctttagtggtccacagaacgttggaccaactacggcataaaaactctacatcaggggacaagactcctggttggcactggggtctttatcgaaatctccctggattaaatggtcctagtttactaatgtccagtctgaggagagtcaggagggacagaagtacttttctgaagtagagagctgtctttgacttggcaagtccccacagggtataacaaggcaagcattaaatgcaatagtttgaggtgaaattgacttggttatgttaataactagatggtcagcaatagcacgaggaaagaaagaagagtaatagaatagatgaaaagagatttttcgtagctttagtttggcagggttttcctctgggactgtggcccatgactctggagggggtggcactttcttgattctggtgtgacgagtccatccttttttgctgtacgaacagcagtcttggtggttagcaacacaaggtagggtccttccaggctggctcgagtttttcttctttccacctttcgatgagaatgtgatcttcaggctggtgctggtttactagaaattctaggggtggtacatgtgctaaaagacttttagtttttgagagaaaggaaagtggaaaataaaccaagcatataattctaaggaactgaccttttgttttaaatgtggggaccttggcagtggactttatagtccttagtgcctttttcctgagaaatttcctttagcacctatttttattagtttttaaaccaaagaaagccaaataccattttacatttaacagtgcttctcgtatgatttttataccagataagctaaattttatctttatattagtgtgttattaatattaaacttaattttaataaaaccttgtagacatatgtatctaattgttaatgtttgaccataaggtaagattttatagattctttttaaccctttataatttttgcaaaagagcaggttggtgctttaagaaaaaacctgttatgcttttactttaatgtccagttcacagaaaaactggatgatacttctttaactttagctaatatgtttacacacagaattttctttacaattaacattttgaaacttgcttaaatcttcaaaacaataattatttttaaccttttaatgtaggtgaaaatgtacatccttatgcctccttacaattcttttaccaaagatatattttacttttcttatacaccttgcatataaactgtttttttttttcaacagttttacattcaggaggcctagttacttttaaattatacaacattttttgcataaatttttttataacatttttctctttcgtgactttcgcagacaattcttcgatatgcctcaactttctgacttattacaaatatttatttctttaaacaaccagttaatttgtttcaggacaagaatttaccatataatactctttttatataaattccgccccccctttttttccttttttttttcgaagatgataaccattcttttccaaagcgaaccttttttgtgtcttgtggactaggccacaagaatataagttactatatacatgttacactgttaacttttagcaaactttagttgaaaacctttaaaaaaaattttaaaaaaatgcatgttgtgcacatgtaccctaaaacttaaagtataataataataataataaaaagaaaaccttctaagtttgggattttaattatcctttgctattaataagaccttgttttgtctaaattagaattggtatagatggcttttttttcttaactttgtatctctctctctttctctctttctttctctctttgactttgtctctctctttgactttccttttgcctctgcctcttcctctctctctgtgtgtgtgtgtgtgtgtgtctctctctctctctctctctctatccttgactctctgtctgtctcttcctgtctcttcctctctctcttttcctcttttcctctctgtctctttcctttctctctctctgctggtctttccttgcctctgccagccacttatgctgctgttctctcaaccactatgtgttgggggtggggggtctaaaaccagctctaatcaagtgtctctgtaagggaactggtctgggttccttggcttataggttaccttgtgccatacctttgaaacaagggacctgtccaggcttccttctaatggccaacctacctctaatgctggccagtctatcttacacaaagttttaagttttcctggtgtcatagcactccatagtctccctcagattcttttttgaaatttgtcaacatagttcctagtggggtgggcttattcgtgcctgacctatgcttcttcaagacaaaacaccacgctcacaccacaaacacaccacaaaacaaagaaccggtaaaaagggcgcacacacagttttgcagtttgcaccaaaccaaaatcagagtatccagaaatccaagccaggtcaaaaccaaaaccaaagtatcaagcaatccaagtcaagtcaaaaataaaaaccaaagtgccaggagaggcacaccatgggtgatcaggccacacttccactcaaatggagtaggcaagttcccaagaccaatcctgtcaagcaattcaaaccaaaaccaaagtgccaataaaggcacgccatgggtgatcaggccatgcttccactcaaatggagtgggcaagtttcaaagactactcttaccaagttttagatgtccagactccaagtgcccgttccttcccggtgttcagccactgcgttgatcctccatgggggcctgccatacagtgctctggcgaggcgtcccagtggggcaaatgcctaaccaggagcgccctcaggatccgtgttgctcgggctggttggagtcccctgcagggatgttccacagggcaggtttaagccgcctaaggagctgccttgaccatccgccattcacctcgcttcccagtcagggaaccaagaaatcgagctgcagacaaaacttatcagacaccgagttaaagaaggaaggggtttattaggccaggggcatcggcaagactccggtctcaagagccaagctcccccgagtgagcaattccctgtcccttttaagggctcacaactctaaagggggtgcacgtgagagggtcgtgatcaattgagcaagcagggggtacgtgaactgggggctgcatgcaccagtaactagatcggaacaaaacaggaaaggcattgtcacagtgcttttctatacaatgtctgtaatctatagataacataccaatcaggtcaggggttgatttttaactaccaggcccagggtgtggcacctggggtgtctgcttgtggatgtcatttctgccctttagtttttactttttctttctttggaggcagaaattgggcataagacaatatgaggggtggtctcctcccttacaccatgttagccaggatggtctcgatctcctgacctcgtgatctgcctgcctcggccccccagagtgctgggattacaggtgtgagccacagcccccggcctcattcatgatttattttgccatttcaagtgatggagctggttttagagctagaagaaaaccaaaatgccagttaatctaaactagattcctgccccagtgcagaaccaatcaagacagggtccctgtctttcagggaccacaggatttgtgttgaagaggagaggagtgggagaggcagagtggatggagaacaaggattcattttctatacttttaaagttcttcagttaagaaaatcagcaattacaatagcctaatcttattagacatgtcttttcctcccttctatgtaaggtcaattctgttcatttgcataggagataatcatataggaatcccaaattaataccctcttctggtgacttaccagattggacactgtaagattttctgcatagcattaaggacattttgtacttcttcaacgcaaacagcagataaatctatctctttctgttccaatgaactttaacacattagaaaaacatgtatcttttaaaaaggtttagaaaaatgacaacttcattttatcattttaaaataaggtaaattgggctgggcgtggtggctcacgcctgtaatcacagcacttagggaggccgaggcgggcggatgacctgaggtcgggagttcaagaccagcctgaccaatacggagaaacctcgtttctactaaaaatacaaaaaaatgagccaggcatggtggtgcatgcgtgtaatcccagctactcgggagctgaggcaggagaatcgcttgaacccacgagtcagaggttgcggtgagcccaaatcacgccattacactccagcctgggcaacaagagcgaagctccgtctcaaaaataaataaaataaaataaggtaaatttaagatttggaaggttttagaataatacaaaatcctttaaaggttctagaagttgctttttgtaattagacaatataaattctgtattttttcacatattgcttccaaccctttgggtcttttcctttctccaagaaagagaaagctacaggggagtgactgaccgggtaagtggtgagctttctccaatgcttctggctgttttctttttcttgcataaaaccaaaatcaacaacgaccaaaccaacaccaatcaaggcctccctgcccctagcctttcccagcgacccactctcatctcaggatccccctcaagcacatccctgccggcagcatctgttactactgacgctcctctacttccctcttgcgctttctcaatagcacaaatggatccagttcttaagttctccctcccacaaaatcctgtctcctccccttcccagacatattcctggcacttcttcttccgcaagggcccatcttctcatatataccagccggtgtttatttctttgtttgtttttgagacggagtgtcgttctgccacccaggctggagtgcaatggcgcgatctcggctcactgcaacctccgcctcctgggttcaagcgattctcctgcctcagctcctgagtagctggcgcgcgccaccacgcccggctaatttttgtatttttagtagagacggggtttcaccatgatggtcaggctggtctcgaactcctgacctcgtgatccatccgccttggcctcccaaagtgctaggaatacaggcgtaagccaccatccccggcgaccagctgatgttcttatacacatggtgtccccttcaaggcacattccagttcctatcaggaggattcctcctcggacacactgtgcccccaacctgatccttagtgcttccctcgagacctacaaactgcccccttccccggggggttcacaacgccttatgcctctcaggttccgcccccgcccctcgcataagaatacccatctgcctagcttcggaaattcactttcccccgcccgtcccccggagcatcccttgggcccctgtccctttcccggggctcttctaccttaacccagagcagagggtgcaggcctcctgagcccaggggcccagttatctgagaaaccccacggcctgtcccccgtccagaacgtctcagcgagctcacgacgcgcagtcacgtttttttccccccctctacattgcagatgtggctcccaatgttgacgttggccaggacctttgcaaacaagccaggccaaaaagtttcaatatttacactggctgctttaataagggcattgatcttatcctccgtaaaggtcacctcatagtcctgcagaatgagggcagagtagatgcaggcaagctgggagacggaggccatagcgcgggcgagtgtggggctggggctgccggacgcggtgctactcaccggatgaagtgagggtctcaccccaacgcggccttagcttcctcggaaggaccgaacaccttggcggcagccgaggaaaggggttccacagttttaatttatctgtaattcccacgctttactgttgccacggaaaccgctgagcaatagcctctcagaataggaaatcaagacacagtcagaggaagggcgggacagaaagagcctagcatctctcggggctctgggttggccacccagtcctcccctggtgacataaaaagaaagagacggaaaaggaagaattctacctgagttcgccgtaaagcgcccgccctctcgcctctacgcttccagttgcggcttattacgtcacagtaattgctgtaccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaaggtcagtggcctgcggggacgcagtgggcgccgaatttgcctggggaaggggaaatccgctctggcccacatctgcgcactcctagttccgcccctcagcctcaatgtttgttattgttgttcgggttcaggttgcttctgccccgccccatcgacgcaatctccaccaatcaatggcgtggtcgttttgagggacaagtggtgagagccaatcatcttggcgaacactcggagaaacaggggactagttactgtctttatccgccatgttagattcaccccacagggatagcggcagagccggtagcggacggtccttgcattggcctccggcaggcgccccccgggggcgggaagctggtaaggaagcagctgcggttacctaggggtggggtcacgtcacgctaagagggtttggggaagttcaagggaggaatcctgcaaagaagaggggcgactttttccgtgtttcgggacagctaatctttttagtgacaggatgagagagcccttcatgttcagagggaccgagttggcgagaagcgccggagagttggagagtctgtgggtcagaacatccggcttctactgatggaaggccacgactccccagtggaatgagggcctaggcaaagaaaatgagagagccctcggggtagtgacactgtcttgggaacatggagtgctaggaaacgaaaactggaagactaggatgaactctgcaagtaaaaaaatgacactacttacacatccttctcatcccatcctcgttttttcgagaccttaaagagatctccttggttagggaccttcggttttggaaaggcactgtttttcctttttgtcaaacactcagctttcaggccacacttttttgagacagagtcttgctttctcaaagaccaacccaggctgggcttgaactgctgagctcaagcgatcctcgtgccttggcctcccaaagtgctgggattacaggtataagccaccgctcccggcctcaggtcacacattttaaagcctggataacttggcttgtaaaggcctctggtggagacagtaatcaaagctcaggttgccaggtctgtttcattaaagggattttgttgaggctgaaaaaaaaatcgacgtggaggaaaagctaacttgtgccaagcaaaggtgagtcagtggcatggacttacaataatgccagttatgaaagctgaaggcctaagacccagctatctgactctactggctgtagacctaaggggcagatagggttaaccatagctttggtgtttacacacgtttaagattaatgctcctgctgaaagaatttttttacatgtcagccaaagagagttccttatgaagacctggatatggtccagccaagctagaatctcccacttcctgttttctcttagttggcccaccagctggaggagctccagagtatctaaatttccaattgtgtaatttgagaaaaagagaggaagattcatttccttcacaagtagggaagtgtgtttcttgaagttggaaagtgatatttcagaatacccacttttggcggactgagtcacttcatttccttgattttttgcctaaggtcctggggaattgacaaagattctcaaattttaaggaccccaataattacatttcatatgaatgaatactagatgtcagcaggattgttgttaagagactaatattattttggtggtgaacttggttcttggtagaaacaaagaatggagaaaattgggggataattgtcttagggtttcaaaaaagtgcctttaaatgacagtcttaattgtagtattttacagggcagtgcattacattgtggaaaacagtacaggtttatggttctaaagactggtttattattatttatttatttatttgagatggagtcttgctctgtcgcccaggctggagtgcattggcgcgatcttggctcactgcaagctccacctcccaggttcacgccattctcctgcctcagcctcccgagtagctggaactacgggcgcccaccaccacgcctggctaaattttttgtatttttagtagagacggggtttcaccgtgttagccaggatggtctcgatctcctgacctcgtgatccacccacctcggcctcccaaagtgctgggattacaggcgtgagccaccacatccggccctattattttttaaaatgtttaattgaacttaatttttttaaggagacagggtctggctttgttgcccaggctggtcttgaactcctaggctcatgatccttccgcctcagcctcccaaagtgctaagattaccagcatcagccaccacacccgtccagttttttattttattttatttttgagacagagtctcgctctgtcacccaggcgagagtgcagtggcatgatcttggctcactgcaaccttgcctcccaggttcaagcaattctcctgcctcagcctcctgagtagctgggattaaaggcctgcgccactacacgcagctaatttttgtatttttagtagagacgaggtttcaccatgttggctaggctggtctcaaactcgactcaaacgatctgcctgcctctgcttcccaaaatgctggaattacagacatgagccactgtgcttggcctttattatcatattttttatatttgaatgacattttgaaagaacttgcgtacacatttttaatttgatccttatggtaacactgtgagatagtcaaagcagacgtattagacctattttataggttaaagaaccgaagctcaaaagcgaactgacctgctcacagttttatgtctagtaatgggccggaggtatgtctggaagctaagtcttcccagtttgtgtgctcctccgcctcccctctgccccccacccccacccccgcagaccacgctgtaaatccctgggacttaatcttgttcctctcaacctaagctattttttcatatcttgttcctctcaacctaagctattttttcataaagtcataaaaaccagttaaacgtaaccattcatcagtaaacaaaatccttaattaaaaacataatgatcagaatagaaatctgattaaggaattgttaacttgttaggcatgataatgatatctagactgtttttaaaaaattcttatcttttagaggtacatactcaattcttaatggataaaagcatagatgtctgtcaaaataatctagtagggaaagggtattgctgtaaacctttggttacagcaaattggtcctgagttgataattatgaaagaagctagcttatgggtccatagggattcattatattctctctacttttgtatagatttaaattttcccataaaaatattttaaaaaatagtccgggcatggtggctcacgcctgtaatcccagcactttgggaggccgaggtgggtggaatcacgaggtcaggagatcgagaccatcctggctatcacggtgaaaccccgtctctactaaaaatacaaaaaaattagccaggcgtggtggcgggcgcctgtagtcccagctactcgggaggctgaggtgagagaatcgcttgaaaccagaaggtggaggttgcagtgagccaagattgtgccactgcacttgagcctggacgacagaacaagactctatctcaaaataaataaatacaataatataaaataattatattattatagtttggttaaaacattagttgactatggtcagttcattgttggggcagaagtgggagatgcgggggtatatgtgaatgaggatagccttgagttgattgttggtttaactaagtgtttattactctccacttttatatatgtttgaaatcccccatttaaaaaatcagtacaaggccaggtgcggtggctcatgcctgtaatcccagcattttggaaggccaaggcaggcagatcatgagatcaggagatcgagaccattttgcctaacacggtgaaaccccatccctaccaaaaatacaaaaaaaaaaaaaaaaattagccggatgtggtggcgggcaccccagctactcgagaggctgaggcaggagaatggcgtgaacccaggaggtggaggttgcagtgagctgagatcgtgccactgcaccccagcctggggcgatagagcgagactccgtctcaaaaataaataaataaataaaataaaataaaaaatcagtagattgtgaaaaaacatagtaacttggatggagggcattgaatgctacctctgtgtagtttcttggctagtgttttggcctgtaagttcgtaaaactggtagaaaacctaggttctcaagttaggacaaccctccttctgcaagaaaaatgtagaatgtcactctcaagtcatacaagaatacaagttccctgagggcagagaccttatctctcttatccatgttggtatgtcctgctactagtaagtatttgtttagttaaccagtcatcataaagtaccgtaaggattttacaaatgctagatgatttctgggaatgtggtcaaaatttaaatactttcagcatacttctgtttccacatgtttccaacatgtggaagttcctaataacttcaagaataatttttgtgacttaagtacaagtctttatggcatggttttagcctatctttctttcctgaaacaattcctatttaacagtgatggtaagtttcgtaagaacagggacagtgtttcttttgttcattgctgtgtctcccaagcccagcccatattgggtcctcacaagtatttgctgagtgaacttttagtgcaacttatagaaccctttctaatgtgtttttctctctctcccaccaaccttctcaaccctagcctcacagcatggaaccacaggttactctaaatgtgacttttaaaaatgaaattcaaagctttctggtttctgatccagaaaatacaacttgggctgatatcgaagctatggtgagtgttactttattttgtttctccttggtttaagcatggttattttttccaaaggtagctatttttagcagtgttgtttcatagctgtgaagtctgtcatagttaccatttctgggccttttggaaaattgcttttgatagggtttcagtattcatatatgagatgtgccccaataaagggaaccaacacataaatttccttttgaacattttagaaagggaaggtaaaattgtttttagtgagataggatttagaaaacctattaattttagaaccagtatgaggagtgaattggtgtgggctccacccaaccagatcccaaggaaatgttctcttgtgtgaggatatgacttgtgttttgcacaaggatataacttgtgttttgcaagagcctatcaattgtttttattgctaggtcagaggttgagtatctcagagttgagcaggaaaaactttcatacctgcttagacagcagttcacctgttccgtttttttgctaaggcttttcctcctcttggtttgccctttgtactcttctgtttttgttcagtttgcagtggtgaatgttttacttcctgtgttgactgtgtttctctctgaaaccctttggtaaaaatctacgtttacctggttatatctgatgataactaaaaagggaaagaaatggtagatcttaaaagatgatctgaggtagttgtctgccttccagcaaatacctgttcatactgtcctatcagtgacagtgagacccgtctcaaaaaaaaaaaaaagattggattcagaaagaagttagatcttgtttgccaaaagatgtgaaaatcagttatctttcttttcctagtagttaaatgagctgacagcttgccttttttcttccttgtaaattttaaattgtataagtataatacatgcccattttaagaagagaaaccatctcaagcagttaatagccctccattctcccccccctcatctgttactcccaccttctttgggtaaccaatgttaacagccctgtatgtactttaaattttccatgttcatgcagatatcatactaggatcatactataaacattatttggccaggcacagtggcacacgcctagaatcccagcactttgggaggccaagatgggtggaccacttcagctcaggagtttgagaccagactgggcaacatggtaaaaccccatctctaccaaaaaaatacaaaaattagctgggcctggtagcaggcacctgtggttccagctactccggaggttgaggtgggcgaattgcttgagtgctggaggttgaggctgcagtgagccaagatcaagccactataatccagcctgagcgacagagtgagacccatctcaaaaaaaaaaaaaaaaagatatttttcgttttttttttttcttatcttgaaacttcaggagatatccatctatacacataacttatacactgttctacaggataaactctgtcctatacaaatgtgagattaatgggtcacaaagcattttatttgaaattttaatagattctgccaaatgctttgcagaacaattgtagcagcacacagaaatacatgacagtgtcctgaagttttgacaacactggatgttatggctttaaaaaacatttgctgttccctaccccacaccccacccaaaacacacacacacacacacacacacacacacacacacacacacacagtttgggtattctgatgagatgtcatctcattgcttcaatttgcattgttctgacccccagaaagtttgaaagtcttctgatgtatttgttaggtgttctgatttcctcttgtatgaattttatgtatatttttacctgggttgttaattgtatcattagcagttttgctggtactctgggtgtgttgcagatattaaccctttgttatgggttattaaggttgtttgttgtttgtcttttgattttgtgggttttttttactttgacttctgtgtacattataacctgcctttaaatatgtatctcttttataggtaaaagtttcatttgatctgaatactattcaaataaaatacctggatgaggaaaatgaagaggtaaaatatattatggcacttattgctaggtgttcagaatagggatcttatttctccagtgatatgggctttaataattcaaaatagtgtttagcttatttgtgtggtggtttaaatatatttgataactgaatattctaagaagacttgcagcatctgagatggagttgagaaatggagaagcaacactgaagaatatctcagagataactttcacttaaaaaaaaaaaaaggaaacagggtctcactgtgttgctcaggccagtcttgaactcctgggcccaagcagtcctcccacctcagcctcccaaagtgctgggattataggtgtgagacacccaccatgcctggcctggcctgagagaacctttttttttttctttttttttttttgtgagatgaagcctcactccataacctaggctggagtgcagtggtgcgatctctgctcactgcaacctccagctcctgggttcaagtgattctcctgtctcagccttctgagtagctgggattacaggtgtataccaccacgcctggctaatttttgtatttttagtagagacggtatttcaccatgttggccaagctggtctcgaactcctgggctcaagcgatcagcccacctcggactcccaaagtgctgggattacagttgtgagctaccacacctggccaagataacttttaaaattatatagtgaccttaagttcacatatagcacaagctaccacttagtttataataatacaaatataatggctaagctttttttttttttttttttaaagagggtctcactgtgttgcccaggctggtgtgcattggcatagcttgctgcaacctagagctcctgggttcaaggaatcctcccatctcagccttctgggtagctaggacatacctctctgcatctggcaaaattttttaattctttggagggatggaatctcactttgttgctcaggctaatggctaagctttattgagtggttacagtgtgtcagactagccacagtaccatgtattgagtacattattatcatcactattttactcatgaggaaactgaggcacagagaggtgaaaataacttgtccaaatgcacaaaaacttggaagtagtaaagtagccgttcagtccataccctctggctgtagaactcaagctcctaactgttatattgcactgccttttaatgtatctgaaataaaggagggcacagtagataagcaataaaatttcttaagtgttattcatgactagcaagtgatatggaaaagctgaatgcttggcctgagtttttgtctgtcctatggggctggtcctagtaacagaaatgctcaactgatgagacacttataattcactgttgctttttttccttttataggtatccatcaacagtcaaggtgagtccctaagagagtctgttcagccttatttaaaaaccttaatctgctcattgaggcatttctatttatactcaaaccttattgcagtattaattttagagtgacattgcactgatggacattagttacctaggggattttattgtatagcagttttttatatacaggatgatgcctttgaatggaccctaaggacagctttaatgggaggttctcatatttaagatgccagtcctctgaaattaatatgcctcccagttcaacacatataagtattcccatggtgttgcatttgtttctgacttggtatatatgttaatatcaacttataaaacaagtggtattccaaaagtttatttatcagatgttcagagcttggagtgtattttcccataggaaccatgttatagttgaagattagtttcccacgatagcccctaaaatcttaatttaatcaggtgaaatgatagtattaacattgaactctcttgagtcctgagcatcacagtgcgtaaatgtgagggacctgggttgagattttgtaactggaagattcccagtagtgatgaaggagggatttaaggggaagaactgatctacagtagatgctgtttgcaacaaaaagggagtttgtcagcaaaaagatagttgctgttcatatataataagctaagaattctttaaagtcaggattagctgtacatttaacaaatttttattgtatatattgaaggtgcacaacatgatgttatgaaatacatatacagtaatgcatcgcttaatgacagagatttgtactgagaaatgcatcaattaggtgattttgtcattatatggacatcatagagtgtacttacacaaacctagatggtatagcctagtacacacctaggatatatggtataacctattgctcataggctgcgaacctgtagagcatgttactgtgctgtatactatagacagttgaaacacaatggtatttgcatatctaaacatagaaaaggtacagtaaaaatgtggcattataatcttatgggatcaccatcatacacatggttgaccaaaatgttatgtggcaatggttactgtagtgaagcaaattaacatatctatcatctcattatagtggccctgtggtgccctgagccctccccagaaaccagccataatctactcatttagcaaaaatcatgaatataatttacgattatttaactataatatgttcctcatgttgtacagtccatctttaggattggctatccttaatcttatggaatctttggttcttgaatgaatgaatggatgtgtacaaaataaaaataattttaaaataatagaatcttttggggtgtgtgaagaagtatcatggtgtatattttttgtccttttaggagaatatgaagaagcgcttaaggtaatgattatttaatctcatttttaaataatttaaaaaatattattatgggttggttttttttctttttttgagatgaggttgtgctctgtcatccaggctggtgtgcagtggcacaatctggggttgctgcagtcttcacctcccaggcttaagtgatcctcccacctcagcctcccgagtagctggaactacagaaacacgtcaccacgcccggctaactttttatatttttcttagagacagggtttcaccatgtttcccaggctggtctggaactcttgggctcaagcaatctgctggccttggcctcccaagtgctgggattataggcatgagccactgcgtctggcctaaaatatttattgactgaaactcaaacctgaattccattagttatggggagagactagtacgtataaacacagtgaaacctgtttatagggagactgatgaatgggcacgacactcagcaaaaggcaattcataataaaaaggtccttctcagttacagtcccatctctttgctggtctttgtgctactgttctagtgtttaaaaatacaaataactggccaggcgtggtggctcacgcctgtaatccnnnnnnnnnnnnnnnnnnnngccaggcgtggtggctcacgcctgtaatcccagcactttgggaggccgaggtgggtggatcacgaggtcaggagatcaagaccatcctggctaacgtggtgaaaccctgtctctactaaaaatacaaaacagccgggcgtggtggcgggtgcctgtagtccccagctattgggaggctgaggcaggagcaatggcgtgaaccccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgaggcggcagatcacgaggtcaagagattgagaccatcttggctaacatagtgaaaccccatctctactaaaaatacaaaaattagctgggtgtggtggcgtgcgcctatagtcccagctactcgggaggctgaggcaggagaatcgcttgaacccgggaggtggagtttgcagtgagccgagattgcatcactgcactctagcctggtgacagagcgagactccacctcaaaaaaaagaaaaaaaaaaaacagaaaaatagtaacccagttaaggagaatcttacctaatttgccatcttaaaacctacttttatgggtttttttgtttgtttttgtggaataaagcaacacaatacttttgtggttttaataacaaaaccaagttcatgaccggcctgggtaatgtatgacaaaaaattttttaaattagccaacaggcatagtgacccaaacctatgatactagcactttggaaagccaaggtgggcggagcccgggagttcgagactagcctgggcaacatcatgaaatttcacctctacaaaaatacaaaagttagccaggtatggtggtgcgcacctgtagtcccagttactcaggaggctgaggtgggaggatagttgaactcaggtgtccaagaccagtctgggcaacacagtgagactcctgtctccaaactaaaacaaaaaccttagccaggtgtggtggcatgcgcctgtaatcccagctacccgggaggctgaggtgggaagatcgcttgagcccaagagacaggctgcagtgagccatgcactgcattccaacatgggtgacagagcaaattgccatctcaaaaaaataaaaataaatttctaggctgggcacggtggctcatgcctgtaatctcagcactttgggagggcgaggtgggtggatcacctgaggtcgggagttcgagaccagcctagccaacatagtgaaaccccatctctactacaaatacaaaaattagctgggtgtggtggttggcacctgtatgtaatcccagctacttgggaggcttaggcaggagaatcgtttgaacccaggaggcggaggttgcagtgagccaagaccgtgccattgcactccagcctgggcaacaagagcaaaactccgtctcaaaaataaataaataaataaataaataaataaataaatttctagttaacattcttaccaaagaaatagcaagttgagtgtaaacattacatttgttgttggatttaataaagcaaacacaaatcctagtattttctagcataacttaccacactcttctgttttgatgtctttgaaatgttatttaggagaagataatcacgtcgcatgtttttgtttcataatgtatgctcttagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcaggtatgaagggtatggcccagtctatccaatatcgtttcttttttcttttttaaataaagctgaacaggtttctttattttatttttttattatactttaagttctgagatacatgtgcagaatgtgcaggtttgttatataggtatacatgagccatggtggtttgctgcacccatcaacctatcatctaccttaggtatttctcctaatgctatccctcccctatcaccccaccccctgacaggcccccgtgtgtgatgtacccctccctgtgtccatgtgttctcattgttcaactcccacatatcagtgagaacatgctgtgtttggttttctgttcctgagttagtttgctaagaatgatggtttccagcttcatccatgtccctgcaaaagacatgaactcatccttttttatggctgcgtattattccatggtgtacatgtgccacattttctttatccagtctatcattgataggcatttgggttggttccaagtctttgctattgtgaatagtgctgcaataaacatacgtttgcatgtgtctttatagcagaatgatttataaccctttgggtatatacccggtaatgggatcgctgggtcaaatggtatttctggttctagatccctgaggaatcgccacactgtcttcaacaatggttgaactaatttacactcccaccaacagtgtaaaagcattctatttctccacatcctctccaacatctattatttctttttttttgaaacggagtctcactctgttgcccaggctgtggagtgcagtggcgcgatctcggcttattgcaagctctgcctcccgggttaacaccattctcctgcctcagtctcctgagtagctaggactataggcacctgccactacgcccagctaattttttttatttttagtagagacagggtttcaccgtgttagccaggatggtctcgatctcctgacctcatggtccgcccgccttggcctcccaaagtgctgggattacaggcgtgagccaccgcgcccggcctccaacatctattatttcctgacttttttttttttttttttttttttgagacagagtcttgcaccttcgccctggctggagtacagtggcgtgatcttggctcactgcaacctctgcctcccaggttcacgtgattctcctgcctcagcctcccgagtagctgggattacaggcacacaccaccacacctggctaattttttgtatttttagcagtgacagggtttcagtatgttggtgagactggtctggaactcctgaccttgtgatccgcccacctcggcctcccaaagtgctgggagtacaggtgtgagccaccatgcccagccctgtttcctgactttttaatgattgccattctaactggtgtgagatggtatctcattgcggttttgatttgcatttctcttttttttttttttttttttttgagatggagtctcactctgtcgcccaggctggagtgcagtggtgcaatccgggctcactgcaagctctgtctcccgggttcacgccattctcctgcctcagcctctcgagtagctgggattacaggcgcccactaccacgcctagctatttttttgtatttttagtagagatggggtttcaacatgttagccagaatggtcttgatctcctgacctcgtggtccacccgcctcagcctcccaaagtgctgggattacaggcgtgagccactgcgcccggcctgatttgcatttctctaatgaccagtgatgatgagctttttttcataggtttgttggccgaataaatgtcttcttttgagaattgtctgttcatatcctttacccactttttgatggggttgtttttttcttgtaaatttgtttaagttccttatagattctggatattagccctttgtcagatggatggattgcaaaagttttctctcattgtgtaggttgcccgttcactctgatgatagtttcttttgctgtgcagaagctctttagtttaattagatcccattgtcaattttggcttttgttgccactgcttttggtgttttagtcatgaagtctttgcccctgcctatgtcctaaatggtattgcctaggttttcttctagggtttttatggttttagatcttatgtttaagtctttaatccaccttgagttaatttttgtataaggtgtaaggaaggggtccagtttcagttttctgcatatggctagccagttttcccagcaccgtttattaaatagggaatcctttccccattgcctgtttcagtctatccaatttctagatttatttctcattgtctttgttgtaagatttgcacatttatcagagatttgggaattagtgtgctcctctctctgacttttgaaactggtaatagtttacttctgtagaaggggagcaggctagagactttgttttcctttagtacgccttcatactgtgactttttaaaaaattatatacttgtatgatttcacaaaagaaacctcaaaataatacactccaggaaaagtattttaaatagaaaaagtaacctctaacatctcggcttgtgttttctcccagtcgtttccacttgttccatgtgacacagaccagcctcaagacaagcccccagactggttcacaagctacctggagacggtgagtgttctgtctcgcttgggttttaactgcggtgttggcacaggtggaatgtggaagaaatagaaaactgaacccaggtggctgctgcctctagtaccggtgaagagtggtagcttataatttccaaacttagaacagttccagtcgagaaagctctaacctttgcagtgaagtgtcagaaaaagagggagtctaattctaagcatgtaagggagagggacaactctctgcttgagaaaaagttagaaatttacttatcaaaaggatgttttgatattttcttcgaaccagtttagctgtggaaggaatagaccttttgctatgtttctgtctattcagtagcagttgtttattgtgtttttgtattataccagagacagttaggtttcagatctattgatatcttcacatttttttctgatattggaactgagttttttccctaccttctgctccatattctagttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtaggtaagcagttgcttgggagtagctagctagtgatagaccttacagcttttacctccctggctttctgtgtaggtaaagggaaattaattgtaccctgtttctgagcattagatgttgtagctgtgagttggaagcacaagctactcttcacccacatgctttgtatgttgtaactattcagattgttgtgttcaaatgtgcatttggattagcaaagccaggcaaaattatgttcccctgaacggacaaaattagatcactaagggtagttcctcggttgttccaaatgcctttttttttttttttttggtgacagggtctctgtcacccaggctggagtgcagggtgcaatcatggttcactgcagcctcaccctcccaggctcagacaatcctcccacttcagcctgccaagtagctgggatcacagactgccttttaattatttttttggagatggggtctccctatattgcccaggctagtctcaaactactggactcaaatgatcctcttctccatggcctcccaaagtgctgggattacagacatgagccactgtgcctggccccatgtactttcacatcttaccttcctcccatagattttcatttaaaatggatatgggttaagtgttattatcctcattttattaatgaggaaaattgaggcatggcatagtcagatggcatgctcaggttacctgctagttggtactggagcaaacatagaagtatggtcttatatctccctaccccaggtacttcctattctgccattgtgtattgtgccattctttccccacagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggtaaaaccctctacatggagatgcttattctctgattgacttcttggttctggtgacagggtatgaatcacaaaactacagatagtctccttagttctgctcattttcaattgatgtgcaataatgaagacagttatccaaagttagtgaaatagaaataatagctataaaaagaaattaagaaactaaagtaggctgggcacaatggcccataactgttatctcagcaacttgaggggctaaggtgggaggagtgcttgaagccaaatatttgagaccagcctgggcaacatagcaagatcccgcctctacaaaaaaaatttaaaaattagccaggcgtggtggtgcgtacctatagtttcagctacttgggagtctgaggtgagcagattgcttgagcccaggaatatgaggtggaagggagccatgattagaccactgtactccagcctacatgacagagtgagaccctaattctaaaacaaaaaaagaaattaaactggaagctgacactgatggaaattgcaattggctccacatagcttcagaatttatttgtgactttcttttaagacttgcttttattatctcacaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgtaagcccaggactggggtgggagccaaaactttaggcccagctctctgaaactggaacttcaaccaatttccgtcttatttattggtagcccttaacacctaaatctttaaaactttccattatctggtcttagtattttttgtttgtttgttttttgagacagagtcttgctctgtcacccaggcggtagtgcagtggtgcgatctcggctcactgccagctctgctttcgggttcacgccattctcctgcctcagcctcctgagtagctgggactacaagcacccgccaccacgcctggctaattttttgtatttttagtagagatggggtttcaccgtgttagccaggatggtctcgatctcttgacctcgtgatccgcccgccttggactcccaaagtgttgggattacaggcatgagccacacagcacccggcttttttttttttttttttgagatggagtctcgctctgtcgcccaggctggagtgcagtggcatgatctaggctcactgcaacctctgcctcccgggttcaagtgattctcctgcctcagcctcctgagtagctaggattacaggtgcatgccaccatgcccggctaatttttgtattttttcagtagagatggggtttcatcctgttggtcaggctggtctcgaactcctgacctcatgaatccgcccgccttggcctcccaaaatggtgagataacaggtgtgagccactgcgcctgcctggcgtggtcttagtattattaaagggtggtttggtagttttttgtttgttttgtttttgagacggagtcttggagtctcgcctgttgcccaggctggagtgcagtggcgcgatctcggctcactgcaagctccacctcctgggttcacgccattctcctgcctcagcctcccgagtaactgggactacaggtgcccgccaccacacccagctaattttttgtattttttagtagaaacagggtttcaccgtgttagccaggatggtctcgatctcctgacctcgtgatctatctgccttggcctcccaaagtgctgggatgacaggcgtgagccaccgcgcctggccaagtttcgtagttatttttgacacttgttttgtttccttcttcagaaagatagaaaccactaaagttcaaaatggcggggtccctctcttcattggaggcaatctggaattgaagcaaaaggaacaaatgtgttaaaagcctgactctctaggtgttgtatttataggcccttttaattactcttaccatgacttttttagctcaggagtgagacctatcctctgttttgttttattgttttaagtttgtcagaaaatttattgtttctaatatgtggtcctatactagtaatatcagtattatttttaaggcaaatgggttagcacattttcaagagtcacagtcagactctcaagctagtgtgaggtattcagaagccttcacacccaacagcaagtgactaagcatctgaatttctgttcaggctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaaggtaatttttcccacaaaatgcaaagatgaggtgatttgaagtggcagagtgctcagctgacaagcttgctttctcttcttactgttcttttcagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggtgagcattgactgacaggctttggcctagtatccaaatcttagttagagaggagatggctaaaactaaaagaacccactcatagctggttgttttccagaaaccttgaaaggttagcatctccccccgccccaacacatctctatgctgatatttggcctcttccttagggtgtttgttttagcgtctttagggtcttgctgcatactgaatacttttgtacctctttgtgatgttgcatggtcagcctgttggctgcacaagggaaaaagggactcctggcctgggctggcctgtggaactgctgaactgatagctttactccttaacatccatctctcctgaaataccctgtgtatgttccctaaatactaatgaagtcttgccctggttgctacttagtgaacagttttttaatgcaatttctctgtattagtggggcagagtgtttactgcttaaagttatccaatgttaattttctggttttgactattatagttaatataagttatcgtcattaggggaagctggggaatgtgaattctctctgctgtttttacaactttttctataactgtaaaaatatatcaaaaacattgttttttaaaatatggaggtacagcagcgtttttatttttgggggcattgtcagcctgcctcttcagttctgttgaaggcctaaaatttgtctcaatggtttgtctctataggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggtggaagattcagcactttgaagggcaagggacagagggagagagcacaggagagaaggtggtagagccataggcagtaatcaggaaatcagagatatgcccactttgatctagtcaggtatatttaatgggaaggagatcacccatggaagcaagtttgtaaactagatgtttcctctttgaattgggaactcaatcctgtacttccccacaaactccctttagttgcctcttcaccttggcctagctaattctccttcatacctgctgcattttctctttcctgctattgggttatttcaacatctaattcccatttaactcttcttgttttcacttgtctggggacaggcatgaatttgaacagagttgaatacgaaatgatgtggaaatggtctacaggtcccatcaagacatggctccagcatgcactccaaacagcctaacattgtctttttttataggacctgctgtcctttgagctgttggatataaacattgttcaagagttggagagagtgccccacaacacccctgtgggtaagaatgtcactcatttcatcttgttcgtcttactaataggcacaaaagtaccacagcctagacactggtagtgttttattctgaggaaatggcaaggatttctcccacagtaggatagtaaagcagcaatcatggatccgtttttcttctttcctgtcctttgtcaaaagtaacaacatgctgggcatggtggctcgtgtctataatcccagctctttgggaggccaaggcaggaggatcacttgaggccagggtttgagaccagcctgggcaacatggtgaaacccccatctctacaaaaattacttttaaaaattagctgggtgtggccaggcacggtggctcacgcctgtaatcccagcactttgggaggctgagacgggcagatcacctgaggtcgggagtttgagaccagcctgaccaacatggagaaaccccttctctactaaaaatacaaaattagctgggcatggtggcacatgcctgtaatccgaactactcgggaggctgaggcgggagaattgcttgaacccagaaggcggaggttgtggtgagctgagattgcaccattgcactccagccaggacaacaagagcaaaactccgtctcaaaaaaaaaaaaaaaaaaaattagcttggcatggtggcctgcacctgtggtcccagctaccagggagactgaagtgggagaatctcctgatcccaggaggcagaggctgcagtgagccaggattgtgccattgctctccagcctggatgacagagtgaaacccaatctcaaaaaacaaacaaaaaaaagaggctgggcacggtagctcacgcctgtaatcccagcactttgggaggccaaggctggtggatcacaaggtcagaagttcaagaccagcctggccaagatggtgaaaccccatctctactaaaaatacaaaaattagccaggcatggtggcaggtgcctgtaatcccagctactcgggaggctgaggcagagagttgcttgaacctgggaggcggaggttgcagtgagccgagattgtgccactgcattctagcctgggtgacagagcaagactgcatctcaaaaaaaaaaaaaaaagcaataaaacaagttcgtgcaaggcttttccactataaaggaatcctcttctcttttttccctctagatacttgtgtccttttgttcctttatgttcatggttttgtgtcttggccacagctttccaggctaaataactgtgattcttcctgcattgattgatctgagatattttgcttacttattggtctggagaaattttttgtaacagacctcaaagcatatcttggtttattttagccctgcgggaggcaagaagcctacaaactgctacttctggacactgactgttgatgatatgatgctttctcttgattgatggttctcctgtcttcattctccagatgtgactccctgcatgtctcctctgccacatgacagtcctttaatagagaagccaggcttggggcagatagaggaagagaatgaaggggcaggatttaaagcacttcctggtaagggattaaacatttgtaaagtatttgcatcctccctttccatatcataccctattttacagctatcccctactgaccctaccttagcatgtaaatgggcttgctttctgtagcatctcatgttttgaagtctcctcaccttcacatggcacagatagcagctattccttggtttagttttagcatgggtaatgactggtgaatgttcttcagcactttaaacaccaagtgcagacaaagtttagatagcagctattccttggtttagttttagcatgggtaatgactggtgaatgttcctcagcactttaaacacccagtgcagataaggttcgtgtgtctttcagattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagagtgagtgtccttgcatttcccctacctagcagggtggcacctgaattgtgactgccagacttgactagttagatgtgctcttcttcactgagactgaagggagagtgatcttagttagaagttctgatcttggcggggcgtggtggctcaagcctgtaatcccagcactttgggaggccaaggcaggcggatcacaaggtcaggagatcaagtccatcctggctaacatggtgaaatcccatctctactaaaaatacaaaaaattagcctggcgacgtggcgggtgcctgtagtcccagctactcgggaggctgaggcaggagaatggcatgaacccgggaggcggagcttgcagtgagccaagattgcgccactgcactctagcctgggcgacaaagcgagactccatctcaaaaaaaaaaaaagaaattctgatcttgtttgtgtctttagactctacgtatgctacctgactgttctaattagagcatcaggagtaaagaagccatcatactcatttctccatcttctcaggggcagaattacagctgcattccacagtggaatagcagccagttgtgctgcctggattctgcagtaaggaatcttcctgtaatttgacagagctccttagcagagacccctatgggtagctgagttgtctgctttctccaagggcagcagtcccagaaacagtggatagaagcaggagtaccaacaaagtttctcaaggttaaattctgctgtaataaatacctttataggccgggcacagtggctcacccttgtaatcctagcactttatgaggctgaggcgggtggatcacctgaggttgggagttcgagaccagcctgaccgacatggagaaaccccatctctactaaaaatactaaaaattagccaggtgtggtggctacatgccaaggattacatgcctgtaatcccaggtacttgggaggctgaggcaggagaatcactttaacccgggaggcgaaggctgtggttagccgagatggcgccattgcactccagcctggcaacaagagtgaaactccgtctcaaaaaaaaaaaaaggaataaatacctttataacagaaacttctaggtatcagatagatagaaccaatagcatatattttaagaagtatccaaaaattcaaatatactatgtcaaaataatattggagaatctctttattataatcaaatttgacctatatctttaaatattatttatcttacttttgtttaaagtatacatgtaaggccaggcgcagtggctcacgcctgtaatcccagcactttgtgaggccgaggcggacagatcacaagctcaggagtttgagaccagcctgaccaacatggagaaaccccatttctactaaaaatacaaaaattagctgggcgtggtagcgtgtgcctgtgatccagctactcaagacgctgaggcaggagaactgcttgaacccgggaagccaaggttgcagtgagctgagatcgcaccactgcactccagcctgggtgacagagcgagactccgtctaaaaaaaaaaaataataaagtgtacatgtggccaggtgcggtggctcatacctgtaatcccagcacgttgggaggccgaggtgggcggatcatgaggtcaggagatgaagactatcctggctaacacggtgaaaccccatctctactaaaaatacaaaaaataagctgggtgtggtggcgggcgcacctgtaatcccagctactcgggaggctgaggcaggagaatggcgtgaacctgggaggtgcagcttgcagtgagctgagatcatgctactgcacttcagcctgggcaacagagtgagactccatctcaaatcaatcagtcatgtatatctttatatttttttccacatgtgtgtacaaatacataacaaaaaggtctggaaagacagtaccaaaatgttcacagctgttattctgataggatttatgggtaattttttttttttttttgagataaggtctcactcgcccaggctaaagtgcgagtagcaagtttatggctcattgcagccacaacatcctggggtccccctacctctgtttcccaagcaactgggaccacagccacatgctaccacaatgagctaaatttttttttttttgtagagatgggatttcgccacgttgcccaggctggtcccaaacttctgagctcaagcagtctgcctgccttggcctcccaacgtgctgggattttaggcgtaagccaccacacctggcctgggtagctttttttttttttgggacacagtctctgtcacccaggctggagtgcagcagcgcggtctcggctgactgcaacctccgccttcccaggttcacaccattctcctgcctcagcctcccgagtagctggcactacaggcgcccgccaccatgcccgggtaatttttttgtatttttagtagagatggggtttcaccgtgttagccaggatggccttgatatcctgacctcatgatctgcccacgttggcctcccaaagtgctgggattacaagcgtgagccaccgtgcctggccctgggtagcttttttctatccttttttaccctctcaaacatgattggccagttttctcccatgactgcatcatctttgtaaagaagaggaggagatagacatataatcctgcaatactcatctcctaactttttctctttttatagcactgttagtgtatcagttttggtttaaactctactcagtatattaaccatcacataaaaaggaaaaaagggatggagctgcctccttttatgattcatagagcttcttggaaacctgagtgtttctgcctaccttgtttctgtgagctttgattctattttgttttgcatagtcttcaaacttagaatatggtcatagttccagaaccagcccttccctttagttcttccctctcctctggctttcataattctagcttatgatccacaaggctttaccaagtaaggatagtacttaggcctgcttttagcttccaccttaaaattggttgctttcatcctttagtgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggtaccactcacagccccctcagctggggtgttcttcagaggtgaaataaagagaggaatcgacctgatctcaaaacctgttttttcctcagtatggaaagagactattttccatagcaaagtctgaatttagatgaataaaagttgtatttcccagtatttgtggattctggatttaaagaaatatttgttttagttggccttaaattatctgagtatagtctgtctgcttatattttgattattgagagctggttgtgtttttttttttttttttttgagacagggtctcagtctgttgcccaggctggagtgcagtggcacaatcttggctcactgccacctctgcctctgaggctcaagcaatcttcccacctcagccccctgagtagctgggactataggcatgggccaccacacctagctaatttttgtatttattgtagaagcggggttttgccacgttgtccaggctggtcttgaactcctggccttaagcgatccaactgcctgggtctcccaaaatgctggaattacaggtgtgagccactatgcctggctgagagccagtttttaaacacaaacatccctggaccttccctccttgttttattgactcttcagtaaaggcagcaaaaactcaacccaaacagtcataattaggaagttaaatccattatgggaaaaaacactataaaaccaaactaattatttttaattctctggtgaatctatctgaatcattcttgtctcctaatagtagggaaaatgctggagccttgactataatgtaaaccattctccccaaaagctagacatttccgtttattgacaccacttgatgtaggtggggacatgaccagactgaagccaacatttctagcttgcctgtggctaaagaggaaaatggggtagaatgtagcccttatgatggaaccctaaatccagacatgtgatctggatcagaaatgtgaagcctctgtagagaatttggcactgctgtgctgtgtttactatttctccactgttgccataagtgccttttcaatttactttccatattgtgtctttctgaaaggagctctccttgtgtacatcatcatggttccccaggagtggatttaccagttaccataccagaagtttcttcagtccctgatcagatcagaggaggtaatgatcagcctaagctttttctctttttctctgctcctgtctaatggaaaccaggtataaatagcctctctctcttcgtgattcttggtggttttttgaaacttgcccttcacaggccaggcgtggtggctcacacctgtaatcccaacactttgggaggccaaggcaggcggatcatagggtcaggagttcgagaccagcctggccaacatagtgaaaccctgtctctactaaaaaatagcaaaaattaaccaggcatggtggcgggcacctgtaatcccagctacttgggaggctgaggcaggagaatcacatgaacctgggaggcggaggttggagtgagccgagatcgcaccattgctctccagcccgggcaacagtgcgagactccgtctgaaaaaaaaaaaaaaaaaacttgcccttcactctctccatgctcctcctgcatactctaatttctattctctggctgaatatattgttagacctcatagaggtagtggaaagaacacaggctttggagccaaacaatctaggttccagctccatctccccctttcctgactagcagttcagcaggtttctaatggctgtgagtctgttttcttactacaaaatatatcagtgtgttaggattatagagttgatttttctgattcaataaacaatcatcttgcattgcatttctggacagtttctccttatcacttaaactacccttaaaacttcccaaatactttaaaaaaaaaaaaaaaagacttcaaacactgtgatcagattgccacctgcctcaataatagccttgctgtgagttaggaaacagtaggtgcttatggatgctgcatctaaccaacagctcttttgcttttagagcccagaggctcatcaggacttgtaaacagcagacagaagagctatgaccactcaaggtaacaaccttgtgcagtctcttttttcagaagcaggtggatattcttgtattccttctgcttaaaagagcctctcacagtatgtacccatcttcagagagcagagaaggggagcctttgttccgtcttattcttgtttcttctaaaggctttgagcaacactgaacaaacggctaaagctgatgtttaagagtgttctgtttgggaggccgaggcgggtggatcatgaggtcaggagttcaagatcagcctggccaacatagcgaaaccccatgtctactaaaaatacaaaaattagccaggcatggtggcgggcacctgtaatcccagctactcaggaggctgaggtgggagaattgcttgaacccaggaggcggaggttgcagtgagctgagattgcaccattgcactccagcctggctgacaagtgaaacaacatcaaaaaaaaaaaagagtgttttatgtttcagacaaggaaatagtgtccacaaattacctcactcttagcactggggaaaaggtagaaaggttaagcccagtatacatttaaataattttttcttggacatacctggttctctgcttccactcatattaggccagtgtccagaaaatcacatttcctttgcaaggtgttttctctgagagaataattgagcagacaaactgttgatatccttgtgtgtcctcgatcacattaattttcagctaggagtgagagccatcatggttaccagagtggtgtgtttcctgcagtgcccctatcttgcttgcaccagtagagctgggccctccatcaaaccatgatctgtagctataaagctgataatgaaagcaattgtgttctctttttccatctaattttttctcttaaggaaatcttattccaaggattagagcccagattatcttgtaaaaaggtaatgatttgtgtttgtttggggagataatttggttttcctctgcaggcaccatcatgggagcagcattgctggaggactggtgaagggggctttgtctgttgctgcctctgcatacaaggccctgtttgctgggccaccagtcactgcacaggtcagtgtgtgtgttttattttcctgaatctcaactccatgtcaccagtgaaagtgatggcatctgtctgggttgaagagtaacatggcattgtggaaagggcataggctttagatttagtctttagttaacacacaacacaactctgccacttttttttttttttttgagacgaagtctcgctctgttgcccaggctggggtgcagtggcgcgatctcggctcactgcaagctccacctcctgggttcacaccattctcctgactcagcctcccgagtagctgggactacaggcgcctgccactacacccggctaattttttgtattttttagtagagacgatgtttcaccgtgttagccaggatggtctcaatctcgtgacttcatgatcttcccgcttcagcctcccaaagtgctgggattacaggtgtgagccaccgcacctggccaactctgccactttctaactatatgactttagccaagttacttaagggaagaaaagagaagaatgtattattgatgatctattaatattttctatagagagaagctattccaggtgttggcactatggcatgaataaaacaccagttcttggccgggtatggtggctcttacctgtaatcctagtactttgggaggccaaggtgggaggattgcttgagcccaggagtttgagaccagcctgggcaacatagtgagacccccatctctacaaaaaaatttaaaaattagataagtatggccggtacagtggctcacacctgtaatcccagcactttgggaggccgaggcaggccggatcacaaggtcaggagatcgagaccatcctggccaacatggtgaaaccctgtctctactaaaaatacaaaaattagctgggcgtggtggcaggcacctgtagtcccagctactcgggaggctgaggcaggagaattgcttgatccagggagtcagagcttgcagtgagccgagatggcaccacagcactccagcctggcgacagaacaagactccatcttaaaaaaaaaaaaaaaaaagtatgatggcatgcacctacagtcccagttacttgggaaactaaggtgggaggatcacttgagcaccggaggttgaggctgccgtagtgagccacaatggagccactgcactccagcttgggtgactgagcgagaccctgtctcaaaaaacaacaacaaaaaagacactgagtcttgcccagaaactatgggaaacaagtgaggtgcatggatacttaaagtacatagtaagatactatgctggccgggtgtggtggctcatgcctgtaatcccagcactttggaaggctgaggcgggcggatcgtgaggtcaggagttcgagaccatcctggccaacatgatgaaaccccgtctctactaaaaatacaaaaattagccaggcatggtgatgtgtgcctgtaatcccagctacttgggaggctgaggcaggagaatcacttgaacctgggaggtggaggttgcagtgagctgagattgtgctactgcactccagcctgggcaacagagtgagactccatctcaaaaaaaagaaagatactatgccagtgctatcagacagatgaaacacttcagcctggtgtgcccaagtaaggctttctggtagatgatgcctgaactgagtcctaaaggacggagtaaatgttcatcaggaaagagggagggaaagggtattgtagacagtgtagccagtaaaaaagacttggaaatgtgagcatggagtgtgaatccggtctaagaagaggagtaagacgaaaaaagactggctgggcttggtggctcacacctgtaatcccaacaggttgggaggccaaggctggtcgattatttgcgtccaggagttcaagaccagtttgggcaacagggcaaaaccctgtctctactaaaaacataaaaaattagctgggcatggtggtatacgcctgtggtcccagatactcaagaggccgaggtgggaagatcacttcagcccgggaggcagaggttgcagtgagctgagatcacaccactgaactccaatgtgggtgacagagtgagaccatgtctcaaaaaaaaaaaaaaaaaaaaggctgggtgtggtggctcacgcctgtaatctcaacactttgggaggctgaggcgggtggatcatgaggtcaggagttcgagaccagcctgacccacatggtgaaaccccatctctactaaaaatacaaaaattagctaggcgtggtgacgtgcctgtaatcccagctactcaggaggccgaggcaggagaatcgctttaacctgggaggcggatgttgcagtgagccgagattgcgccactgcacttcagcctgggtgacagagcgagactctgtctcaaaaaaaaaaaaaaagaaaaagaaaaacagaccaaatatgtaggcaggatgctgtgttatgaggtttggattttattttaaggctaattaataggaggagcaattgaagggttttaaggaagtgattgacatgatgagatctgtttttagtaagattaccggctacattgtagaggctggtagagccagtaaagaaatccagttgggcgtggtggctcatgcctgtaatcccagcactttgggaggccgaggcgggcagatcacgaggtcaggagttcaagaccagcctggccaatatggtgaaaccacatctctactaaaaatacaaaaattgccgggcgtggtggcacgtgcctgtagtcctagctactcgggagtctgaggcagaagaattgcttgaacctgggaagcagaggttgcagtgagctgaaatcatgccactgcactccagcctgggtgacagagcgagactccgtctcaaaaaaaaaaaaaggaaatccctaagagaatccatgtattggtggaaaggaagggtagaaaagataattaagagatggaaatggcataactttgagatgatgattaagtggctaaaaagaaggataggctgggcacggtggctcacatctgtaatttcagcactttgggaggccaaggtgggcagatcacttgagttcaggagtttgagaccagcctgggcaacatagtgaaaccttatctctacaaaaaatacaaagaaattagccggacttggtggcgcacacctgtagtcccagctacttggggggcttaggtgggagaatagcttgagccccagaggcagaggctgcagtgagctgaggtcatgccactgcactccagcctgggcaacaaagccagacactatcttggggtggaggggaaaaagtcaaggataaatcccaagtttctggcttagtaccattcattaagagcagaagaagagaactaggtcagttttgctggacagtgttgagtttgtggcatatccaggtaaaggtaaagatatccagagtgcagctggatatatagttgtccctcagtatctatgacggttggctccaggaccccctgtgggatactgaaatccatagatgcttaagtcccttatataaaatagtgtagtatttatatataacctaggcacatcttcttgcttgcttgtttagttttagttttttagatacagggtcttgctctgtcatccaggctggagtgcaataactagattgtagctcactgcagcctagaactcttggattcaagcaatcctctcacctcagcctcttgagtagcagggactacaggtgggcaccaccatgcctagctagttttttaaaaatctttttgaagagatggggtttcactgtgttgcctagggcaactaactcctggcctcaaaacaatcctcccacttcagcctcccaaattgctgggatgagaaacttgagccgctgcacccagcccatctcatatacttcatctctacattacttacaatacccaatacaatgtaaatgctatctgaatagttgttatacggtattcgggaataatgacaaaaaagtttgtacgtgttcctttttttctccccaaatattttcagtcctttggtgactgatccatagatgaggaacccacagataatggcaagccaacggtatccatccagatcacaggggagggatttggcctggtgatacatgcttgagagtcacttgcctacagattatagcagaagccatctgatggaatgagatgatccaggaataatggggaaagcaagaagcaacctttaaggatcagggaaaggaatactctgaaagaaagctgggaactaggaggaaaatgaagagagagagttctatgctggaacttaaggaagggtgttttaataagggggacatggtcaacggtgttagatgctacagagagatatgaactggtggtgaggaatttgagagtagaagtatgccacactttcaaatagacaggctacaacaggcagaagctaggatacataagacaagaggaagcatttttaaagttgggtgagactttagagatgggcaagccagcagtgaaagaggttaatgataaagatgagaagacagattggagatggagaaagatttctgaagtggtgagaggtaataagatacaatgcaaggtacattccattaacctgcaaaggaggatggataatctattctgaaataagaaggtagaatggaacagtggaatcaggtttggagggaaatgcttaacatgtttgcatactgttctcatctttacatactttttcaacaaccctgcaaagtaggaggtatgatatatcttcagttcataaaggaattgatagcacagttggtaagtaaatggaagattagggtttgagtctaagcctatctgcctcccaagttaataatctttctgctgcacagtttcagtatccccagtctgtgaaattgggataataacagaaccagaggccaggcgaggtggctcacatctataatcccagcattttgggagaccaaagttcaaggatcacttgggcccagaagttcaagaccagcctgggcaacatagggaaacctcatctctagtaaaaaatttaaaaatttgccgggcgtggtagcgcagaccagtggtcccagctatttggaaggctgaggcaggaggatcacttgagcccaggaggttgaggctgcaatgagctgtgttcacaccactgcacaccagcctggggaacagagtgacaccctgtctcaaaaaacaaacaaaacaacaacaacaacaaaacaagcgtttaaggatttaggaaggtaatgcttccaccacagggcttgaatgaatgaatgttaacttcctcttacctattcttgtttttttttttttgagatggagtctcgctctgtcacccaggctggagtgcaatggcgcgatctcggctcactgcaagctccacctcctgggttcacgccgttgtcctgcctcagcctcccgagtagctgggactacaggcgcctgccaccacgcctggctaattttttgtatttttagtagagatggggtttcactgtgttagccaggatggtctcaatctcctgacctcatgatccgcccgcctcagcctcccaaagtgctgggattacaggtgtgagccaccgcacccagcccctcttacctattcttttggaggagaaaaaatcaagaagccttcccaggttgtaatttcccaagctgttttttttgtccagctcctctgcatatctgacaaaatttcccatagcatctttcagtaacacttttatcttgctcatacttcccccatcatcacaattacacttatgttcacagggtctctggggcttgctgtcattccttcatctggccaaaaaatgcttcttcctgaaagccccgagtgaagcattctcctggttctaagtacagttcattagctccccggtttcccttttctcctccttcaagtacacagataactaatctaaaatagggccttcccagtccgaaccgttggtatcaagtacacaggagtgccatagccttgaatctaattacctagtactttgaataaatctggaaagactagtatgcttgcaagatgatacaaatgtataaaataaacatttaaattatacagaatttttttttttttttttgctttgcttgtctctacacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctacccggactggctagtccttgcggaagcagcgtccgggccctcgggtaacgtttgaagagctggcagcgtctcaggctgctgcgtggcgaaggggcggaccgggggacgggggggtgggcccttaggggctggggcgggacttccctgggcactgagtcaaagcttgaggggagtgttcgctcccgcattttcgattccactctcttccgtttctgtcgctgcagtcgtccgcgggtaaggccctccctagaccctttatacctactttacctttcggaggtcaagacacctcctgttgccgcctcctcgcccaacacacaggcgccccccgcacgggtaccaagcttgactaacggcctctaggggtgtgtggtgggacttgaaatcctcccttaatgaagtcacaccttctccgtccgcttccacccggtcggcccatggcagagcccccatgtagcccaggaatcggcttggcccttcggggaggtcagcgtccttactatccccactctccagtgcggcacattcgttcccctaggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaaggtgagcatccctatattttagcccagaaagatctgtgtggctcacttgccggcctcgttctgtcacacagagtccagatttagccttgagttttcctagtgaaagacagaccctggtatcactatgaccctcctcaggctttcttaccccgcctcagaaagcagtgaggtgtctgctttctcccagggcttctttagataggggtcttaaccacacctgtgaccagtctggcctcctctctccttgattcaaagaatctcttttctgccctatccaacttccttcccttaaactgaatgacagctcagcaacttttccagagaaaaattaaatgctctgacaatcacttatggaagttccttaaagtgaagtaacttctgcttttcttttgttttcccttttgtaggcagattggtctcttttaaaataatgaaaggagtcgaaatgcattgagacttctgagagtcccatgtgaccacccagtttttcacatcctatcttccttaggcttgagcttgcttaaactgtggtgaagctccttgccagtcttgagaacttcaaaccaaaattacatctggcgtcagtgctaacaagcttagcactgaactttggtcttttctcattagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaaggtgagtggcccaaggctctggaaatagcctggaatccagggaaagttcttagcctgttggcctggggcagcccctctgagtctccttggatggggttagatctgctcccagctcttgacctcccagtctcaggctggccagggagatacttaactatccttgggttccctgcaaaaacctgccctccttccctggttgtattctccagccccttgtgggaaagaaggattctagccactgtgcttctgagcaacactgtgtgtcctaggattcattcagttcaggaagttacaaatgaactttccaaagatgctgggcatctctgatttgctggtgactttcagagattcttcatacctattagtggaaatctcacttccattctagagatggcaaagctgagctgccaactttggtagcagagtccagtgcttccagtcctgctctggggcagatgtggcatgtttctaacattgctctatggtgtgggtggaggcgtgcttctgggaagctggcacagtaaatatttgtcacagttgcatcttggccctccctctcaccttctctctctctagagctggagaagcagttggtggctctcattccctatggggaccagaggctgaagcccaagcacacgtaagccccccttcctcccctagcttcacaagccattgcccctgggggctgctccctttgtctcccctgttttgatctcccttaatttcttcctattagttcttccatagaaagcctgagcctcagaggtaccagctccttacgtccaaggattttttcctgatttagaagctcctggaccgggtgtggtggctcatgcctgtaatcccagcactttgggaggccaaggcaggcagattacttgagctcaggagttcaagaccagcctgggcaacatggtgaaaccccatctctatcaaaaaaaaaaaaaaaaagaaaaaaaaaaagaaaagaaagaaagaaagaaaaaagcagcagctgtgggcacagcagatgtcacttgaggccacctggtgggcttccttaagcatcactgcttccagaaagcatggccccctctccaagacaggaaggatctggtagctctgcaagtcctcccaggaaggagggaacaagcatgtggccctggctgcaattgatttgaaaatgttatttttcttaagcacctcccttgctgaggcagttcagatttgcttgtttttcttctagtagagatgaaaaacctattgtccgctgttctgggatacttcagaacctcaggcagacctggggcctactgtgtttgtgatctgagtccatctgacatggagctccctcaacctcctcccaaggtcctggtgtcaacctgggagtcaccaccaagccgaaccctctccgccaccccactataccagaattagaaatcaggctgggcgtggtggtttatgcctgtaatcccagcactttggggaggccaagacaggcggatcacctgaggttaggagttcaagaccagcctggccaacatggcgaaaccctgtctctactaaaaatagaaaaattatctgggcgtggtggcagacaccagtaatcctagctacttgggaggctgaggcaggagaattgtttgaacccaggaggtggaggcttcagtgagccaagatcatgccactgcactccagcctgagcaacagagcgaggcctcatctgaaaaaaaaaaaaaaacaaaaaaaaaccctgtaatcccagcactttgggaggccaaggcgggcagatcacgaggtcaggagtttgagaccagcctgaccaacatggcaaaaccgcctctactaaaaatacaaaaattagccgggcatagtggcaggcacctgtaatcccagctactcaggaggctgaggcaggagaatggcgtgaacccgggaggtggaggttgcagtgagccgagatcgtgccactgcactccagcttgggcgacacagcaagactccatctcaaaaaaaagaaaaaaaaaagaaattagcagtgcacatcataagatactaacaaagtactatctctttaatgcatatctgaattttgaattggatggatggtgtcctgttctgaatgttaaaattcagaacttccaaatatggacttatttcttctagtgataataactagcattcattgtgcttttgccatgtgcagggacctgtgattagtattttttcatatattagccgataacaaattctgtgaggtcagtacaattatctgccttttaccaacaaggaaactgagacttaaggaggctaagtgggctgctccatgttattgggtcaatgggaacagagatctgggagtggaaaccaggctgcctgcctgccaatcctgtgctcctactcattccgggccacatctggggagctaaatgttgttggggtagtgtgcaggggaaagctttgtatatggagaggagtgtctgaaccccctctccgagtttccttggtgttcagacttttccattcctccatcctgggtcctgctttcccacaggaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacggtgggtgggtgcccttggctccaaaccccccttcctagcaatacttcgctgtaacctttgtccagtgttatgaccctgggcatgggaagccagagatcttatggcacccagagggtgttgggagcctgaagagaagtaggagcaaccatgagctccatgacagatggtaaggattgggactctacacagtaaggggtcagaatccgggccagataagtaaaccacaggggtggagtggggtgacagtgcctgagactctctggatggacaggactgaatggaaagaagctgtacaggatggacctggatcctgaggcagcttaacttcgtaaagttgacccctcaccattcaatgcccctccaaggggctcccagttttcatcctctgcacctgaagcttgtcatggtagatggggctcaggccagacagccaggcttttgcaactgtttggcttttcctaaggatgggccatcttcactcctcccttcccttgtcttcatccccagaatatcttaaacatctccaatggcaactactaccccattatggtgacacagctgaccctcgaggttctgcacctgtccctcgtggtggggcaggtttccaacaaccttctcctacacattggccctttggccagtgaacaggtgactcccctctccctggccagccctgcccactggtgtgtggatgtgtggtagtgggaaaggggcagctggagttggggctaaccctgtgcccatttggttgacagatgttttacgcagtagctaccaagatacgggatgaaaacacatagtgagtaccccttgatctcttctcccctagccacttgcctggcttagggacccaattaatacccaccagctttcctgattgcttagcaaattcttcagccagcatctggcctgccctcccatggccgagaatgtaataagcaagggttcagggtccccagcctctgcttgtttggaccttgattagaatgaaaaacaggctggaatttggttaatctttacaatatgtgaccttgggctcttcagcctgcattgctgaggaagaagaatgttttgtctgtctcctgaatgggggtccagcatgtgcctgggccaagtgagtggaggtcagagtgatagtgcagccatgctgctacactcacctgaagggtgggaaggggtgggagtgacattttgggggcacctgatggaaggaaagagttctgtggggtaaggaaactgggacctgcaggcatcttctgagctgacaggctgctccatgtgacacgtggtcccacgttctcttttcttctctctcagcaaaatctgtacctggctggaaatcaaagtccaccatgtgcttttgcacatccagtaagtagagcttggagctctggtatccctgctctcacttctgacttcattctcactcagctacacctcatgggcagagagtcttccaagctgaccccatgaatctttgttggctcttgggaatagcaagtctagccccttttctgagtctcaccttgcctataagttattaggggcaacaggcatagggctgtctggaagctgctggaaaacaggtggggcagctgtcccaggtaccttggcagagtggggagccagagggaagggcaaatgagggagctccccgctccccacccccagacagtataatggggccagagctttccttttcctcccagccatggcaacaaggcctgcttcctctccaggggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactgagcacctggtcagtctgaagggggcatttcaccccagctccatcagggctggctgtcccgtctgaatgtggagagagctgtagttttatctggcttttaaaacatggacctgccggctgggcgcagtggcttacacctgtaatcccagtactttgggaggccgaagtgggtggatcacttgagggcaggagttcgtgaccagcctggtcaacatggtgaaaccttgtctctactaaaaatacaaaaattagctgggtgtggtggcatgcgcctgtaatcccagctactcgggaggctgaggcagcagaatcacttgaaaccggaaggcagaggttgcagtgagccaagatcgtgcaactgcactccagcctgggcaaaagagcaaaactttgtctcaaaaaaagactcttttcaagttttctaccctctgataagaaaatttggggatatccagtgccatctccaaggactttcaggggatcatagatgcttttctgtgcctatctgctttgaccatgtgaaaaagtgatagtctgcttctctctggtaacttgtctgccacccatctgatagtaagattagccaaggccctttagccctctgtcctttctggttattgactgtccctggttcctaggaagacagagttgttctccagctaaagcgtctcctctctataaagtagttttactattcttttcatagcaggagccaaaatagtagaggaggggagagaggcacctggcactctgcgggcctgcacaggaaaaacagagccaaagacagaatcattgtataagatatttattaaaggagagcctctaagtccacatcctgagcccatgtgagtggacacaggtaggtaaaacggtgggtccagctgctgtcatctgaaagccttcaggagatgaagctatcagtatccagctgaaggctgctgggttctgttccaccaccaccttagcaccagggccctctctggtcccagaggcctcatctctccttgggctttgacaatgtggagcagcacatcagcagggactggtctagaccctccctttcctgtcacttagctggagctaagctccagataacccctaggttcccactggctcctagtagaaatagtttctgtactttagcagaacaggaaggatatttgttcattaaaggtggcttggtcttacagctgggtgcagtggtatatacctgtagtcccagctactcaggaagctgaggtgagaggatctctagagcccaggaattcaagtttaacatgagcagcaacattagcaagaccccgtttaaaaaaaaaaaaagagctgggcgtaatggcgcacacctgtaatcccacctactcaggaggctgaggcaggagaatcacttgaacccgggaggcagaggttgcagtgagccaagatcgcaccactgcactccagcctgggcaacaagggcgagactctgtctcaaaaaaaaaaaaaaaaaagatggctgtctctttatcattcagacagaacgatgaacacaggtgagcagggaaagctaattttgaagtaggatgcatggagagggagaagtggtgacagaacttggtaactagctggctgggggaacgaggggaaggaaggagactgctgtctccaagctgaggtcagggtggtgttggcaagagcgcaaaagtccagggaagccaggctggagctgctgtgtatagactgccaaatgtgaagtatttatattgtattcaataaactatacttaagagtgttcaaaaaagtctcctgggagtgggaagggagctagtggatactccctatttcacaaacttttctttttttttttttttgagacagtttcgctctgttacccaggctagagtgcaatggcatgatcttggcacagtgcaacctctgcctcctgtgttcaagtgattctcgtgcctcagactccctgagtagttggggttacagacatgcaccaccacaccaaattaatttttgtatttttagtagagacagtgttttatcatgttagccaggctggtctcaaactcctggcctcaagcgatctgcccgcctcggcctcccagagtgctgggattacaggcatgagccactgcacctggcagaaactgtttccttaatgttctaacgggcagcaaggtttcttccccaggcctctgagccactgatgacatatcctgcccttctgttttccgtgagattgctcacaggacctcactctccctcttgctcccattgtgtatctctaaagtctcttccaattttactattcctgttctgtgccaccaccatcccgttatcttccccagctgctctcatcaggaaatttcgtgggttgcactgaaacggccccttcagaccaaaggcaatgctatgtaggctaaaatgaaatacgcagctgatgcctcggacggggcttgtgattgaggtgactgaggcagcctttctcagcatggaggaagaaaggctttcccagggcttgcaccttcctgaagtctaacacccagggcccccagccctacccactccttcaccttgggctggtgaacctctgggttgtctctgctagatggagaggctgagagccaggaagggagagggctgtgggttttagaaggcaagactccctccccttcccagggtcaggtgtcatgttcctgaggctatagcctccgtttcctccaagctctttcgctccatccctgcctccattgtccatttgacagctgagtgcccactgtaggccagccattgcactgggcttggaggtggggagcatcactgcctgccaccactttctgctgctgcaggcctgctctgatgtgatgcgacccctccttccccaggctatatctcagtaagcatgggcttgggggaatgggtgatggctccagtgacagtcataaactgaagccccccacagacttatcactgctgaatgagggcaggtagtgatagtagtaggagttgcatacttgggggggacccaagacccagttctcccattggctttgcctagagaagcataaacttgccttccactctctttccaccctctccatccccttcgtgagtcctcctgccctcttcctctcatccctgtctcataaagctgtccggtcccgtgattcttcccaggaaaaaaattacattttattcctggcagcctcctcttctagagtgg

SEQ ID NO: 971 - DNA, 4385 bp, Homo sapiens
gggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaa

SEQ ID NO: 972 - protein, 967 aa, Homo sapiens
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 973 - DNA, 44090 bp, Mus musculus
  misc_feature (1)...(44090): n = A,T,C or G
gcataaaatacttaaaactttacttatgtgtgtatataaattttagtaacaaaagtttatcatgaaggtagagctgaaatactgtcatgattggcaattgaatataatgtaaaagttgctacatttcatgattttttttgtaagaaagacctcagttgatccaaactcatgaacactcacactgcacttcctttctgtgtgacgcactttactcttgttctgaacattctggaagagaattgagggtcacagtgagaacagatccgttcactcttggcaggaagcagtacgctggcttgaggcttttaactttgttcggaacggttatcttcaacaataatagatcttgtaggagtcacttccacaaatatgtatcgaaattcaaactggccactccctgggttctgaaagacacgtagatgttattacgctctccggagcttcctggaccccaatgaccctgagtgaccctatggtctgaggctggcatacctcttccacttctgcatgtaccgttccttgcttccctggttcagagccctcaatgtagaatttcacacggatgcgctttagcccattgtttacatattcagaaaaactgtagagaaaatacaatgttgcacatccaaattccctgtactcagagattaccctagagttcccccggggacaccgcattaccggacatgctgtctccgcccacgtctcgacatttccccgtagcctttcaaaggctcaccaaatacaccaatcacctgcagaatagagactacacttatttagtgtgattcttttcatggctcctatgtaagtattttctgatggtcaagtgacattatttgtttacatatggcaagtgattttaggagagaaaaataatctgtgagggcccttgactcaaacaagaaaactagagaaagggcattatgcgaaaataaatatgtcacacacagggacagagatgggtcaccctgtcactggtagctttacaatgatacaggatgagcggaggctctctccttgacaagaaacaattaagcagaagtttgaatgtatttctctattgacactcatactgagaagataaaatggatgggcaatagtaatgacattgttaaaataaaccaggtgcaaatcttttatgagaaaatccatttgacgtagaaactgttttgaattttcaaagcaaatacttttcttaaaaacatacatacaactaaataccatgttttgtctttttgctgagtgtctttattatgagaaagaaagttgtcagatatctaagacctaagagctaaaagaaaggaataagcaaaaaaataggtccatcctagcagtgccagattacctatttattgtaaggcaggcagttggcctggcaaaaagtgggacctgtaaaagtatgacaaaacatacctgtttatggaacagctaggaagctgactctagcaatattctattctttcatgtattttgtgcagttctatttgtctcaatgtgaaaatgcctgagagcccgagcctgtgattaccattgcatccaaacacagttgggatgcctactgaggaccacatagaatcccctgaattctgtatacaatatagtgccctaagtgtagtctctgccaactttcaactctcttggcgacattctggtttaggatagttttgtaggaaggatgcctgagacctgatgatgcaggtgcacttaacaccactgaaaagtgtatgtatgacacagtgccagggtcaaagtgcatcaaagaatgagacctgaaaacagaaaaacagctcagcatgggcttcagaagggatgcacacctccttcccaatacaatcatcagaaaactaacctcagggtgtgttctgcattttcctaaggctttcccatatatgatattagggctggacgaaaaaaacagttctttgaagatcgcgtataacaagccgcctgaaaaagcagaaagaggtagagagagcgagcaatgaagtgaagcactggggtgagaggctatgtaaaggcattcatgtgcttgctgggtctgtaacctgtaaggccgactccaaagagcaccactatcaagtagctgacgtctctcccagcttctctcactgcaaagagaaaatatcaacaggttacaagtgtgtccacagaaccctggccttcgggggcttcaggtgttcctagcaggtgacttgtgacagtgggtcctgatccagtgtgtaccattctcagtagcttatctcaaatgctcctgagcttcagaaaaactcctcacccaggcatagcttactagaccagaaaagaacagacctgtttagtgtgtgtggcatggttgtccacagggcttagggatctctggatttctgtaactgatggatattgcttctgttatagtaacagaaaacccctatcagtctctcagagtaagaatggccacagatgaggccatgtacacaggtctatcctgtccagactgagacaggcaactcttaacccgccccacagaccccactgactcgtgcacaaatcaaagaactgagcttggaatcgaaatgttggctaggaagatcaatgaatcaaatatactactacaaagactgttcttattctgcactaagtgtatgaacatggattaaagaatagtttggggagataagataataagaggtgtaggtagagacattatttacataaatgcatgttatatgtgaaaattatatcgtcaccagtacactatcactgattatgagtgcactttacctctttggtaaaattttatacacatggacagtcacatgaggaacccaggttattctaatttcagtccttaattttatctttcctagaaatcaaagtttagcagtggtatatttttccctactttcatagatacaatgaaagaatggaatataataaaatcaaagtaggttaccataacatactttcagttttcagtacaagttgctaactggaaatgagtttaggggactcagtagtatttgctgctctagcagacatccagaattcagttttcagcaactccatctgatggctcacaactgccagtacctttagcttcaggggatctaacaacttttttctggcttccttcactagtactcatgtacacactgatacacacacacacacacacacacacactcaccccccccccacataataacaataaatagatatttaaggaagaaaacactaattcaaataacagaaagatttccatccctaaaaattgtgtaatttatgtgactgaacttcacaaatccaatctctttaccaggctttgaggccgagggctgcaacaccaatctattccattgtcctttaatgtcataaactacgtgtcactacggagactacgtgtcgctacgtggacactgcacgaggtcccaaattgagagcacaataacaattagactacataactatattggtggtgctttccaaatcatgtcattggcctggacaacccaagtccctattccctccaacactctgtcctgacctaatattttcacaaaaagatccccattccttgtgttcctgcagttctccgcctctggtgcaggcactcaggagtggggagcatcaagagctagccgacagtctgaagttctagatcctttttgtttgtttttacctttctgagacattgagacgccggtttcctctctttgatttctgcgaatagacacttgcttggtactatcctcctttgctttccgggggtccggtccttgtgtccagaaagttttctgggtgaacctaaggacagttctaggttgtactgttatcttctgctctcgcagcccccatctcaaaggctgagttttaaagcaagctttggtgaacacaaaatgtggcaacaactgcctgcccaaggacccgtgcagcttctccgcatgctgtacaactcgtagaaaagcacaaatcatgtttacaaaaactcaggcttcaggaccgcaacttctaaaggtttgtaatccacacactcaggcggatattaagcattgtgttaggcggatatcaagatgaaaataatctataagagatgttaggtaccacttttcttattcctctcttgaattaaaatgccctatttaaccgtcttgcggacactcacaaagtggccgccatgctttcgcaaagcatcccgggaaacaacagacgtgctgggtatcgcagtttaagtgcttcacactttcctgcataactacagagaaggaagggaggagagactacatctcccacaatgccacgcaacagggaagcacccactctatttccctaagacgcttctgcgccgatcgctgcgcgtgcgctgtgtccaggatgaagagggcgtgttatttgtatccctggttctataatggcctcgtggcttaaacagaacttgcaaaatcgggcaactgagtgttctcatggcctttctaaagaggactgttgtcaactgagaagttcatgtggcttttgccataactataaaaatgacaatttcagcgtttccgtttcttctcaggaaaacagctaacaaacgtagttgaacagggccacaaaaggctaacggaccaagaaccggcgtcagaatgaccgaggcttgggaaaggagccgggctgagatagtcccgaatgtccttccagcagcaagggccgaggtgttcgcagagcaactcagtcaacgcatgcgcgatcccggtcgtggttctgcgcatgcgtgtggggcagtggcgctgcgcttttctgtccggccgctaggtgtctttgggtctccatggcgagcggacgcggtcggatgctgaggggatgttttggcctccaggcgcagcgagggtcacttcatggtgggggcgctacctggggcagcgcgggacaggccgcggggcgctccgggttcaggtgacgctccgggctcgcgtgtgggtctcttcagtatcccaccccaccgctctttctaggatgtcggacctattctggcatgtgactcctactttttaacacgggaaacaccttaagaatggcaaagggaaacttctacatcttggacactagggtatctcaagttaggacacaaagttacttcttcctaaggaagtgatgtgtattactaagcattccattcattcattggtaggtcctatgggaaggcgatttccagtccctgggggaccccagcagcacacatgtaaagacagacgtaaacctactgctcccaccggcacaaggctctcatgtagcattcttgcattttagtgatttttaaaatgagaatcacccttttaaaatctggagtaggatgtatccatccacacctaatgctaaccaggacattttgtgcacctttccggagcactaagccaagttgttttctagatggtcacatcttgatatccaactctagtttgctgtgttcctaataagtgtaaggaccctcagagtgacttcttttctcaatgttttccatttatctcaaggatgcctttaagccaaagtatggtcctcacttgcaataacacaacgagagaacagaatttaggacatgggaaaagggcctctcttgaagaaccttcattcacccaaataagtactttacaaaatgtaatgtttgtgattgtttagagcactgtatccatcacctgagtcaggtcaccagagctggaggaatagtgctaagaacttactcttttttttttttttttttttgaggtaaggtctatgtagccctggctgtgtcttggaacttactatgtagactaggttagccttgaactacctgcctctgccttgttattgctgggattaaagggttgtgacaccaaccctaccctgcaagaatttatacatccccgaggattttcatttcattgctaaggcttcttgacttatggatgtaaccgtcatgtacattttgctttctaaggagccaaatgtctttttgtgtaggtgtaaaaaacttgttaacagggtatgtcaactgcttaagctatccctctttcaactaaaagaccctgtcctgcatcctttctaggttaccttgctttcagaaagatggcactttgtgttacagttgttcttgactgagcttttaagacgctggaaaagccttaagacgtgtcacagaatgagaatgggacagcatttgtaaaaggaagagaaagactttttgtgcctttaaatgggaaactttatttcccctctattcctaaaattaccctttagattgtgctttgtagaacaagatgagcttatgtctctgttcctttgtaagtttgaactttctgatagaacaatgtaaatggcacttggcatgatgatgtgggaacctgccagtgaattggtcttgtacagattctgattggtaaaaatgtcagctgctaagactagaatgattgactgtgctttaagaagttattagcctgtctgtggtggcgcacacttttaatcccagcactcgggaggcagaggcaggcagatttctgagttcgaggccagcctggtctacagagtaagttccaggacagccagggctatgcagagaaaccnnnnnnnnnnnnnnnnnnnnatgcagagaaaccctgcccctggggggggggggaggggggatgaagatgtgtttttcagtcatgccaacattaaactggtaaatatttgaaatggtagttagagctccaaagtggttgtaaggacggacagtcctggggatgctccgctgctgttttgggactttaataatagccctaattatctagctggagacatagtgtgtgttctgtgaaatgtgcagaaatcaaaacaaaaaaatgccacaaagtagccatgccatttttagaaaagtattaaaaaacttgtccatagtaaaatatccttgattttcttataaatgtaggatacaatcacttttaaagcatttactacactccctttgcagaatgtcattaagatggatttgaagcataaattggtaaataagctgtagtcaatgttttacttagtcaaacacagatgtatctgtttgaattagtgaaaagaagtttgtaccattttctcttaatggtgccaagaaagtacctacctgcctggtctttaactggttagacagaatcccacaatacacattaatctagagtttttgcgcacatacttccaaaaaaaaggatgactgctcatctcctgagattcttggagccaggctttcataaattcttagcaagtgagttaatcttgtgtgagctgccaggctgctgtgttccatgaaagctgagcatctggtagagttgtgcttcttaggtatgcactcagaagtgggccaaggtcagagacatcatctttcttatgtgtaaaattggggatcgttctttgcttctgatttctttgcgaatggctcaaaacttttctgctatagaaatttttgtttaaacactttaatttgtacagacgtataaaagtatacctgttgcggcagccagcagctcgcaacgtgaacggtttgactgatatggctactcgagctgtaagagaggaatctagacagggcgaaagaagaaacagagctaagacaaattcattctgatcaaagctcaaattttattgttatgaacactagttatgaaggaagggggaggggacccgattcccgccgaataatctctggtccagtagaaaggtgagcacgtgtgtggctccgtgtgtggctccgaacagcaaagcggcaggttccagcagtgggcgtggcagaacgaatgagcaggaagctccacccctgagcaagcaaggtttcaggctgggggaggggagactacatataccataggttttttttttttttttttttttttttttttttgattagagctattcagagtacaaactgcacactggacttcatttgctcaaactagagtgcagaggcctgtgctgccaggcttttcactgtgcatcgtgttaccttccccgctctgggagaatttatccaaccgttcgtgccatgctgcctgccagggtgtggactaatatttatagggagcttcccgtgctccagctgctcagctggttgctaacccagggagagaagccctttgtgctgctgctcagaagacatggggatgttgctttttgggcaaggcagctgggcctgtgaagggtgtggtgataagtgatacatattttggtgtactgtcttggcagaaggtaataggctacattgctgcctggtcaatccaggccttgggtaaggccccccctcccctttttttcctgcttgtgtcttccaatagtaggctgtgcttggagatgaattggcatctttaatggttgcatttggtatagattttgtatgtcagctcccagagagttcattaattagttttccattgagatttttaggacagctcacttttgcttctaattacatccttttttttctttttctttctttctttctttctttctttctttctttctttctttctttctttctttcttttttcttgatgttaacttgggaactaagttatcctgagggtggtaaaacattggtgaatgaagattgggtaataaatactttatattgcagggtatggggggttgtgtcagtagatgatgtatataagttgtacactgctcaaagaagtaaagtctagtaggttttctctgctgagaaaaaagccaaatcaggacaaattaaaaatataaagtcagggggagggtatgggggacttttgggatagcattggaaatgtaattgaggaaaatacgtaataaaaatattaaaaattaaaaaaaatataaaggctagcattaaaatataaagtcagttttatttggggaacagctcctagaggtggagtggagtgggttgagggggttcaccagtctcaggaaatgaggtcagaggaatcatcaggcagagagggagagagggagagagggggggatgggatggccggcaggcactgctcacagctggtacacctgccagtgaatgcacctgtatattatcagggttagggctaggggtcccaggtttgaagcctatcagcttttctaaacattgccaagaaaagtagaacattcactgggagggcttattggggctgggtcataaaagtgggacctgtgggctatgatttcccatagtctgagcaccacttgttttgaggactgaccctaatacagagttgttttgatctgctctataaatctgttaattataaaatgcattattttatgtaccattaaagacagccaattaaaatataatttatttgagtataagatgctaaaatgtgggaaaactttggatataggtacttttgtgcataacatagatggaagttactaaattaaaaatctatggtttctaccttcattacctttctattatattattggaactggccactcaatatatctgttataattaaattagatttaattgtcagtttgacacagcctagatcagattgccataagggcatgtctgtgagtgaccgtcttgactttcttcaagaggtcccagtccactgtgggcagctccataggaaggtgatcctgggctctagctcaacacgagccagcgagcgagtcagcaaacatcattgctccatggactctgctcctcaagctcctcataggtttctgctctctctgaactgttttctcctaaattgtctttggtcccagcaagagagtgaactagaaagcctgtgtgtcactttactttgtttctctcacatacactgtggaatacctaccctctgacaggacgacagcctaacaatgagaacagtattagacggcaacccgcagactttaggcttatacgtactacacaggtcatttggaccttctttcctttccttttcccttctctttattttcagagatgaagttttttgttgaataatatttacagtttattggtctttcagaatcttggagaagggaagaataatttgcctcattttgtaactttaatttctcccttttagttttagaagtaagtttgttagaggctcatctgtcacgaagcagcatgcctggcgaaaccagcacagcgagaaagcgttgctcttcctccatcagttctatatccctggacaggtaaataacctgcttctcatggagtggtgggctttaggcattgggttttctgaggagattatagtggagcatatataccaagttgctattttgagcttcctaagaataggattgcgtaggaagaatgtacaacacagagtttgacatgagtcatgagcttgtcaccattatcccgagacggaacttctaaaggtgacaagtatgttgcattttccatttattaagttgtgcttgctaattactcacttcccagtagacttggtggaatccttctgaagatgaacaggtctgtggggccttacagttcagtaatttggaactctgtcactgtgagttctctactttagaaccgaaatccatagaattttctttattgtgaactgatgctaagatgcctatagatgggtgttgtgataccatttgtggggcatagtcagcatcctctgagtcttgccacatcagtctttttcatgaagagacattttaccctaggatgcatacggtgtcccccatcctccagttcctgtatttcagcagagggtaacacatgctcatgatggaggcactgaagctctgcctgttgatccattgtgggcagatgtggttgacatgcagagagagccagttctctatgccttttgctctcttaattggtctatgcaatgagaactgtaataaacagaaaattacaatcaagaagttaatcgaggatgagagaacagtttgcctattaaatgagtatgtctgatgccctctctttaggatgcgtagccagttgtattctgggtatttgtagactcagtactggttaacttgtttcatttttctcccccggtctcagaatgccatcggaaatcttggtgaagatactttcttacttggatgcggtgaccttggtgtgcattggatgtgtgagcagacgcttttatcatttggctgatgacaagtaaggagaatactgtgtcatctattgtatgtgaaaatgagtaggcatttttagccattttctaaaaagtaacagaattaattttagtactatttttagacaaatttgcatttatgaatgtaagataaagaatattctttgcatgtactaaagataaagcctattactattggactctagagtaaaactgtagtctgtgatcaggtgtcctgggcttgatagactcatccattcacagagcctttcaccaagtcctggttttctgggcacatggcctgttctctgcagatcatagagaagtggtaaagggggacccttgccaaaaatttctcaatcacttagaaaaatgtaaatcctatttgtgaatttgtgaagattcagtgctttgaaagattgtatcttagtgctaggatctgtttcttcaggtcatagtaatgggtaattaccatgcaattgctatgttagttacatagtaattaaaccagtatgggaccggtttaatgcatttctgatgctccctgtttgctttaaatgaggaacccacagtaaatcctctgacctcactgaggctgtcctactgtcctcaccatccagaaagcatgtgtgccttctctgattaggaagggtttgaactgaaaagtaatatcgctgctatagcctccacactgatgtgttctacctttttcttacagtcttatttgggtcaggaagtacgcagctgcatttagatcaaaaagatcacgttggaaagctacttcagtggaggaaacagccacaagtctgagcttgctgtcagtttgggataaagaagatggatactggaagaaagaatatattacaaagcagatctcatctgtgaaagcagccctcaccaacagcctcagtcctgtcaaacgccgcacaagccttccttcgaaaaccaaagagtccctcaggtgtgtaggttcctcttgaacactcacctcagtggctcttggacagaaccacaaaatcgtccagtctctaaccagatgttgtcatctcaaggtgtatgcagagagggcgcaggtttttttttttatttttttattttattttatttttttatttatttattgttatatctatgtacactgtagctgtcttcagatgcaccagaagagggcatcagatctcattatggatggttgtgagccaccatgtggttgctgggatttgaactcaggaccttcggaagagtagtcggtgctcttaaccactgagccatctctccagcccaggtttttttttttaaaatcagttttgctggtctaaggactgaaactaggaccttacatatggataccataagctacactcctagactacaggaacagtttagatcagagggaactgtctttgatagttctttattgtgtgtgttttggtgtcttccatgatcttgagtaaagccagagtgttgaagtgccatcatgtcagaacatcacagatctttagggagagtttcctgggaggagggaaggtttagaaagtgctgtgggtaaaatgaaaatgtgtcagagataggctgaggattttgactgtattatgggaatgatgtgtgaagttgctgttatgtgttgtcaagttttcagcttttcttttctttctctagaatatctggcttaggttggacaatcatcttaagagaagccagtggcaaagaacacatcatgcagcattcgaatctttccgtaaatgacaactctgtcactgttttttggcatgacaaaaattggccacatgtagacacgttgtccaccctggatttgtatggtgccacaccaatttttatggagcagtataaaggccctaacacaagttggtaagttctgattgagcagcttgttggtgaggattcctggaaccccaatattaggtggtgtattattaatttgattgtatcctagagatcttcctgtcctgcattgttccagaagattctgggtgtgtcacacgtagctctaaatttcttgaaacttataacagtaatactgatactctatgttaaaactttgttagatgatttgtggattttctacctatttctacaaataaccagtgatatataagctgggcacggtggcgcatgcctttaaacccagcactcagaaggcagaggcacgggggccagcctggtctacagagtgagttgcaggccatccagggctacacagagaaaccttgtcttgaaaaaaaaaaaaacccaaaaaacaccaaaaaaccactccccagtgacataattatgatattcttggtgctggagaggtgactcagaggttaagagtatcatctgctcttccagacattctgagttcaattcccagcaaccagatggtggctcacaaccacctatgtttctctcttctggcttgcaggcatacatgcaggcagaatgctgtatacataataaatcttttttaaaaattagcatattcttaattatacactagttatagtacttcctaaatacaactatcagttattttttgtggttattttcccagactagataactaagtatattttgaccgttgatttttatttgggtataaaatatatctgaaatttgtatatgaaatgatgaacaccaaggtttcctactatagttgtgtacagtaggagaaaccaaaatgtactgttttgacaggatggtattttattggtgtgtcatgactatagtttatagatacaggcacaggttagttaacattcattaaacgatcttgaaacgatgtgttgtgttgaaatgtagaactcacttaaagtgtgtgtgtccccagaaattgccacaagggaatacgcgatacaacatggtaatggaaaactgcaacactgagggaaattcatacagtgtaactaacttatttccatttaagctctgaggagcagcctttgaccagcagtgataaacagactgcagtctgggccgtggctttcatcctgaggaaagtccctcacctgtatctttgttatggacaggagaagcttacttaagcccatacttaagcatgtaattgtttcttctgcagaagtgctcatggtgtttgcagataatttcccagtaactttttgtgactttgtatgctcagctgcatttctggcatattattagttcatgtactccacactgtccatgtttgtgaggaccgttattttctgcctcaggctatggctgtagggtacgtgtccccagagcctgtttaatattgccatagccaacagaagaatgtttttacagctttggtaaattgacaatgacgtgaagaggtctacctagttgcttctttctttgttagccacaacagtgaaggtgactgccggccactgagtatctgttagatgtgctctcatggagtttgagcgggcatcctcatatgttgggacccagtctcggatggttgtaaagtcattttcagttggagctatggtttcctgttgggttttcttgagactatacttgttccattaattggtcatgtgttcatcgtctcccaggcatgtcctgtagatgctgagtttatttttagttaatatgtcacaaacttctcaccagccagctctgtcaccttgccactgtcagcataagttccttatgactggttctgaggatcctgtgacaggagagctgcagtgtcttaggtggcccctctgggttttacttggcaactgtagacttatcacccagagtaaactctggatccagtgtccttgcacctgagggacttgggctctgaggtgaccacaggtctcatctcctttctcctttcctgagcaatctctgcatgtgttgtctgccatgctatttctagataatgtgtgccctctctgtatggcttcactcaagtcttcccggaacacagtgaaagtatctcttccacagtatttactcttgggcatgaaaacactcctgattttgacttaattatcttctaatatttccagttctcactgtctctcagctttacattacaaacaactttgaaagaaaggcacatttgctctcagaggaaggggaagaaaaacagggttataaattttgtgtttgtagaatttatagtcatcccacttggtttggacattttagtgtgtataaattggtcttcagaagcacttttagttatgctaatgtgacttgacaacaagacatattgggaagttcacatctttctcttctctcttggcatgctgttcaaagtccacgatggctgtctttaattgaaaagtacgatctgagtaatttacgcaagtctgctatgattggctgcgacagacatgttcgggtattctgtgtaaatcctggcctcctggtggggctgtggcaggtaagatggagttcatacatggactgtcatttcccattcacagtcccatgcttgcaccctgcatatcagactgaatgtagactcctggaacagttcagtagctgtgtctatgtgtgtctattgagttgttgtgttctctgctaatgtggatggcaggcatgcagtgtcttcagcaataggtatttactttcaacattggagagtcaaccaaaaggaacagcaatagtctctgttttgggagtcacttagacttagaccctgaccagccattcaaaagaaggttatattttggaaaggacagcagggcagtgtggtgtacatctgcatccacatttagcactgtggctttggctcttggcttttcacagaatggttgagagtagtagtgtacccgtatgcacagccactattttctgcagcagcatctttttgtcctttgtagcatatggtagtcatttctttccttttttactctctgcatgtgtgacttgagggtgaagcagcactggttcattcttgccggtctgatttgcttggagagtagcaccttcaggtttaccattcagggatggctatggctgtcagcatcagttccctacaatcacatttctgccatttaatcctgtggccaaattgaagaagcaaaagtctagtcattcccaccgtatcttccaaaccatgcagtgatctgcaaagtaaatattgtgatctctgtggctgtgagaacccccaggatcaaacagtacatcattgaggaaagtcagggcaggaagccaggtcacctgcaactcgatggcaggaactgtggaggaaggctgcgtgttgctcagctagctagcatagactgtccagaacctcaagtcaaggaatgctagaccttcctatgtcaattaccgatcaagaaaattccccagagacaggctctcaggccagtcagatccaggcagtctctccgttgggagctattgagttaatagctgaacctaactaagggaaactttatctcgtaatgctcagtgtttgtaaaacttaccagacatctgtagggtccacatctttcaaaaaaggtgagatagcctgaattcatctcccccaacctctctcaagcacacacaaagtacttatgtgtgtgtatacacacacacacacacacacacacacacacattcatataagtatcatggcaatcattgtatagaatagagaattttgctatttcacaagtgctaggacattagttcttcaactgcatattttgcattgtgggtgagtggtccaacatcttatacacagtaatgatgcatgtatctttacgctgggattttcatgatgaacttctgaaaaattaaaatactgatattaaaaattatgttcttttaaattttcaggagaatggtggactagcttttgtcatggcaaatattcattcccatggccttttcgagagaagcataatgggctcagacactatgtatgtatctgtatgtctgtctgtctgtctgggcaggtttcatttttatctatctgtatgtgtggttgggatagagggctagaagggagttccaccttaatattatttctatattcatgaaagtattttatagccagtaggtacaagacaacagatatgatcttaaccattgctaaatagttacattatttataaatatgtatttgcttgatttattctagtttaaggactttattccttataataatattctttgagatcaggggtgatctcttctgttagcatggtgccattctcccttcattcatatttcatgtgaagttttgaactttgaaaagtgcagacctctgactctgttccagtgggtgtcttctaatatattagcatgtttttaggctccctacagcttttccctttgtccttggcccctgccttatttttgttaacatctgaaaagctcctggatggttctttccaagtatgttgccttccatggtgaggcctaccttactgaaacaatttattgggcttctttatttttacttgtttaccttatatcccaatcattgtcccctcccaatcacttcctcccacagttatttcccccatctcccttccccttcttctctgaggaggtgggggtccccatgagttcccctgctctggcactgaggccagacaaggcagcccagctagaagaacatatcccagatacaggcaacagctttcgggacagcttcccccagacagacccacatgaagaccaatcagcacatttgctacacatgtgcagggaggcctgggtccagtctgtgcatactcatacagtcagattggtggctcagtccccgagatgttcaagtgtcaaggttagttgactctgtcttcctgtggagttcttatcccctcgggggcccctcacccctttaactggagtttttttgctgagtctctgccctgtagatttgcgttgattcatcttttcctgggcaactgaagacagagtgttctttgtagagaactactgtctcagtcaatctcatagtcactgtggtggtctttggttgcccatggaactctgcctatgtcccagtttttgtccaagttggtgagggattcctatagcatgttatttgtgggaagtagtgtttttggatagataagttttagtagtattttctagccaaatattttatctgtggttttgacagatttgtacactttttttttttctttcagtccctatacattgcctcccgacactacatttgtggataactacccagactcaatgaccttttatggagataaaggctttcagctgcatatcgacattcatggcagtaagacttacttcctgtgtagcaccttccacaatctcttctgcaggagaggtaaacctaagtcaacttgttcccttctgaagttagtgggttgtagagaagagaaagtataatccaggttaagaattctccttccagtttataatctgccagccctgctctgttccctgacccttctctttgcatgaggcttgtgaagtacagacagcctctcactctctctgtaacctctagagggaggcttggctcatcttttctgatatttacttccaaatctccccttctatttccaggaattttgtaaatgtggtcacagggtgaatgtcacaactaggatctagtttttctcgtttgcagtgcctcagagtttgccatttgccacgttttcgaaactagggctgggaaaacgcagaatgcacgacctgccctgtgctttgggagagtgtttcatgatttcttaacgcctagggtatgtctgcttgagtgcaagtttaacattgttggtgagtgtattttatagggaaaatgtaacttcattttgcatcattatgagatgctatgtcaggtggtcctgtcagtagcactagatctcctcgtttggctaggagggttattgtacttcctcactgctaaggcatgatttttctaaagtgattgccataatcctcttccaccaggtgggcttgattgccactaatgatccgtgtccaaatcagactttagatcgatcatctgcaaaagagatacattaactccccctaccccgccccctttttgtatttgcatcccttttatttcattctcttattactgtggctaatacattgagtactatattgagttggagccgagagtgaatgaacatggtagtagtggttagaggttggttccttcatgttgatgtgtgctttgtcgagttatcttttttacttaaaggctgttagtttttgcatctgttgggatgagaataatcattttccctctatgtttgagtccagtttgagtgattgagactggagccttgagaggggctcttctcatatctcagcaagaagaggaatgacttgctgctgaagagggcgatgctgcagtttaatgacaatgctaggccacagcaagcagggtggcaagggtttcaggagcattctatggagaaaaattctgccttccaggcaggcccccaaataccatcaaacttgcttctcaggcagccttgcaggtccagtgcagccactctggttgtgccctggctttctcattttccattttcttaaagcctacagatgggtagagcccattaactgcttcatatgtcttgctctttggagggaggcagccccacagactgcccgactgtctgtgcctcattacaagtacagtttcttcatgagctgcatgtagctcctgtgggtctgctacatctcctcactttctcacggcaaggaaaacatcagacatggtttctatttctgattggtcatggtttatacagattactaatcattttgttaaatagccttttaaatttttttccaatcattttgtaacatttgtttctgtaacattaattgaattttgaatttttacagctttataaatgtgatagtattaatacagagaggtccagtattgcctctatacagaatcttatgtttataattcccttttcttatttgtgatacccttatctactgtgtgtgtgtgtgtgtctgtatacatacacatatatgtctggctactgctgattagtcagtcagctaggagataggactgtctgggggaatgaatgctcatgaggaggtacagaggagagggctcccacaagtgcagcatatgtagctttctcattggctatacctgagatgccggattatgctggagttgctagtgatcagatacatttatgggcacttactttagctgctgttcttactcatgacatcatgagagtgttcctgatgtggaatctgcagctattagctaatcactttcttgattccttaaggcattcctaatccttgattccacaaatgtgcacaggtgcacaggtgcagaggtgaagttcccatctgcacttgagcctgcatcatcccagagagagcaagcacgtggctacataaccactggtgtctgtttgcattttaatagtttgcagttagggtttgcctctgtatgagtggaggggggaggggagaggtgtttgttattggtttcctaggtgtgagtctgttgtgctgatatgctacagtagcattcagtctagcttcatacagggtgactaagccctgtcagtaatgaggttgttacaacctgcaggagctggttaatgtggggaaatgtggaattagacagtttcccttttgaagagtcagcagagggagctgttgccatcagagtgcatagcattttcacaagtacggctgtctcttggtatggtgtagtatatttagtaaatttcagctatgtcattgaagtttgagatgacagaactttatccctattgaaaaaaccctttgtccctaccaaggatgaaatgttttatcatcatgtccctagaatttaggtcactcctcatttgtccttagtgagacatgagaaacctgactggacacaaatgagacagcctcagtgaaacagcatggggttaaagcatcaaggccaacttgtcaggtcttgcattaacaaatagtgctggattcaaggatgaatcaggcacaggaatacacaagattcttgaacataggcggtgaggccggggcttgctgaaccaagtacttatacacactgcatgctcagagggtggttcacatagttctctgaatagagtttttatgggggaaaatgaggcaaaggagaatatgaggccgtctcgatgtctagagtagcatgttcagtatttagataataaatgcagcataggggggggatggttaaatttgacataacagcctgagcatggtcatttcatatggccatttctggcattctctctttgagtaacgatcatgtgttcatccacaaatcagctgcaacatttggaatacccttgaaggggttaggatgttgctcagcagagcacttgcctaggataagtccataggctctattttcaccagcacggtggacagctgggagggcaggtaagtgtatgtaaacgaggaagtccttttagaaaaatgcatagagagataggtgcagaacttgggtatgtaaatttaatgatgagttactagaaacttttctatacatgatgtggtccaagctttagataatataatcaaggagccaggacaatttaagaaatatactgttagagccgggcgtggtggtgcatgcctttaatcccagcatttgggaggcagaggcaggtggatttctgagtttgaggccagcttggtctacagagttccaggacagccagggctttgaagagaaaccctgtctcaaaaaaacaaaacaaaacaaaaaaaaacaaaccaaaaaaaaaatatactgttgccatgacatttgaggtccttgtgtgacccttgctactgctctctgctgttccttctgccagaggccgccaccatttctgtcttcctctatccttttctttgtattgtgaattgataacagcaatgagacttctgcttagcataaactagctactgtactcctatcactaaggaagtatggtgtcacagaagagatggaaacccaggggagtgggaaaatgggaaaatatcactatttatcacagttcaaattagtcaagaattatttgaaaccattcagctacatctgataaaccattacttacagaaaaaagtcatcccataagtgtaatgtggcatatctttacatctgggtgtgtcttcatcctgtagagtgtattattttttgaatgttggtatcgaacaggttgtgtagtttgcttaactggcatcaaggagttgcctttgcctatgtagggatacaaacctcagaaagcatctatgctttccattcattctctttggtttgacggttttttccatggagctcactcatgttcctctaaggaacattgtctctctgtgaaggtatcaagtgtgtgtgtgcttgtggagggcagacggcgatgattgtttttatttatattttgagacagggtctctctctctctcattgaacctagtctcatggttggctagactgactggccagataaatcccagcactttgtggaggcattacaagtgcatgctcttcttgttggcatttttctttttggtttttaaagatggattttggggatctggactaaggcactgagccgtttccccaggagcactttctttgagattttcttaagtcatggctatagtaaaagtttatatctctttaaataaatttatgatccctaaacctgcacacaattgacgactatttgtcctcaagagaagtgaggaggtatttgctgtctgaattcaatgagagggtatgagaggaagagccataataatcatagcacaggaaatgtttccagaatacaagaggtgagtttataaaagtatatggtttttgtgtgtgtgtgtgtgtgtgtgtgtgtacaatttgttttttttttttgttaaaaatgcaaatagactgaccagatatgactggtcctaactgagatcattgactcagtaggataattcacagtattctggatattgatgtattagtggatacaatcaacaaagaggaaaggtatatgaggtgaatgaattaagcggaaaccacccggtgcttagcgccttcactgttaccatgtatgcgtgcctcgttcccccagagctgctaaatctgaggtttttactgggacgagtatgggtctgtgtgacctaggtagtactgtgacccagcactactgtatttccagacttctataaggaaacaggtgcaccaacctcacccgcacccgtgttaggcacagtgaacagctgccttaactacatggagagattctcctggactttcagaggctaaagcagacctctgtgagctaacgctgcaggactccaacctgccacattagttcttttcagcacaaactgtccattaacattttgattaggttatggcacagcctggtgaacagaggaaatagttcagttgtgcctttgaagtgtaaattgagattgccaaagggcctgatcagcaatgcagaggataaaggaatgtatacttatttgatcctcatatcaagctaattattaccaattttcagaagcagaaggagaaaggttttgcacagtatggtatgttgtagttttttatcagtattgaggagtagttagggaaagaagagagaagagagaagtgattttaattagcaaagcgcactgtcccagcctttgatttttaagaaagtatgcttcactttttagagcattttttaaggtctgtaataaaactgagaaggtaatacagaactaccccacaccataagctacagctgatgaccacacatcaacatattattgcccaaagatatcagtagcatcagtagattgctccggtaaacttctcagagcagcctgtacacagcagcctgtacacagcagcctgtacacagcagcctgtacacagcagcctgtacacagcagcctgtacacagcagcctgtacacagcagcctgtacacagcagcctgtacacagcagcctgtacaggaccttggccacagtggacaatgaagaggagctgaggtcctccatgttgtccctccatgcgtgtgatagattctgagtgaggatagttgtctacccactcctgagcccagcaggctctaatgcttagttggaaatctatagagacatgtttggtcctggtggataacaaaacaaagacacaaggatgaagaggagatgggatctgagagggaaatatgaggaggatgatggtgagaataatgtactatagacatttatggagatgtcggagaataaacatagtcaaggaaattgcccaactgtcttccagaatggctgtagcactttgaatctccatagacaacaagtgattcttgttgctcaggcctttggcatcattcgggggcgttctttctgcgtgtttgcatcttctgcatggatatcatcagtgagggtacttttagccttagattggatctagtatgctccctgtaatccctatatgttaaaagcgttattaggctgttgatgtagttcatgatgtaaactctaagaaggggatctagtgggaggtcttgcagctactgtagatatgtccttggggtaatcaacagtcctctgtctccctctggccacgaagtgagtagtattgctgtactgtgtgcttctgttaggattcactaccttcccacaggccaactggaaccttcattattagtcaaaaagaatcccttttcttaaaccattggttcacatattagttacattgatagactcagtatgtttaatgtttaatttcttaccgcatcattccagactccagcacagtcctttaagtctgcagagagaagacaccttaccctgtctgtttctcagacctcagtgggaatgctttaactatcactgttagttttccttattggcctattgataaagtagacggttctgagttcaaatcccagcaaccagatggtggctcacagccatctgtaatgacatctgacaccctttgaagacagctacagtcagtgtacatacatataataatnnnnnnnnnnnnnnnnnnnnnnnnnnnnnnnnnnnnnaaaccggttttctactgctcccttgctttactctcatctggaacatttccttttttgtgttgctgttatgaattattaagctctttgggatagtgtttgccttttctacatattagggtttgttaagtatttacacagttattgtgacattctttccattaaacactatgctaagtgtcttgggctttgtctgtaagacaccacagataacttcagagaattcaaagaggttatcaaagttacaagatctcttttattccttgtaccaagagtagactccacaacagctgagagtgaattcttttgaagtgtttttcctttgtagatcttgcgcatatatcatattatcttatttttgtggccatgatcctaaaaataggtaggtttttcgtctcctgtccctgatattaattgcttgctatgtttctaggtcgagttgtcctcagtaagcatttgtcatgccatgtgaggtactggaagcagtggtgtccttcctgggtggtgattatttagaaagcttagagagggcactgcacttatggcgtcttcatcaggagcacatggtacatgtttcctgctctgtacatctaatgagatgtaaactttgcaagtgattggcttctgtgagagcttacccagaggcagagactagctattgagcacagctctttagtttgtatggcctgttgcaaaattactaataaaatcaaaatggcattaagagcattaagtccaggtctttggaactacacaggatgtatcccaaaaagacctggcagccgcacctatgattctgatgcccagcgcctgcttcagctgctggtccagatttaactccagcctttcagctctttctggtgacttgaattctttaaaccctatttgttgtcaaggaaatttgtttcaatatgatattttatatagtaagattttgtaaggcagttatggtaacaggatgtcttatgtaaaacaatttatagactctaagtataaaatttgtaactttctccgggtgtgagtttccttgctgttgatctccagtatgctggacttagagcttctcttgccttggatcacactcttttttttttttttttttttaaagatttatttatttattatatgtaagtacactgtagctgtcttcagatctcgttacagatggttgtgagccaccatgtggttgctgggaattgagagtagtcagtgctcttactcactgagccatctcaccagcccccagagcctttctttcattgctcacgctttctctggatcattggccttcagttagcctctcccccaggactgtgacacagttactatcaggaacctttgagtcagtttctagatgccctttatgttttgaataaggtccagcatctccttctccaacactgacgcccgtgcccccctgagcatcctgcacccccctgccagcacacctttacttgtctgcctcagcttttctgttttgccctttctgtttcagaggaaaagatgtatgtcccacttctttgcaaaatttctgctcctatatatagccactctcgcctgcttgagacctgtatttagccatttgtctcttgtctccttcattgccacaaatcagcttccgtatcggctccccttcttaagaatttatcaagttattttagaagaaaaaatcaacttctgtgccacgtaatttttttagtgttaaaattttttaagttttactaaaagctacaaaccccacaagctaagatagcttgacaaagccatttaatagtgttgaattgttcagaggtggtttgacgcaggcccattgatgtgtctggctggcgtgtttcctgtcctgacttgtcagctttcttccatggctctcacgccctatgtctgaggttccttttacatttctgagagtctcagtccatctccttggtggctgtgcatgacccattgtacaggatcattgattgccaagtgtcatttctcttaccctgcagccccaccatatcgacttgttgcagttgtgaatatgtaaaaataccataagcaggaacagaataggactccaaactacctgtgtagggaaaacttgcccaggaaaatcatactcaggtggactaggctgatatggaattggaccaatgccattgaaaatagaaatgggagaggcagggaaaagctagctggaacccctaatcatagcaagctccacacacttgaaccaatggtaagtacatatgttactccctttaacctgcaattgattgtcctggtgcatgtatgtgtatctttctatgtgggcctagttaataggacagatcacatactgactgacagcaggtttaactgacactgtcacgtcgtcaccgtgccagctggcacagagtgaaggttgtccttttgtgctacacagccttacttgtaacaaaaaggaccaggagggaccattcctgatcctactgtgttccatactagcttaggtatttcttctcttttttgggggtttggaaaatcaaactattttttatttgctaggaagggaaaaaagtctagataaactatgcgtgtgccttgggctgtttacttaacagggagtgaggaacattactgaagaccaagtttgtttgatcattagggcctaactgttactgattgccccttctagtatgtgggtctggtcaacactggttttcaacatgccaactagctttcagttcattgtgtgagaggtgcttactgttactcttggtggttctgtgttcccaagtttggctcgggtggaatctttgggtgagttggtctcttttaccacctctgattcctccctagattccgttctaatctactttgaccttctgcttctgtgtgcattagaaaagtcaattaccagtaaaccaatcctcccacactctttatattccaccttttctatgtcccatttatttctgaagctgaaatgaaccctgattatagctggaaatgtatcattaatatgttaaagtattggttttgacaagaccgatattctaacacaaaaactttgtatgtaatgagatgccagagagtagtcgaggtttagaaatgaaaggcaaaggtagacttccatacaagtagatggtaaagttctgaaagactaaattgttggggcccatcagttatagctggcaagtgtggcaaatatggggtgcagctatgcacagtgtcttctgttctgatttctgagatctgtcagagactcatgtgtctttattgccccccccccacatctgtttcacatttagtgcattgtataaataggctcacagtttgtgctttttgcttctggtcttttcctgtactctggttcttatgctcagtgttatgctctggcttgatccatacagttgcagatgttaatagctcattcttgtgtattgactagtagtgtttaaatataaatatatgaattgccagctttgtttctttccttgatggaaagaatcctaggtttattctattgtgggaccttctaaaacctttagaatttttggggagtcttgttggccttgtctcatcaaccatccatctcatctgagggagagcagaggaggaccagaccgagttttgttactcacatggagaagaaggaagaaggtgggcttcccattcagaagccgctgctatggccagggaggctggagttgactgtgccctccctgaagcagtgtgtcatataggagacacctggggaagccttggtttcatttgaaagtagttagcaattggagacagctgctgggttagtacaatggtcatggtgtttcttcacagccctagatagaaatcctaagacaaaaagagtgtagtgaggatagttctgtttttattggcagctcatatattcattatccacacaatgaaaaggttactaaaggacataattttgtcctattggcatgaatctaaaagcagattgatctttcaggtctttattcctggatacatttggaatacacttgaataaaaactgttcaaatgtgattgttatcaggatggggaaatatagtattagggataggagtgtggcagccatggatggggtggatggctgagggggttctgaggttacaggggagtgtgtgcaggaatacaactagtctgccaagtatagtgatacatgtgtgtgtttgtgtgggtataaaactcaaatccagggggggtgtggagggtatatggggtctttcgggatagcacttgaaatgtaaatgaagaaaatatctaataaaagaaaatgaataaaaaaaaaaccaactcaaatccaaataggggtcccatgaccctaaactgcctgcttcaccatgaaatagctgaagtgcaacccaagaacatttgcgttttccttctacttttgcagaagtgaggtccgcctcactggcatgcagctgtctgactctgcagtcattgtgtacagtgacgacactgcagcattactgtgccgtgcagtcttcttcatggtgtgcgaaataactggcaaggggtgtgtttataggaactgggaggcgttgcaggctctgtttgttaccagacgctttggaaagcatgcaatactttgtgtggtggcaaagttgctagtgcccacctttgggtacattttggactcagactttttggcaaacatttacagggtttttcctcgagcatgggcctttgtgttttataagtcttggttttcagcttggcactgtttgagattttaagaggttgtggtccctacataagaggtgggaatatggggacgccttcaggtcattggggtgcaccctttccaacagtgacagggcatgcatttccttagccatcttctgattcatttctctggaatccacacccattttccaatcaaaggttcatgacataggcctcacgatagaatatcatgtcatcagtgagtagaactttgcagtatgtgacatccctctgggagtagcctgtcctttttctgtcctgtattgaaatgtaataattaaactaacctttcatttcagcgggcattaacaatggatatgtgaagttcttgatgataaacttaaaaaataacagagaacacctacctcttgttggaaaagttggccttgaatggagaactgactgtttaaatggccgtattgaggtaaaaactattttattttttgaagcaactgtttgtataattaaaaaaaatttttgcctgttgatacatagatatataaccctccttaaaagtattgtggcttctgtgaagtgagattttcatcaagtgtttaatattttgccttagtcatggttctactgtgatgaagagacaccataaccaaggcaactcttttaatttggggcttatttataattctagagggttagtccatcaccgtcatggcagaaaagcagacaggtgtagtctctgtctgtatcaatgagcagtatctgagtatgcattcaggtagcaggcacacgggacctaggaggagacaaagacagacagacagagagggaggtactaggtttgataggcttttgaaacctcaaagcccacctccttcaacaaggccaattgtcctaattgttcccaaccagttctaactggggaccaagcacccaagcatctgatcctatggggccattctcattcataccacagcaaacctttgctctccatggaagcatttcctgtaccctccattccctcacacagtcagtctgttccatgaagaaagcagggagccaaaggttgggcccagttcacaggccaagagactgtcttgaatttttttctattttctctgtagcctaggcttaggaatctacatggagctcgacattagtttgattttaatcccgaccatgcaggattagtggtgggctgcatgcaggtggatggttagggcaagaggaacaaggatggcaccagacttcagatacagcttatgttcagtgatgccactccagagcccaaggtgcaatcctatgcagttctgctggggtgatcataggtccgagtaagttgtaccaaacttgattaacctctgggtcatccaaggtgttgagtaagaccttgaatacttaattcctgaaccttgaaggaagttcagcctggaggtatactttgttgtaagtcatggacatctagattattgtatgagttgtggatgtagacaaattccatctagggagagagtgattatatataataataaaactgttgctttaggaccacactattagtagggtctggtggaagttatgggtggttctggaagcactggaaaaggtagtatttgaagcaaagaattataaacagtgctaaaccttccaaggtgaaggaggcctaacaaatattcactgtgcttagagaccttaggaagatgctgggtcagagtgggttgaagtataagcaggaagtaagggaggagagagagctctacctgccaagtgaagagagaacaaggtcactcggaaactctaggagggttgtttctctctgagtgtctgttctccttttccctcacccctcccaacctcttctctcctctcctttcccctccccacctctcctctcccctccccttcccacctctcctctcttctcccttccccttcccacttcttctcctctcccctcccctgcctacctcttctctcccctccccttcccacctcttctctcccctcccctgccaagctctcctgagctcttcccttctcattccctccctctgacaactcctccctcctctctacccaagagttgcattaacatgttggaaagttaagggctggacaaggtgttagaggctacctccttgtctacctccttgtgatagaagcacacataacagagacatgtaaggaaggagctggtgaggacgaacttgtgtgtttggtgttggaaacaggtggccttccttctcaaacttctgagaagtgtatgtgaggtgtaggagcaccctgtgaggaagcaaagggagtcttgggagagatgaggtatgacagttgggagggtgccccacaatgcatagcagactcaaacaaaagacttgaaagcatggttgtggttccctggggatagctccctgtgtggctctactaccatgctggagattttattatggacttgttttgaatacttttctaaaaatgtcatggctactttgtggtgtttttttctgcatttctctcacatttcacagaatatacactatgtctccaactagataattaaagtcccaaagcagcagcagagcatctccaggactgtccgtccttacaaccactttggagctctaattaccatttcaaatatttaccagtttaatgttggcatgactgaaaaacacatcttcatttcttaacactgacatcacattggcacaagccaatctccacttgactggaaagtcactctacattgcttcttaatactcatgtctcattgacacaggccattccactaacaatcgtgagttgagtaaagcccccctgactcatgcaaagctgggtgtgggtagatctggaaccaggtgagatgaaatgttgatgaagagagaagcaggagtgactgagatgaggcccgaggagaactaggggtgctggtaggtcaggggctgtactggctagttttgtgtcaacttggcacagctggagttatcacagagaaaggagcttcagttgaggaaatgcctccatgagatccaactgtaaggcattttctcaattagtgatcaagggggaaaggccccttgtgggtgggaccatctctggactggcagtcttggttctataagcaagccaggggaagcaagccagtaaggaacatccctccatggcctctgcatcaactcctgcttcctgacctgcttgagttccagtcctgacctcctttggtgatgaacagcaatgtggaagtgtaagccaaataaaccctttcctccccaacttgcttcttggtcttgatgtttgtgcaggaatagaaaccctgagtaagacaggggccatggcactctccctccatcaactcactcactcactcactcactcactcactcactcactcttgttatctaaacagaatttactaatgtggcgcttatgcttacagcatataattttctttaacacataggatgcactagtagcaatggcttgctgtgacaaaattctggcgaatctttgtctagtgtgctgggaagtaggagtagctgaggaaggaggaaggtgaagggacaagttagaaagcagggcccacagcccagtgttgacatggcggtgctgtgtctgggggtaaaagtaggaatgagtaacagaggtgaggttgatcatttcaatttgagaatcaatgggccgatgtcatcatgtctcctgggatccctagggtggttgggtcactcaggagatgggtaagggggtgggtgcgtagcagagaaaccatgagcaagggtgggagagctggaagtttagactcaagggaactggttgataagagtggaaggcattgagaaacttctgtccagggctgagtgacaccctcttggaaacaggaacaaaggactctctccagttgcctctaacttcagcaagcgccttggtcttatgcaggggtgaggacacggtaaggactgactgagtagctgtgggataaaatgtagtcacacgatgtgtaggagagggttttggagtgtattatttccagtctgctcaacagtcgcagttcctgtggaattgaacctttaccctgaaatgtgttcatcttctttgtgaattacagagttgcattgtagtggatatgaccttgctggatgaggacaagaagcccatctggtatgtgagttctccagtgtgcttgagatctgcctgccttcctgatttcccgcagccggcttactctttcgagtacatggacagcgtaggaggagtgtgcgcagacctagggtggtttgaaaataccgatgaatacttcattgtcagactggacatttacctcagtgtagcaaaattacaacaatggtttgggaggcaataaatgctgagttagcagtagggagtcttgttattagtaagctgtttgttttttacaactttgtttttattgaaagttaaaataaagcatatttgtggtagtctgtttggtgtcttattttctaatacaaattatggtttgtgactacagtgtttagaagttgacatttttaataaagcatgcctcagtgaagatcaatataaaggtatgcagtaaattaatacagtggctgtttttcttattcctagctaactccccaataacaacacagagagaccaagatttattttcaacttaaagtacgactataagtaggccttataattctaatctagatcgaatcctttaatctaatatggctacctcccagcctaaatcactgagattcttgcatttttaagttagtcttgctctctgggcttcaggtttgctctggaccccttcctcgtgccctcttctcttttcctctttctctccctcctcccctggttggcaggagtcctgccctattccctctattgccttgttgacttttccagcttttattgacaaggcagagaataagtggtgagcattgtttacacaaacatgagacaggagattctgacataaacatcacagtgccaagtcattgaaaccagatagggggatagacaaatcagcactcgaataagacaagggtcaacctctggggtgcatggtatcaaggcaagacaggtgtcggtgtgatgtggagacattagaatgctattgctgggtatgtgacattttgcagccgctaggaatttaagttcctaaactagcattatacaatcttatttctaactatgtattcaaaggagttgaaaccatgatattgaagggacagccacatgctcatgtttattgcagcataggttttagtcatgataaggaattagcctccatgttcatggataaagatacacacacacacacacacacacacacacacacacacacactgaaatatttttggaccttgaaaaaatacatggatgaacttagaagacattatgttgaagtggaaactttagggttctttggaaagtcagttgtgttgggtgtgttgctgggacaaacacatgtgaaggagtgtttcctgaagcagaaacaggagagaggatgctctgctaaagcaagcatgtgaaaggacatgtgatgaaggattctttgctaacgacacacatgtattggtttgccttacattttgtagttggtctatattggttgggactccatgagagagaaatgcatcagaagacttctggtggcgagctatggtttcttgctacttccatggactctgattggcagagtgatgtcagctgagacagacagacatactgaggcaagacacaggctgaggctagacccgtggaggacactgatatttggagggtataaataagactcgacagagagtggcagaggctgagctgggcttgcttatagagctagctgtacaatgcttgttggtcttaactgatctttgcttctctgagagaggcacagtctagagcttctggtgtttctgctggcccctgctgctgactagtgccaaggctgaggcctgtctctgtctactaggtagtgccactattgctgatttctgctcgctatcccaactcaaccaaactggattgatggtgtatctgggaagtgtttctgagtcgatggagctgcagctgccaacctgtgaactgaactgctgatagccagagagcatgggtgggagttgctccaacgaaccatttctgaatgggtccacttcccccatatcctttcttttccaccatctctggtggtgggtaggctacaagggaggttaaaacattgaataatcatcattaaaaataagcgttggggaaaattaaagttaaattatgccaagtgaaataaaccatagatgggcaagttctgtgctgtattattttacctgttaaatgtaaaagatgaaaaccatagacacactagactaatggtcgcctggagctgcagggaggacgaaatgggaacttttctccttttttcaagagcacagagttagagttatgcaagatgaagaggttctagaagtgtattagtgtaacagcctctctgtagtgatactgcgtcaagcactcacagatttgcagagattccatgttaagttcaaaagaaagaagcacttcagtattcccacgtgccagcatttctgatgggatattcagatacattctctctccctctcctggtgcatgcaaatgtgcaggtctgtgtgcctgtgcatatgcagaggccagaggatgacgttgaatatcctctattgtcatctgactattttttctgacaagatcttcactgaagcttgctggttgtccagaaagatcccaagaactctcaattttgtctgggtacagagaggcaggcatcaccatgttggctttttgtgtggtacatagcaagcactcttatccactgagctatctccccaactctcttttactttaaaaatcccggggaaatcgcttttctcaggaaacaccctcctccgacaactctactgggatcatcacactgggccaacttagagataagatctgcctctctgtaacattcaaaacggagtcaccagtcaaaactcctgcttgcagatacataaaatatctgattccacttggtgctacctcatcttttaaaggggaacctggggcaggttccaagacttcaagaagcaggtgactatgcattcccacttggaacatcgcaatgaaggaaagccttaggagattgtgtgaaacactgcagagtattttgcctctccaacccccacagtgatgtttgctgtgttcgtcattagtaaaattgactactgacatggacaagaattggttccagcgaaatatctatatatgtgtgtatgtgtgtgtatatttacataaataaacagtgtatttacataaataaataatatagtatatagaatatatgatgttttatatataattgcataccacacatgtattttatacgttgttatacattttatatgattataatatatattgtattacaagctatttatttatgtggtctaggaaccaggtcaaagagttatgttggtttaatggcattaatgttgctgtaattctgagaaagatgctttactggtgaattgtctgaacatcctcagggttaaaacggtgaggttaagaatgtctgaacttcttcatatacctgaaatgccaagtacttaagtgtagtgtgctttatgctaagtaaaagttacatattttcaataggggctagacagaataatgaccaaataaatgcaattaggtttgttgatgtcatatgttttttttttacttgtaattctattaatattactgaaatgtgataaaatatttaaaatccgacatttagttcatggatatattaactctattactaagttctgatatggctggactgtgggtcctacagtaagagctgttagaattattcacatacaacccacatcccaggagtccttaattcccctggttctttcttgtgcttttcctgaacaagcagatctttctgcatttaggcgagaattgtggttgtcatggaatgagattttcagtgataatatgcatatacatttacaaactgcaccttctggttttcctggaacaagacaccgcctttctgtaatgagattctgttggccacctgtctgccactgagttactaagcaaggctgacctctgtgtgcttttcccaaggagctcatgggaacacacagacaactgattcaaggaggttctcagacccctgtagtaggaagaagtctcagctggtcttcagtataagccagaatcctgaagtaggctctaatgccagtgaaagaatggatgtgagggcaagagcaagcaggcaaaatgtttccttcttctatattctttatatagagtattagcagaaggcgtgaaccagattaaaggtggattttcccacctctaaagatctggattaaaaccagttctttccactttttttttttcgagacagggtttctctgtgtaatcctggctgtcctggaactcaccaggctggcctcgaactcagaaatccgcctgcctctgcctcctgagtgctgggattaaaggcgtgcgccatcacgcccggcggttctttccactttaaatgctttaactaacaacaaaaatccctcacaggtttacttagccacttgtgttttacctaattccagatatagtcagactgataaccaagaatcctgctatcatgaattgtaactgtgctttttagctactgcaatttatgttttttttaaaaaaaaaacgtgtgtgtgtgcatgtgtatatgtgtgtgtgtgtgcgagagagagagagagagagagagagagagagagagagagagagagagagagagagagagagcatttagcaggcaagatgaaagggcttctctacggaaaactctgcaatcccccaaacacaaagaaacagagctttaaagtcccatgacaccagtttcttctcaccaggagccttggacactgggcatagccaaagttctgtcagtgtggtattgtcccttttttgtgtggagttactgactggcagacaggacctgggcagagaaggcaggaggtggctgtgctcttgacttgttccaagtagaataatttagtcatttacctgaggacatgagagcactggcagcacatggaggagcggtgaagcccaaagggaatgagacaggcagctaaacattcatcgccatctgaaagtttccctaaagcatggcatgagagttctgtttactcttgagactcaggttcataggttaaatatatgatatttcccatcaaatcagctttggatgtcagactacttggatgtcatgactacttggcaggaactacattgcctcacacttgggaacatggtacctgcttggctggcgtgtatggaagtgaccatccatgtcttctgtgccaagagtggtttctgtcctgccctttggtgctgaacaatgactaatgttctctggatgggtgatcatgtagttttgaagacagtgggaattctcacatcatatgtagcccctcagggaggtgggtgggtgatgacgtcaacgtgcctcctggtaccagctccactgcacaagacaaggacactgctgcaaaacatcttcatggaggtggtggggcgtggctttagcaccttgggatgacaaacatattatgaatgcagaaagatgtgttgtactctcatgtgcccttccccttcctttctttcagcagggttattatcctaggaaatcagtcttaagagtgctgagtcatcctgagtcataaagattaccaggaactctccccgaggtagatcactgtgttcttactgtcccatgggtgccatgtacagtatgagaaatcactcaggaaggggagtagaaatctctgaaggagccagcggatgtcctcaagacggttgctagagggcagtccagaagtgtgacagaagacaagaccatctgatagtgatagaggtgctaacactaagactccttcctgtgtccctaaaaccaaacctataagcattttctgagtagtcagtagatgggattgggacctgcctctgtgtagcctctaccctagcacactccacaagagcattgatccaaatcaagcaacaggttacctatttctcccacctctacggaaacttagggaagtttctgaaaagcttagaccccaacttaaagtccctggataactcaacttttaaggaggaaatagatacttctcaggaataaaaccttttttcttcactggctgcattgcatgtggaaggatattacttctgtctatccaattatgtctatgtgtatatgtgtatatgatgtatatgtatatgtacaatgtgcatatagatcagcaagcagctgcagatggcgttgaaggtagtggtgtcactttcctcttcctcagcagctagagtgtggtgaaggaagccttcagatgtgtataagaggaagacagatatagctgaaaatgctcagtttcataaagttaggatcattgtggttacacagagggtagtgtttgctacagctatctgggcttgaaggagaaagcatgggttgtatcttgtatcctttgcagtttactacagaatgacctttaagattgtcatttagtagctgatcttgctgacccctttggcatgctaaataaagcccaacaagaggacatgttgaattgacaaagctttatacttcattaaagtttgcccagggagagaagtcacgctaacaaactgatgtcattcttcaccagaacatcaacaaatggctacccgaccgagtttgttgaagtgaatgcaatcacgcatcttttcctgacctgactcaaataattaaacagtgaatatccactagaaaagcctttgtgtatgtgattaagcaagttatttttagagacaaatcaaaactagaatggtgcttgcgtctctgcccacagaactttttacatccgtgtgtgttcaggtatgttaacagcttcattttgggcatgtaattttagcaaaatttcttagctagaggtcaggacatttatttattattattgttttgttttgttttgttttgttttttcgggacagggtttctttgtgtagccctggctgtcctggaactcactctgtagaccaggctggcctcgaactcagaatctgtctgcctctgcctcccaagtgctgggattaaaggcatgcacctccaccaccaccacctggcaggacatttatataacaggaaggaaatctactaacaaacactgactctcttctatccatctgtgaatgtcataaatgacaaataaccacgtctatcacttgtagaattactattgtgttcacctctcaacagtcacgtgaaatgggaaaggagatgtggacagtgtatgtgtcttgtgagaagtgacagccacatgcttctgtgagaggatgatggttttcatttttatgtgatgtgcagtttaaaatgcaagatgatgataaattgagaccatgtcactatttgcagtaataccggagtgcagctaagtggcatggcaaatataaagtcacatattgataaatgacttctgcttaaaagcaagtgaaataattttacttatatattgtatttctacaatcaattacagaataatagggcctctctttccactgatggccaactaggccatcttttgatacatatgcagctagagaaaacagctccggggtactggttagttcatattgttgttccacctatagggtttagctcctttagtactttctctagctcctccattggaggccctgtgatccatccaatagctgactgtgagcatccacttctgtgtttgctagaccccggtatagcctaacaagaggcagctatattagggtccttttagtgttgctaaaatgttgctagtgtgtgcaatggtgtctgcatttggaggctgattatgggatagatccccaggtatggcagtctctagatggtccatccttttgtctcagctccaaactttgcctctgtgattccttccatggttgttttgttcacaagtctaagaaggggcaaagtgtccacacttttgtcttcgttcttcatgagtttcatgtgttttacaaattgtatcttgtatcttgggtattctaagtttctgggctaatatccacttatcagtgagtacatatcatgtgagttcttttgtgattgggttacctcactcaggatgatgccctccgggtccatccatttgcctagtaatttcatgaattcattctttttaatagctgagtagtactcccattgagtaaatgtacccacattttctgtatccattcctctgttgaggggcatttgggttctttccagcttctggctattataaataaggctgctatgaacataattgagcatgtgtccttcttaccagttggaacatcttctggatatatgcccaggagaggtatttcaggatcctctggtagtagtatgtccaattttctgaggaactgccagactgatttcagagtggttgtacaagcttgcaatcccaccaacaatggaggaatgttcctttttctccacatccttgccagcatctgctgtcatctgaatttttggtcttagccattctggctggtgtgagctggaatctcagggttgttttgatttgcatttccctgatgattaaggatgctgaacattttttcaggtgcttctcagccattcgatattccaaagatgagaattctttgtttagctctgagtcccattatttaatggagttatttgattttttggaatccaccttcttgagttctttatatatattggatattagtcccctatctgatttaggataggtaaagatcctttcccaatctgttggtggcctttttgtcttattgacgatgtctttgccttacagaagctttgcaattttatgaggtcccatttttcaattctctatcttacagcacaagccattgctgttctattcaggaatttgttcccctgtgcccatatcttcgaggcttttccccactttctcctctataagtttcagagtctctggttttatgtggagttccttgatccacttagatttgaccttagtacaaggagataggaatggatcattttgcattcttctacgtgataactgcctcttgtgccagcaccatttgttgaaaatgctgtcttttttccactggatggttttagctcccttgtcaaagatcaagtgaccataggtgagtgagttcatttctgggccttcaattctattccattggtctacttgtctgtcgctataccagtaccatgcagtttttatcacaattgctctgtggcatggtgattccaccagaggttcttttatccttgagaagagtttttgctatcctaggtgttttgttattccagatgaatttgcagattgccatttctaattcattgaagaattgagttggaattttgatggggattgcaatgaatctgtagattgcttttggcaagacagctatttttactatattttccctgcaaatccatgagcatgggagatctttccatcttctgagatcatctttaatttctttcttcagggacttgaagtttttatcatacagatctttcacttccttaattagagtctcgccaagttattttatattatttgtgactactgagaagggtgttgtttccctaatttctctctcagcctgtttatcctttgtgtagagaaaggccattgacttatttgatttaattttatatccagctactttactgaagctgtttatcaggtttaggaggtctctggtggaatttttagggtcacttatatatactatcatataatctgcagaaagtgatttttttgactgcttcctttccaatttgtatccccttgatctccttttgttgtcgaattgctctggctaggacttcaagtacaatgttgaataggtagggagagagtggacagccttgtctagtccctgattttagtgggattgcttcaagcttctcaccatttattttgatgttgcctactggtttgctgtagattgnnnnnnnnnnnnnnnnnnnnttttatgtggagttcccttgatccacttagatttgccccttagtacaaggagataggaatggatcgattcgcattcttctacatgatacccacccagttattcctgatctttccaagactttaatcatgaatgagtgttggactttgtcaaatgctttctccgcatctaacaagatgatcatgtggtttttgtctttgagtttgtttatatagtggattacgttgatggatttctgtatattaaaccatccctgcatccctggaatgaaacctacttggtcaggatggatgattgttttgatgtgttcttggatttggttagcgagaattttattgagtatttttgcatcaatagtcataagggaaattggtctgaagttctctatctttgttgggtctttctgtggtttaggtatcagagtaattgtg

SEQ ID NO: 974 - DNA, 1521 bp, Mus musculus
cttttagttttagaagtaagtttgttagaggctcatctgtcacgaagcagcatgcctggcgaaaccagcacagcgagaaagcgttgctcttcctccatcagttctatatccctggacagaatgccatcggaaatcttggtgaagatactttcttacttggatgcggtgaccttggtgtgcattggatgtgtgagcagacgcttttatcatttggctgatgacaatcttatttgggtcaggaagtacgcagctgcatttagatcaaaaagatcacgttggaaagctacttcagtggaggaaacagccacaagtctgagcttgctgtcagtttgggataaagaagatggatactggaagaaagaatatattacaaagcagatctcatctgtgaaagcagccctcaccaacagcctcagtcctgtcaaacgccgcacaagccttccttcgaaaaccaaagagtccctcagaatatctggcttaggttggacaatcatcttaagagaagccagtggcaaagaacacatcatgcagcattcgaatctttccgtaaatgacaactctgtcactgttttttggcatgacaaaaattggccacatgtagacacgttgtccaccctggatttgtatggtgccacaccaatttttatggagcagtataaaggccctaacacaagttgtccacgatggctgtctttaattgaaaagtacgatctgagtaatttacgcaagtctgctatgattggctgcgacagacatgttcgggtattctgtgtaaatcctggcctcctggtggggctgtggcaggagaatggtggactagcttttgtcatggcaaatattcattcccatggccttttcgagagaagcataatgggctcagacactattccctatacattgcctcccgacactacatttgtggataactacccagactcaatgaccttttatggagataaaggctttcagctgcatatcgacattcatggcagtaagacttacttcctgtgtagcaccttccacaatctcttctgcaggagagcgggcattaacaatggatatgtgaagttcttgatgataaacttaaaaaataacagagaacacctacctcttgttggaaaagttggccttgaatggagaactgactgtttaaatggccgtattgagagttgcattgtagtggatatgaccttgctggatgaggacaagaagcccatctggtatgtgagttctccagtgtgcttgagatctgcctgccttcctgatttcccgcagccggcttactctttcgagtacatggacagcgtaggaggagtgtgcgcagacctagggtggtttgaaaataccgatgaatacttcattgtcagactggacatttacctcagtgtagcaaaattacaacaatggtttgggaggcaataaatgctgagttagcagtagggagtcttgttattagtaagctgtttgttttttacaactttgtttttattgaaagttaaaataaagcatatttgtggtagt

SEQ ID NO: 975 - protein, 473 aa, Mus musculus
LLVLEVSLLEAHLSRSSMPGETSTARKRCSSSISSISLDRMPSEILVKILSYLDAVTLVCIGCVSRRFYHLADDNLIWVRKYAAAFRSKRSRWKATSVEETATSLSLLSVWDKEDGYWKKEYITKQISSVKAALTNSLSPVKRRTSLPSKTKESLRISGLGWTIILREASGKEHIMQHSNLSVNDNSVTVFWHDKNWPHVDTLSTLDLYGATPIFMEQYKGPNTSCPRWLSLIEKYDLSNLRKSAMIGCDRHVRVFCVNPGLLVGLWQENGGLAFVMANIHSHGLFERSIMGSDTIPYTLPPDTTFVDNYPDSMTFYGDKGFQLHIDIHGSKTYFLCSTFHNLFCRRAGINNGYVKFLMINLKNNREHLPLVGKVGLEWRTDCLNGRIESCIVVDMTLLDEDKKPIWYVSSPVCLRSACLPDFPQPAYSFEYMDSVGGVCADLGWFENTDEYFIVRLDIYLSVAKLQQWFGRQ

SEQ ID NO: 976 - DNA, 94512 bp, Homo sapiens
  misc_feature (1)...(94512): n = A,T,C or G
agttcaagactagcctggccaactaggtgaaaccccgtctctactaaaaaatataaaaatcagctgggcatggtgatgcgcatctgtagtcccagctactcaggaagctgaggcaggagaatcgcttgaacccagtaggcagaggctgcagtgagccaagatcgtgccactgaactccagcctgggtgacagagcgagactccgtctcaaaacaaacaaacaaacaaacaaataaaaaaatgaccactccaataagaaaactgaaaaaagggttattatacaaaaatcatcccataaataatttaaacaaatatttcatgcacaaagattaaaataggtagctttatggtgtgacttgtagtttcaaagcaatgtaggttgacatgacgcagttcctgctcctcttacagaaaacaaacataacaacacagagttcagatgtttctctactaaccccttatggtttgaagataaaatgtatgaacatttttaatgaaatgtaattaattaatagcatctaatactaaaactatgagatcaaaaaatttttaaagttaccaaacacagtgaggaaaaagaaaacagataatgacatttaaaataaatcagagctacaggtgtgaatctactatttctaatgagaaaatccacatgaagtagaaatgtagtttttattgaattcaaaatgcaaatactgtggaaccctctaaaaaatataaatttgatattaaactaaaaaagtttgaccctcaactctacgaaatttatcttattttgtctgtttgtggagtatcttcagtatcacattttccaggataaaaagaagtaatatgtaagatgatattgcagaattgtatagcacaaacaaatagaacaatttactttaatctattaaacatataaatatcaacatccatcaagattttgtttttcaagcagacacagtacccagcaaagagaagggtaccccttaaaaaatgttgacaaaattgttaaagtttaattattatttgtagagttttttcaggcagcaaatgaagttacgacttcaataatatcccacttttgtatattcttgtggagttttttgttcaaaatgctgaaaaatctacgaaaggctgagtttgcgaataaaacagcaactcttcatctctttccagagatgcgtcctaacatttaatgaggttaccacccacaggtatttccggagtctgtaaagaatgtttcttgtcagataaaatttggattcccagtaactattatgggaacgaaccttccttatttcctggttttcacctctgagatactttatcctccctgcctttctccatggttaccactggctgtccagagctcaatgaagagaaatcagtggatttaaaaggaaagatgccagagatcgttagcttctgaggtttccaccctgacatgattagaaaactggtagaacattcagagccggggccccagggaagatcagcaccgggctctatactgagcacgctgtggattgaaatctttctcctcttcaggggctgcaaatgcgagctatgacattactccttggtctgtgtgaagaacagccctaatatttatgatgataatggcagacgattacctgctgttatctttcagggtgaatgaagttgtatttcaatgagtaatattttcagtgctgaaggtctgcagcagggagtaagaaatctgacacttcccaggccacaccggctacgtgtgactggaaggtcacatctaaagccttccttcttgacagggtccttcaaagaaccaaggcagcttccccatgtccactcctcccagggaagggtagaggcagactgtgcttaagagcttagatttggaagcaaattttggatttgtgtggattcgggttccggttcccccacttactagctcagtgatcctggtgaagttacttaatctctttaagtgtcagtctccccttctgcaaactgaagacaaagtagtgccgaacacaaatggtttttgtgagactgaataaagatgatgcactgagaccctgggcagagtgcttgcacggacacattttcggtaagtgtcagcaatgacattatgaccatgaggtcatgcatcaggctttaaaaagactagaaacttaccatgagttcaatattttggtgtattctaaaaatttagtatctatgaacaaccagcaaaatgactgtcttgtacaattagcatgaaaacatctgtacactgacttttgggttctcttaaagagcaaagacctaataatgtaatgatgactcgaccattatgtattattatgtgaatttcactagcgtgagaactggttcttgaattctgcccacttcctcctcccagacattttctccccctcatcagagttcatgtaactcaatcttgagaactaacctcaggatgtgatctgcatttttctaaggctctcccatatatcttgctaggactggatgaagaaaaaagttctttgaaaatcgtgtaaaacaagccacctgaaatcacagaaaacaaagatgaagcgaagcaagggcaacataaaaagtccagtttaaaaaatattcaagggcttatacttgctgttttttgcaacctgtaatgctgattccaaaaagcaccactattaaataggtaaaatctcttccggcttctttcactgtgaagagaaaacaccaatgggttacgggtgccggctgggagcaggcaagcttgtctgctgcttttgcacttcttgcgagagaaaagcagcctccagatcaaagcaaggggtctgtgtgtgttcaggggcagctgttttgaaaactccctgtgtgtcagcgcctcagcagaattctcagagcagggcttgggaatctatgttttaatttaggatgaagaaatccttttaacaagtgatccagtccacaactgctgtaggttaggcaacactcccagattaggaagagtgctggcttttgtcaaccaaatgggtaagggactgaatggaccaaaatgggtgtcaactcttaacagttagtaactagctcgaatgccagtcccaccccacactgactggtgcataaaaacagaactgtgttcagagtaggaatatggttggccagaaagatttatgaattaaacttagaaaatgaagaaaatgcacagaccagacatttgttttcccacactaataaaatatgtgcatatgggttaaacagacactctgagagctagagaaactcaatcaagacagtgtcagggggccaggcgcggtggctcatgcctgtaatcccagcactttgggaggccgaggcaggcggatcacgaggtcaggagatcgagaccatcctggctaacacggtgaaacgccgtctctacaaaaaatacaaaaaattacccgggcgcagtggcgggcgcctgtagtcccagctactcgagaggctgaggcaggagaatggcgtgaacccgggaggcggagcttgcagtgagccaagatagcgccactgcactacggcctgggcgaaagagcgagactccgtccaaaaaaaaaaagacagtgtcaggggacagaatatatacatatgtatagctataaataaatgtatttgtattatacagaaatacatatacaagtacgcttatttgtccctattaccccaatcaccctagattcccgattgtccctcccaacatttcattcctgccttgcttagcgtatcaggtgagtctttctattttttcacttaccaacagctactgtatatctaccatgtgtatcttcatatatatgcaaagagctataacattacagttacactaccttaacattacaattacgactatgcttttcactgatgctgagaaagtgagtcacctcctggcattatgtttatagactaatttattcaccacattagccattcagacttctgaaatataaatctttaaaaaatttttaagaaaaaaacttttggaagaaaattttaatagatgttgctgttattttctcttctgtataaaaagcttctattatgtttataaacaacattgtttaaaagaagtatttagctaatacaacgcttgtttaaaagtagtctttagcgtatcacaatccttcaagttttcagcaaggttcccaacttagaagacattattcaaataataaaaagacctcatctgccaaaatctgtgtaattcatgggactgactcaaacaattgtcacaaatccaatttcccttccaaggttcaggagttggggcctacaatgacgacatctcattccactctcagtgtcacaaaatacatttcaataaatattacctgccagttatgtatcaactcccaggttgagaatacaataacaactaactagttctagtaagtatccttatttgtccttgttacccaaaccgggtcattggccccaacaccctggacttctgactgtcccttccaacaattcattcctaccttgcttagggtatctgacaggtcttttccatttatttgataaacaacagctcctgtatatctgttatatataaagccctgtgctaaatattctccatattctacacacttgaaaaatttctgtttgttactttatagctgtctccaatggaagctgctcactgtctaactttctgaaccctatcagacctaatacttgtatgcaaaaaaccctcatgccatttatttgcttccacaattctctacccctcctatagtgggtgctgtggtatggggctcccagctgcagggagcactggtagcggacagttgtcagctgagctcctctctgggcattccatcataagagagcttcctcacttaggtcacggcacttccctggaccagcccatattcaatgcctggttgatgcagaagcataagactcagcccccatattaggtaggacagtgactggccagctcagctccagaagtccccagagcagcagctgaggccccaactgcaaatgcacttcggcctctccctctgcccagtcctgcttccctcatccctcaagacgtattctgagagcactccctgataaaccttacgcaaatcccacttccctgggaagccaacctacaacgggtgctaccaggagtggtaagcagctctcaatttggattttggagctggcttgccggccactggctggcaatgaggaccctgtccctggtggtaggggggtactgacagcacctgtcatagagctgtagtgcagctgatgcagctctcaccaatggggacctgggatggaatgctggcggaagggaatgtactggctgatgtgttattctgggagtttaggaggaatcagcaattttaaggacttatatcagacggctgtggctggggccatggagagggatggtgagatgaagtgtgtaactaatcaccagtgaaggtgagtgccaagggcaggagcctcctccccggcagaacaagactcaaattgcacccagaggatagaaaatgcgtgggtgaggtctggggcggaagggattcagggagtttggcatttcaagcccatgagacctcccacaccaaggtcagggtcctgatttgggaggaaaggcaacctaaagctgggtagggggcccttgaggtcaatgttgtaaaaaatcttgaatcccaattctcctgacccctctagccctgaagcagcagctcagtgtctggtaaaggttggcacttcctccaccttggaaactgggcgaggggtgggtgggggtttctgcctagcaagatacgtgctgctctcaggagggctctccacctcccctcctggccaagttacaacacgactgggcatgagaagggtgagaagaacaatactcggaaggagctggaggtccccccggggggggggggaacatagacaccactgcttcttaagggtggtgtgtcaagggcacagaacacaaaaccagctgagagttgatcagcatggggcacgctcctgtgatgaatttagcaaccaggcaagcaccctgggaactgatatgcagctggctaggtctgctcctggaaacttcgagacagtgatggtccacattaagtaaaagtgacagaacagccatggcaaactggacgaaaggctcaacagcctccaagaatggggatgctaccatagatataagatataaagcccgaaaacccaccagctgactatgttcttaggagggacaggaggacactgtgtaccaaagccacaaggaagccacagttacatctttatagagcaggatgccctgacagaaatggagatgaaagaattatgaagcagagaccaggctggggtgttaaacagaagccaaggtgggtgcaaccatcataactaatggcaaggctggagtggcagtcgggagtgtctgacctacagaaagcaacagagttgatgactagaacacagtgtttccaaagggaagacacaagggcagcggacaaggctacttctgaattacacagtcatgagaaattaactacagatgattcctgaggctgaaggcagctgctctaatgcaaagtcctgaacattgccccagtttctggacctgaaccagttttcagacctggaacgcatttactgaaggaaagcgtatgtaactgactccccccgtccttcaccaaaaggacctacagttatcaacttggacatagtctgtgctgacagtgatacccaaggacccaaagagtcatgatgaccccctgaccgccctccatcaccggatgtaagaagctcacaggtgggtccagggacttacctggcaataatttctgtgatttccaaatgtataaatcaaggggatgtactgagtaactggcaacaataactcccactttagttcctttggaagtgggttaagagccatcgcagtgggaaaagtcaaatggaagcccctgaagctgccctttcggtgaccaagataggaaattaaaaatgatatcacatctatggggaatggcagagtattcttagagaccttagatacaggcatggcgatccccatcacggtcccttgtaatttaccagtcttcctttacaaaacacaaataggtgctggagaatgacagtggttaactgcaaactcaaccaagtggcagccggggtacacatgtaataccacaaatggtaactttacaggggaatgcattaacacaatctcatggtattggccattgctttgaagaacgccttctattcagaagcagcagcagtagtctgtagtaacatgaaacagataataacagtgtatgtttatgatcctgcccaggatttgctaattctctcaccctctatcataacagtcttaagggactgaaaccttctggacctgggctgtctaatacagtagccacttgccactcatggctatttcagttcaattttaaattaattaaaattaaatcaattcagttcttcagtcacaagttttagcaacatttcaagtgctcaaaatagctacaagtggccaggaactacccaaatggacagcacagatataggacatttctatgcagaaagttttatttgaataatgctgttctggacattcaggagaatatcacatttgtctactatatttatgccatcatgttagagcccataagtaacaagtggcaagtgtgttagaaggcttggtcagagaagctgcaagtgtgagaggtgggtccaacaaagatgcagaggctcatcaacacatgagccgacctcgtggggctacactggggcgtgccaagacatgccctcccaagtaaaagacaattgtaccctatacctcctaccacaatgcttcataggcctgtttgaattctggacgcagcatattccatatttgggaatgttgctcccatcaattcactcagccacaaggactgtcacgtctgaatggggtgcagatgagggaaggggtccctaagcaggcctggtgtgcagtgcaagcatgagcactgttgcctgagccagatgacctgatgcacatgctgtttgccacttctatgcctttcacctctgcatacaggttgttccttcgtgctgaactagtatgaatgaaaagctaggtttttggcatagtcagcagactctaaaacaattggtatgatccaattttttgggttaaaaattattaaaaggtatgtgtatgaaagtgcaaaatgttaaaaatagtcatcttcgtgtggtataatcatggcggtctaaattgctttgtctttttttttcctacaaatcacatgcgaaatgaagacattaaaaaaaaatcttaaaatatctgtgaatacatctctgactttccctgacaacttacattccatcctccctattttatgtttttctattactgcaggtaacatgtgaaagttttccctaccagttatgagtcaataatctctctctctctctttttatcctatccaattactctttattatatgtaacagagccaatataacttgagaaaaatttcccaaacataatgaaaaaaagttatatcaaattcaagatcaactttcacatctgagttccaatctgtgaagaaaactgtagatctatatgttctagttctaaattatgtttaaacggtttttaaaaattcatgtgaattgctttttcacctttagcagtgaacttggtataaaagggcattggcagctcttgtcatgtctgttgaaagcccaatcattaaagtactcctttttacctttttgtgatgttgggacggcggttccccctctctgactcctgtgcacagacacttgtttgctgccatcctcctttgcttttcgggggctcggtccctgcgtccagatggttttctgggtgactccaagaatacatctaggtcgcagcgttttcttttgatattgaagcccacatctcaaactgggctcagtcttcaagcacgctttgttaagcacgatgtatggcaaaagcaatcgctttgccgaggacctgtgcagcttctccgtatactgtacggctcgtagaaaagtacaaatcatgttcacggaaaatcgttccgcttagggacgatgctaactacaattaggaaagctttagggttcactacacatgcggccggacacgtactcaagcctatacgtttacattacatggggtgttaggcaaaaacgtcagtttccgcagcgtaaatgaaaacgaaaagtctccagggagaacctgatgtctaccttcccttctgtcttctttccattttaattaacaggctctgatcaccttctgggctgacattcacagtgtccccgccatgccttcgcaaagtcacctgggaaacccccgtcttcctgggaatagtagtttgaaaacctcgctcttaactgggatacggcaaagaggcgcgcaaaagagactacatctcccacaattcaaggcggccagagcacggcgcaggtccttcccgcgcccccagacgcctccgcgcccagcgtcggcgcagacgctgcgcgtccctggagcggcggaaagtggggtgttggtgggggaattggtaccacccaccctacgtggttcaggcgggacttgcaaaagccaaattagcagttacaatctacgtgttttcctgatccttatagagaggactgtgcacagtgggaaatacccccttggactgtggtcttgccaattccgcgtgggcaaatgatttagtttttgcgttttactgtgttttcagaaaaactggacaataaagagtcagcaagtggggatgaacgaggccgctgcaaagcaggcaccggtttcctaaatggttaagccgcgaacttggcttggcgccctaggcggcagaatgttaggggtgggtaaggaagccgaggcccggaagtttctagaagcccgctctgtgagcgggtgtctggcgcggtgccgtctgcgcaagggtgggcataccgttacttttgctcacgcgcgcatgcgcataaggggtgtggcgacgtgcgggcgtgggggcggtgcgtgcactcttcgtttcagccctggcgcggtcctgtggtgaactccttgtctctatggcgactggacgcggtcggatcttgcagcagcactggctcggcctccagacgctgcgcgggcccagcaggggcggtggcgcggcccgggggcgcgccagggcctttgggtgcaggtgactgtagggcctgcgggtggggtcccctggcgggaagcccgtcactgcgcggccccgctctcttcaccgtgtattttattcgtccagcttggcgcaaggcccgtggccgtcttcaacgtgagaagggtatggaagaacgaccggaggaaatcctttctaccctgcaacgtggggtaccctaagttatgacacaaatagagtagcctctcggggaaatattttttcttgcggcgcctgtggccggggatgcgcgcacctgccaggacaggtgcaggtccaagaggtcgtttctccgggatgcgtgccctaaattcacgtgtgctccgcccctgccttcgtattttcgctcttctgtaaccaagaatctcccttcgtgtttttcatgaccttacaacttagggaagtagagtctgttcatcaaaaccttatcagttgacaccctcatcccccaagcagatacctcgggcaggcaggttggtctggcgggtggggggcagcactttctgcacctccaacgtcaaggctaagttgccatctacattgccaggtcttgctcatctgctttccagaagcatcttcagcgtgaagaagtaaaatgagccagtgcatcagaagtatcagcatgcataatggtaccttatgaaatccctctcattatatcgtgagctgttccctagctgtgtacccatcactgcagttagtttacagatggagggataatgccaagaatggtttacattcttgaggattatctttctgcttgtaagactccttgatttataaatagggaaagtcatgcatattttgccttctaataaaccaatggtctatgtttaagcacacaaagggagtctattacatactagttgaactacttgttttttccccctgaatctccagaactatgtcctgtgtcctctctaggtctccattacttccacttacctgttttcagaagcccagccctgttgcttagtgctgtgataatagttcttaattgaatacctataatgctagacataccacaagccttgtcacaaatagaatggtgacaatgcctgcaaaaattcttttatgtaggagaaaaagcaggaatttaaataggaaacttgaacttttaatcaatttgctgctattactaaaattagtctttacatagtgctctattagggggaagcagaatgatttttatatgatgaatcttttatcctttgtaagttgagtgaacttcctggattgatataattagagggcctgtcattatgcctggcatgggaacctgcatttcaagctgatttggaaatgtatgcattatttttggtaaagaaaagtccgctgctaaaaatagaatgattgactatggtcaaagcaggtggttattttaatatatcgctgtggaaaattagatgttgttaaggaatcagtgttcccttttaacacaaaatgtgaatatgtataaatatcacaaactgtaagaagtgtagcagaaagcgtattaagttggcttaatttgtacctgctgtaatttatttgatttgccagatatttaaaatgaagcacagtcattaggtttttaaaatattggacttattgaaagctatcagacaaaaacctgtcacttgaaaaaaagtgttttcaaactaaatttatcttgctaaatgtatcagtgtatgtctacacttaaccttgtagacgtatagattcgcataaaaacataaatagaacttgctgatttgttaattatgtggaccttaaaaatgtgcaattggggccgggtgcagtggctcacgcctgtgatcccagcactttgggaggcggaggcgggcagatctggaggtgaggagatcgagaccatcctggctaacactgtgaaaccccgtctctactaaaaatacaaaaaaattagcccggcatggtggcgggcgcctgtaggctcaggtactcaggaggctgaggcaggagaatggcgtgaacccaggaggcggagcttgcagtgagccgagatagcgccactgcactccagcctgggcgacagagccagactctgtcgcaaaaaaaaaaaaaaaaaaaaagtgcagttggtttattttatggataaatagaaatgtgtttccaatagtgttaaaaggtacactgataagatgtatggtctcatgtaagacatggtacagagagctctgacaggacattaaggagatgggcgtctcagagactgtctttgcttctagcttgggaccttaagtttctttagttgccttgttagagccttagccttgtaaactgaaatgagggactctatgagatccattttaattgtgaaaaaacaaaacagcaagaaataagctttgacgttttaaaagtgtgaaaacatgtttgtaataaaatagccttcatattccaattaaataaaggatgaaatgtcttaaagcacttacacattaccttgtgcagagtatatgattaagaagtatttgtagaattgaactaactaagccctgttaaatgttttagccaaagatagaggcatatccattcgttactgaattagggtttcagattagggaaaagcatttggtacttaaaaaaaataactagtaccaaacaggatttatttgcttaatcgttatttaaaactatctttgagtggggagagttacagcatgactttgaggaacttactaagatcattttatttacatatattttatatgcatatatgtttacaaaacaggtgactttatttcactggtgttttcacagtaatctttcataaattcgggacacacaagttaaggttttcagtaagaacttggtggtggattaagccagtatgtattcttgaaacatctaagcaccctggcgctgtgcttctcaaacgagtagttgtagtgggtggggaacacatagagcatcttctttgtctgcaaaatcaacacaaaggctttggggaaaatgttaaataatttaactggtaaataatataatacatttttatgataggacaaagacagattatttagtagaatgcagtatttgctttaatttttaagatcaattgggagactcctaagaaattttgagtttgctgcagactgtacccccagatttcgggggacctggtttcagtttctttgcaagagttctgttgctaggaatgcctttgagaaccactgctccagtctcaaggattgtgctgtcaaactgtgattccctggccttcttttgcatgtgactcttaggtttgaaattaaaacaacacccccaccccccaacttattacagattcaatatgctaagaaaaattagaacatacatggagttatgccccctaaatcgtccccatttaaaaagaccttcaccaacagattttgtaatcctatgaatcagatctgttaactgttaaaccttggtgtctctagatctcttttctttgtatgcatatatttacttttcctcttagagaaatagaaaaataagtttatgtattaggttggtgcaaaagtaattgtggtttttgttactgaaagtaatggcaaaagccgcaattactttagcaccaacctagtagtatatactgatataacctgctttctcagttatactgttagtgattcagcgatatttattgaatgctgctcgcatgccaggcatattgtgggtgctgaacgatcagcagtgaacaaacccatgcagtataactgcccatgtcattccagcgatagtaagcaagacaggcaggttaaatgtatagtgttggatggtgatgtgtgctaaggagagaaacagagaaaggacacaaagtgcatgtgtgtgtggcagaggggactggattgcagtttaaatataacagccaaggaaggtctcagtgagatggtgacattgtagtaaatggctgaagaaagtgagggagcaagccatatagacacctggaggccatcagggacctgtttctaattcaaacacttaacctgggttgaaaaatctatattttaattgactagacattgttaactctatggagaccatgcaatttaaccaatctctataccgtttttagtatttttttcccccagtgcagacaactctgagatggacattcttgagtgaactatctgtgcacatttctagaagtggaattcctggcttaaaagagcatatgtgctttttaaggatcctggattccaatatcagatttggctttccataacgtttgtaccactgtatcttgtcttacgggcagtaaatgaggatgcctgtttctttgtaacatagccagcatgaatcatcatcatttatttggtatttgccaattgctagattaaaattgatccatcagatgaatttacttttctttggttctcttggaaaggcctaaggtaacagtttttatttttctggcttcttattgaggaaataaacaatgacaaaaagctgttactgattcagtaaggtatttatttaatatcttaaataaaattatatttgatgaactacaataatatttatgtttaaagtatatatagaattattcatatgatgcttagggtatgtgtggactccgattctaggtacagccaacccccacactcccataggcttaagggttacaggtttggagctcctgataggaattgttattgtttgatgaaggaatgatagaaattccctttatttgaagcttaagtgttagaatcctttatcaattgtagatattttatctttgaatatgtaatataagtcaatacagactttacaacaataataaccatttaaaaataagtcatgcttttaaataattttagaatgtattacaaatttgtttactgtgttgactattgacagtaaacaaagtgtattataccttctaaagttatttatgtccttctggaacaccaggatgtgactttctttagatatagggtctctgcaggtataattagttaagatgaggtcatactggatgagggagggtcctaagtgcaatatgaatgatatccttataagaagaggcacagagacagatatgcctagagggaagattgctctgtgaagatgggggcagagattagagttatgctgacacaaactaagggacaccaaggatttctggcaaccaccagaaaaaggaatgatcctctctagagccttcagagggagcacggccctgttgacaacttgggttttggacatctggctactgagacataatacatttctgttgttctgagtcacccagtttgtgaaggtagtcttaggagacgaatgcaattaggaaatgatattttacttatgattactatgttaggaccatgttaatggagcctaagcttttctcctgtggaaatctgtgtttaaacaaaatttctaacagaagtacaaaaatatataacaggtagaattatctgattaaaggaggagagggtattgcaaaaatgtcccaattagcatttcttcctgtcctttctccctgtcttcctgccctgcagagcacagattgaaaaccattggctagaaagtcatataagaccaaaagtatattaagcaccttttactgaagctgggatggaaaggcatgtggagccagcatttttttttcctcggtgcatttttactcttacaggatctggaaaagtttaccttatgcaacttctttgttgagatgccagtggagcagctgatcactaatatttgtggagggcctaccctgtaccagctactgtgcttttttctagagagaaaaattcacaaagggaagaggaatttactctgtagctgcttggaagcatgtggagacttgtgcctgggaagcagggcagccaggtgccagtgggtgatttgagtgcgtgctgcatatcatgatgctgtcttgcggtaggctccaggctacactgtcacctggccagctgatgcctagggcaagggctcctttttcaccacttgtgtcatctaataggttgtgctcagagttgagggccatcctctgttaagaccagttgtgtgtggatttcatacttcagctttcaggggggttggttcattactttttcttccaagttcttaaggcatctctttttttgctcccaattgttgccctcctttatgaatgttgtttcaactatatctggggaattggcctggtgtgaaaaactgagggtggttaaactgtcagtgcacaaagtacacattcaaagcaatgatgttggtgaactgagcgtatacataatgtactctctaggatttagccacttcttaaatagcacatcaggaaggaggtgcgccaatatccaatacctgtgtgttgtatgttgcttaaagcagaagcttccaaacctttcctagagaaatagtgtaaccattcatggctctccgggtgtgctgctgcctagacatggaggctgtgagctgtatgattttctggtgtttcagattccctcaaggtgctgctgagtactactggttttgaggactgatcttaataaaatttactttaggaacctctgaaaaagactcactgcataaaaatattatatgctatttcattgaatctaaaaaaccattcattctaagatgcactactgttttctgtaccactaaaataaaaagatggccagtgaaaatatattgcattgaatgggagaggttaaaatgtaaaagtttgtggatgagtatttggtagtttgtctatgactgcaaaagctagagttggaaccctcaaagatcagaaaagttgtagattgtgttttatgttgacagttctagtttactaatagtaagttttttaaaaaaaactttaatggtttctgttttatccaaattggctaatcagtacactaactgtatcctttttgtttccattaaatgtatttggtaacacctctttgacatgttgaaagcctacagtgagagtgtatatttctaaacctttgggtgaaagcacatcagagtaagtacggtcttgaggtttccttaccaggacactaaaggtttcactgcctcttcctcccttctccctgcctttcttccttccttaccatcaaggtctcactgtctcttcctcccttctccctgcctttcttccttccttaccatcaaggtctcactgtctcttcctcccttctccctgcctttcttccttgcttaccatcaaggtttcactgtctcttcctcccttctccctgcctttcttccttccttccatcttttcttcttcccttcctttttttctttgcagaaattaagtttttcagtgagtaatctttggagtttatgaatcctttggaattttgtagaagggaatagataattcacctcatttggtaattacataatttgaatttcccacatttactttcagaaaggggccaggggtcaagctttctgcaggctctgctgccctgaggtgccatgccggaggtggacagcactgggagagctctttctcctgctgttctgggttcctggatgggtaagtagcagaagtagactgtcacttttgggggcctctaggcatggggttattagagaaagttatgatgctgtatataccaagttgctattttgagcttgctaagaataggattgtgtaggaagacagtacagcatggagcatttgatgagtcatgggcctgtcaccactatccttatgagatgaactttatgaaacgaaacttcaagaagtgacaagtaaattgaattttccttttattaaaacgttcttcaaaaatattcacttttgagttgataaagacccttgaaaaaggagaaagaaagaagattaaagtgtgttttcctgaaagctcaagagctctgttcatttctcagctttcaatatctgggagcccatttgccatggcaagattctgtgctgtgaccctcagcaccaagatccacagaagctttaaaaaattattatgtttaattgatgctcagaagtccatagatttgtactgtagtaacatttatggaacaccgattatatgctaagcctcatggggagcctgaaagcttgagatgatcacagagagacattttacactgcaggaagctaggcccacgtagtctgcatattgcagaactgtgtgattcagatataagttgcctgatttcaagttctgggcttttaatactgtatcacagcttgctcagctaacagtgtacatatctgtatacacatttcagtgtattttaaaaaaagccagaaaggatatttcattaaggacattaatttcagcttaaaaccctatgctctgggaataggctgttttacaggcatctgatatgagaaatggagcaaatattcctttggttagtccatccattaaatatttgaggacctactctgtagcagatactgttcttggtgctgggacagaaatggtgagccactcacatgttctcatgaagctgatgattagtcggggaggcagatttaaaatacagtaagctgggatacctgttgttgagaaaacaaatggatcccccagtccagaataatggggtggcgtggtgaggaaagacttacttcaggaggcgcatttaagatgagaactgaacactgagactcaggagcttcgagaggagcttgccagcgaggggagaccagaggtgtggtggtgggggctccagatgctgcaggaacagtgtgggggtcggggagcccatcaggtggggctaccaggctctggggaggagtgtggatgccatgtagtttcccaaattatcttgtttatttgtttacctctcttctctagaagtagggaagacggagagacacaggcaagtgggagatatagttgggggcatggctgacatgattcatttatgaattaatgtaggtgtgagggggaaacaggcaagtaggaatccagagctgttggctgaagcagtagcacaggttgaggtgctgttgactgagatggaagagaggtggggtcagggcggaagagagggccatgataatgactttggactggttacagctgagatgcctgggataggtgcaaaggaggatgccagatggatgatggatgtgtcagtctggctcaggatgaggcctggtggggtcagcagtcatggagctgggtgaggtggcttagggaaagggtggggaagggaaggcaaaggcgactcaggagcaagcttggaggacctgcggcagtgagaaccaaccaagcaggcagggaagagccctgaggtccaagacattgaggagaggctgtgtgtgaagcagaagaggagagagcctgcaacacaagagcagtcggtgacctgcggcctggggaggcggggggaggaggcagcagggcatggtggcccctcacagctgttgcaggtgaatgcaagggaaggggctggccgctcattttcctacttgcgtgtgttctattccacactggaatgtagaaagcaaaaattagggagcttggaggtggaggcaacaggtgtagacaagtgttttgttttcttttgttctttcccagagcttggcagtgcgagggagcctagaaattaggtggcggctccagagagatgggggtggggagaaccaaaggaagagtgcagtttcagatgagagattcagggtgattcagaggctcctatgaacagtgtggaagagggaggcaggaaccggaggctgaggtccttgtgcagaaaccgtggggacctagagcaccggtgctttgatgagaggaagtgagcattctccatcggaatagggggaagaaagtgaggaaagcaggaatattgggatagatccacaatatgaagcagggacaaggacgtgttcacatttgtattccctcagtactgaaaatggacacgcacaaattcacattctcagggaagcttgttggtttcagagcagtttctttgttctacattctgaacttctttaacggtcctgcctctcacctcccctttcccttatctccctatcatcctgtctccttaccccacacaaagtgaaataactagaatccaacagaaagtaatccaatatgggtgtaaacattgtgtaccaggttagaagaaattatttgaacaatgattaagaatgtattcgatctccactgtcttaactataaagtagagattttctccttttgctagaaggacacagagtaccccccttttcattaggttagtccagtggggaggaaggtaaaaacctgctgaatgcctgtcttgaatgggatttcattccagttaaataattctggtagttgctggatacttttctgaaatgtctttaagcccagctctgtttttttgttcaatggtactgatttaaaaaataatagatatgaagttttgtgaaatagttaaatcaaaatataaaaattatatgcaatgaataatccaaatggtcacaaaaatatgttttcttgcaactttgctgtctctagcattagagactttttctcattgcaaggatctaatttattgactctgaatgggaggggttttattttggggactgatttaattaatgcttaagcaaagcttttcgtttaaactctcagaacgtctctggttaactatagctggagatttgagcagtggggacatttacatggtgatgcatatccaacaggcataacgttaactgtcttttttctgaagatctactttattctttctcagtattatcggagttataggactgattattttcctgtgaaacacccagttacctcatttccttgaaaaataaacaaatttaaaatcataacaatcacaagtagacagtatgggcaagcccttttaaattggacaaaagatttctcccctgactcctttatccctagaactgccccccaccgacccttgatacaatctgtggtagctctgttgccgcttgcccttttgctgaagattcacagaggcgcactcctgacttcttgacactagtgatactttctagtcgctttcagattattactgtgttttatagaattctgagatcatagaaataggtggaatattgagactatatctcactatcatatttaggcatacaaataaaacagacacttcagaaaaaacttatggcccttggtgtctccttgaagccccagacgaagcagtgaaaagcccaagggtgctcagaaggtggcgcctgggatcggtgtgggcgaggtgggaataagctgctatttcccattatacttacttttttggggaaagagattctgtgtttttcttattaatacctaagaatatgttctctgattctctttttatctcactaaagaaacatacctagtttaggccaggtttggtgggcaacatggtgaaattgcacaaaaaatacaaaaaattagccaggcttggcggcgtgcgcctgtagtccagctgctggggaggctgaggcgggagaatggctggagcctaggagttctgggctgcagtgaaccctgatcatgccactgcattctagcctgagtaacagagcaagaccctatctctacaaaaataataataaaaaaatacacagtttcatgggggacattgaaatcctgcctgttgattcacagtgtatgaacgtgattaaaatgctgaggaagttagctcttccaacccttggctctatttatggtttatgtcatgagaattagaataaccagaacgtttcaataaagaaagtaattgaagatgagggtacagtttgcctcttgtacaggaggggtctctctacggccttctatttagagatgagcagccagttgttttctgggtaatctgcagattaagccctggtccactctggtgattttttttttctttttctgtttttgcagaatgccttcagaaatcttgctgaagatattttcctacttggatgctgtgagccttctgtgtactggatgtgtgagcaggcgcttttatcatctagccaatgacaagtaagcagaaatccaagtctctgttatgttttgatgacagtttgatggaagtcaggaaaactagtaactttttaaccatttttaagaatttaagagaattcaagagtatttttacacacaagtggaaatgtcaaatgctttaactatgaaattttcaaatatttgcatttatatgcttaaaggaatatactttgcatggaacaaaaaaatcaaacttgttattgctgtagctgttacagaatgcagcttcaggtctgttgccaggaggtcttcgctgtattccccacagaatcagacctaaccacagagtctcaagcagcactgcagggacctgctggctttgaccctagccgtgcattcgcagagcagaatgagtgctctctgctgatggccaagcagatcctaaagaaagagaaggaagagactaagttaggtgtacttagcttctcctcccaaacatgccaatcaagttaacttactctgtggggagagcgaaatggatagagagaggccaagactgtcctctcctagaggttgtacgcttggatgaagggagccaaaagagaggggttcacctgtggtcatctggtcttgcagggggtggatctaggaaggaaggggagaaacctctgcttctgtttgtcactataatcttagcctgcatctcagaattgtatcttggagggagagatggtggaatcctcctttcagtgaggatttcgtggcttacaacagaacatcttggctttttaggcccctctctcatttagcatcaaaagatcagacaaacatcattcctacatagaacctgcatgtcagctggggagatcagcaagatgagagggaatgccggttttaactgatggttttgtttgctaggtaaggagacggagagtggcagaatgagagctgtcatattagttaaccctggaacatggtggacaagaatgtcatttagtgcagtggttctcagatgccatccagggaagactacatatgaaccacctgggaaagtttaaaacatttccatccctagtctgcatttctagggattataatttagtgctctgaaatctgtattttaaaaattctccagccaggcgcagtggctcacacctgtaatcccagcactttgggaggccgaggcgggcggatcacgaggtcaggagatcgagaccatcctggctaacacggtgaaaccccgtctctactaaaaatacaaaaaattagctgggcatggtggcaggcgcctgtagtcccagctacttgggaggctgaggccggagagtggcatgaacctgggaggcggagcttgcagtgagctgagatcgccactgcactctagcctgggtgacagagcgagactccatctcaaaaaaaaaaaaaaaaaaaaaattctccaggtcatactaatgaatagtcaagttccgaaataactaatctagtccatctttgttgttaggtgtatgccacttaagtgaggaactcagaataagccctcagatctcattaaagctgtcctcaaccattgtcatactctgaagaggacatacactgttccctagttggaaaggggggattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtctatgtcaatacatgcacacacacacaaacacacacatacacatatcaatgaatgaactaataatgttcttcacagtagttatagaatgaattagagcaatttctacatttcccttccttaatgattgttgtagtttacgtagttgagatttgtttgtttccccaagcctcatgttgaaatttgatccccagtgttggaagtggggcctaatgggagtcatctgggtcatgggaacagatccctcctgaatggcttggtgccttccttgtagttcttgctctagagctggttgtttaaaagagcctggcagacctcccttccttctctcttgctcactcactctatttctctctctctgccgtgtgatctctgcacagttggctcgccttggttttctgccacgtgtagaagcttcctgaggcttcaccagaggcagatgctggtgttgtgctccttgtatagcctgcagaactatgagccaaataaacctctttcctttgcagattacccagcctcaagtattcctttgtagcaacacaaagagactatgacaatgatctaataagagatgaaggtggtcactaaaagaaagcacagcaaggcatttttcaaggaaggagtcaaccaaatatctaaaactagcattctggagggttcccactttatttaagggtagaactcagactcttcagataagctgatacattgtatatttcttagtttctttactgtcttctctctccacttcacctgcatggtgaagaaaccaggcctggaatcagatttggagcatggctctagtgatgttttttgcatacttttagtattatttgtgtgccctcctcactttcttggaagttgccgtttggaaatatgagctactgatgaaattgcactcacatttcttttctttttcaaaagacatatttaattgtgctaagttgaattgcactttttaggtcctgttaaaggacctaaagagtcatagtctgactcttaaagtcaacgtctgatcatgaagtcagactacagaaaaggatgtgtgataattgaacaagtaatcaatatgtgtttttgaaaagtttacagtgtattctaagcgttacttctgaagagagggcaagcacacatagtgtagtgagttacactgatgacttatgggcaggcacacttgaagggcagggggctccccagtgccccatcccagcagcggggctactcccttctgtgtgagccctgtctctgcgtgagaaaaacaggggtgtgtggatgaggtgacatctggtttatcacaagggggttttatttgccatgtactctggcaaacactatttatctgaacattaaattggccccattttctaaacaacttgtttgagtttccctgagcctgttggtagttctgttggataaatatgccctcgtcctcgaatctgactaggccttctaacaggatggagcatttggggatcaagaagtaaatgtgtttggagactgtgaaaggtatctgaaccttaacatttgtatattataaaaaatcaaggggaaccatctgcaatataaaatgttttcacttaggttcacttacggtaagtaatatatgatcatgtatgtgaacatagttcatcatacgaatgttagttgtggttatggttactcactgcatgtggagtttatgctgtgattcccatctctgcggcagtgtttgtttttgcagttggtaagtgctaacacatgtaaaaatagtatcagaggttgtttagatagtgctgatgtgaggaattcaaggctccataaaggtcctgctaaaggaatacttacatagggtgagatgctgaataaaataaatgtgaagaaaacacaagcaagcttttatgcaaagggagttttaaaagtgtctattcaaaggattttggtgaaacagtttcagctttacttaaatgtactcaactcatcatcgcattgcatctgtccgcttacataggaaagtctagaaatttctgaattgaaaacacaaacactttaatataaaagctaggcatgaagtgattttgcagagtgagaaatgactgagaaacccacactaggaagagaattcaaccagggtctgactgtatgtgagcttgcatttgttgggaagtccatgtaatgtctgagtcaaggaggtggtgttccaaagtcacgtgtttgagaaatggtccttttctgctgtggttaaggaaatagctctgcctccccagagcacccagttatccccaggggtcctgctgcagttcaggaccactgctctgtgggggaatcgctttttccttgcagcctccaggccgttgactgcttcatcccatgctgctctgagtagtaatgtggagacctaaatgagcaaatcattaatgtttaaaatgcaaagtttgcctttcagataaggaattgattttaaccgctgcctcagttttccctgtgtcttccttctctttcctggtggagagtactggctgagagggaggagctctcaggccagctcactgccaccactcgtggggcttctcctgccctcttagtagagatgagtggaaggaacagactttgagtcagagctgaatttgaattccaacattgaggcttattggctctctgaatttggggagcttattcagtttctttgacccatttctttgtgattgaagaggcagtgaaacccaggtgataagagtgtgagctctggttccgatcccagcttcactatacacttgagtgcacagacctgggccagctcaccttgcatctgagcctcagttacagcatctatgcagtggggacaggaataccagcacctcctggtttctttctgaggaataaatgagtcatgtataatacataaagtggttaaacgatgcttgacacatagtaagtgttgacaaaatttaatgttaactattgtttagttgttaccattaaaaaccttcactttttttctctttgtgaaagcgtattccttgttgaaagttaaaaaatagcaaaaagagtgttcaattccattgttccctattgaaatttcttggtgtgtgtacatacatcctttctgatctttttaaaagcatgtatgtatttaaaaacaagaatcatactacatatactttctgttatgtttaaataatatatttcctattccattactggtataagagggcagtcgtttggatgatcctaaataacgtgagattactcacttgagacctgaccctgggaaatgggcttttcctttttttaaaatgtgtttttggtggtgttgaatttaaaacactaaatctcaaactgcaattcactttaacagatgaacgttcaactgtaaatattcagcttggcttattcatggaattggattatttgaaaatatgcatctctaatttgatatattatgactaaggtaggtgacagtgtctcttagttaacatatttcctcttttccctccagttttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcaggtacgcagtgtgttccaaaagagaatgatggcatcagctcaaagtatcgtgtacgtaggacgtatgtgcagtttagattgtgtgggactgtctctagtatttttgtgtgttttgtgcatctataaaatatgtatcattttcctattccgcatagccttctgcatctgctgattcaaccaactgcagatcagaaatattagtgggggggaacttgaaacaataataacagtataaaaaagaatacaaataaaaccagtacattatacataataacaacagtttgcacagcatttacattgtattaggtattataagtaatctcaagatgatttaaagaatacgggaggaggtgcataggttatatgcacatactatgccatttatataagggacttgaacgtccacagattttggtatcatggggttcctagaaccaatttcttgcggagacagagggataactagtaagtagcctaaagttttaatgaaaagcagaagtaacctacttatctgctatagtacaataagaatgttcaaggtctcttttctgggcagaacctttgtcttatttatatattgccagtacctggaaaatcatggatgttcagtgggtgttaggtgaggagaaaaagtctaaagagagtactattgttgaagtgaaaattatactgggcacattctgagaattttgactttggcttttaaggaactagatgctttagagaagatacatgaaattgcctttagcattttttttttttcaatgaggcaaacattgttagtttttttttctttctccagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacataggtaagtaccaatcagcagaactgttgagtgagagcatcttatatgtaaatattagttggcattacttttgtaattaaaaaataagagcagcgttttttaattttatcacatattaaatgtannnnnnnnnnnnnnnnnnnnnnnnnnnnnnnnnnnnntggggttgtctttaatggtaaaagaaatgatgttctagttaacaaaaatttcctgaatgattgatggctaacctttgaggtttttcattttaaccatccttaacagaaaagatatatgttatcttcccttctttagtaaatggtatactaatcatagtctaaatatgaggaaaccaagtcataattatgagttattttgtctgccttctgttgaacttactagatatgtgatcttgtgcaagtaacttactctttctgtgtctccattctctcctctatgaaatggaatgatcgttatactggcatagtatttagcatatatgactgcaatgaataagatcgatcaaaagatatcactataaaatgcgtagatcagctaagtgtgcagcacatgggtaatgcttagtgagccctttactattctgttgtcaggtggctttgcactgagtccatactcactatgaggctggcattctgcctttctgagcagctctctcgggctgtctttttcatcattgattgcttcctcctaaaagctggattatggcatgcatagcatcctcatctctggagcaagctaacatagctttatataagatatattgcaaatataaaggtaatacctgccttctcctgcgttggtttcctgccctcccatctccttcactgtctcagtattctttgacttttcaggagtatttaccatgtcgttttcttaccatccttgcgtgctgcagttccacccattggtttctctcctgtctgtccttgctatggaggatactgtgatatctgacattagtgcctgccatctctatggagggacagggttcttttcatggtttccctggatacagacacttttttttttttttgcagctctgtaactggggaccttgtttttggctcctctccatggcgcctgctctttgagcattgttttagtgattactgagctctcttcccatgctctgaatgtaagactattcagacctcttggtgctggcaaatccaggttttattgtactctaaaaatattcttaatgttatgatgaaaaatgaattatttttcctaaatatattactgaagatactttggaaacagttaccttttaaaaaatggtacttttatttggataaatctttgaaatttcatacgggatcatgaaggaagccagctttttctaatgtagtaattaggctttatgcatttcaaaattacgtttggagaacaagtccacaaactgtactagttttgctaaacaatatgttacttggcatatcatgaaatgttacttacagatattaggacaaactggctaacattaattcaaatgatcctgaagaattaagttaaatggataatgttgaattataaagctcagttaaagacagtatttccctgaaatggtcatcaaggtcagaagtaatagatactacatagtgcccaatgctagaattcattgggaaaattcatttgatgtaatttatttctgtgaaacttccatggactccagccagcctttgatcaactgtgataaacaaaactaaaagtgttttttaggatttgttttgatcggcacttttattgcaagtttgtaagtgaatgctttcattgtgcaggaatataaatccttgtacgcatctgtgtgacagccaaaaagagcctttgtgatttttatttgggtcttttttgtttcctctatgagaagtttttcaacaacagtgaaagcctcattgatgtaatctggatttccctgtaatttatacctttctagtcagactccaaattttcttccttgccagcactttctgctctgcagcttgtgctgtcccaccctaaatttgtgagaactgctggggaaacgtcagccttagtttctgtgtctgtggctgtaaggccaagcacatgaggactcagcacattcccagagtctatttaataagtacctctacagccagattttcagagaagaaggtttctcacatccccacccagcctcctctatccacattaatgatactagcagggactgcgatttattgagcacctgccccatgccgtgtgctcttgtccccactcagcaggctggtgatttcatacacaaagaaccagcctgtgatagtcgcaaagtcactgtaggttgaagctaaggttttacctcaggtttctctgactccacagtgaggttcctgaccctgcatttatcctcctccaagtgtattctgcatatgctgggtttatttctaatttctacatcacacacgttcaccgaccgtctctccttacccagttgttgttctctgcacaagaagttattttgaagagctgaacatgggactagggtcatgtggcagctgcggatctggttttgatgcttcacagtcccttccactttgaagctggactgcagctggtgtcctttttaacttatttatttaatgtacctttgaattcctattgcctgctggcttgtgcctgaggtgctgggcaccaactgttgaatgagatgtggccccagctcctcagggatttcagtctaatgctgtgttagtgtctcctttatgaaaacactggtgatttagtttaagtttatttctgatgtgtcaactttcactatctctgagttatccttgatgataactgtgaaaggcccatctgctttccagccatctcctgagaccacccgttcttatgtcacttgaaatagtgtatctttgcttctgtgttgttttactcacttgactaggaatacacattgagagtctactttagattgtattgtgctggatttggagggaatagaacaggagacaatgctgccacttcatcactttcctggtccttcaacttcctcccggctgggtcattgagttgacagtaagagcaagacggaggggaagaaatacctagttggcttggaaatctgaatgtatccattttgccttttattcatttgtgtcctcaccctgccaacatgccacttagtttgagcacatcattaacatgctcttcaaacacatttgtgatacactaaagagaattgacaacactatggacaggaaagctcacttctctctctcctttccttggcataacgttcaaagactccgatggcattctttaattgcaaagtacaatctgagtcatttgaccatatctaccatgattggctgtgacagactcattcggatcttctgcctgcaccctggcctcctggtgggagtgtggaaggtaagacttgagtccctgtatgtactgtgtcatttccccatcacaataccacatttacttaccattatgtatgacttcaaatgtaaaatcctttaagcttttcactaactgcaatccattttaccatctcaccaacttcattttttcaagctaacatggccctctctgttccaccgaggctgctgtgctgttctgctatgatagacaactctgctatctgttgttctgctgttctgctatcatagacaacaacctcttcctgccttcatgttttccttcatgttattcctttcatgtcatgtggctttcccacttccaatcagtccacgttccttcttctcttcctttcatgctctttctctgacaacatttcccttactatgtgttcagcacgcttgtctcccaagcctgtttctgatcctgtaggtgcggcattgagtgaaatctgctcttcagggtcagctgtctacgatgttatcctttctctctgcataagatttctcgtttcaccaggtctggctgatattttaagatagtagttcacaaatctgtttctgagttggcgttatgcattagtttacaatgactagacgggattaagaccctagcttcagacaacaccatcctcatcccttttccttagccaactgtggccgtcactttttctttccctcctcccctttctgtgtgaaggtggcttgtgggcgagaccgcagcttgcctgctctgcattcggtgactcgcatgcatccagctttgttggttgcagagttgtgagcactctggtggcttcgattgtcctctgcctggctactggagagtggcaccttcaaatttaccatttgggggtcacctatgcccatcagtgtcagctgtgaatctggggagaaatggaggtcagtccccaaatagtcgcattttctgctattcaacctcatggacaagtgaagaagttgaatctaatcattcccaccacgttggccaaatcaagcagttacttgcaagaggaacattgtgtcagtaaagttcagtatttgtagaattaatctggtatctgtgaaagtctttgaaaggaatttgaaacagcctggaactaactgcatagtttcacaactatcatatatatcttttgatatttcacaagctctaggctgtgagttcttttggtcctgtgtgctctgcatatttgggtgaattgtggtcctgctgtcaatatgaaatataagtcttattagatagtagtaacatattagcagtaataatgcattagcactgtggtgatcttatgtttgtaagaaagtgcctctatctgcaagatgaatgtgctgtgatcttcacaatgatcttgtgaaaaatgtaagcattttggttgaaatatgtattcttctcaattaacttttcagaaggaggaagaactggcttttgttatggcaaatcttcattttcatcaccttgtggagaggagcacattaggctcggctactatgtatgtatttatatgtgggtgtgttgaatttttgtacagtaaatataaagtattagaagttgatgccatcttaatatcctgagaatagctgcagagatattctgtttttaatcagtaaacacaaaccaacaggcacaattagctgtcgctaaaataattggattattcacgagtacatatttgctttatttattctgggtcaaggaatttgtacctagtaggttgttatttgtatgggtaggatagcttgattacttcaagatgccactactgtccttcaagttcttgctcttatgtgaattttcacatcttgtaaggcatgtagactcatggcccttgggctgaacctggcctgcggatgattctgtccggtctggacagtgtgtgtcttttaatgaatttgcgcgtctttaggtggcgcacaggcttcccatttcactacagctctcacccttttcctgtggacttagactcccttactcattttttttttttttaattacctgagaagctcctgagtatttttgagtttgtcaccttacgtagtcatgtttttcttgttgaataaaactttgtcttggctttgggtctgcctgggtgtttgtcctgcagatcggtattcagtgccttttcctgctgagcacttttgtcccctggacactgagaacaacacggagggcagagtggcttttatagagtggccatgctgggatcagctgcagaaacatgtgcacccgtgctgggcggtggctgcctacagaactcacatcattgcctgtttttatagaagttggtaaaagtaacattgagcagtcttttaagttcacagtattgaagattatagggaatcctatggagtttcatttgtaggaggtagtgctttgatacagatggtaattttttaaaaagtattttcaaaccaagaattttatccctggtgttgacaaatttgtatgtttcttttgttttgcttttcagcccctatgaactgcctccacatagcccctttttggatgatagccccgagtatggactgcacggctaccaactccatgttgatctgcacagcggtggggttttctacctatgtggtacatttcgcaatctcttcaccaagagaggtgaaattgattgagtttttatttcattatgaaattaaaggttgaggtgagggaaccaattttgatgtccgagttaagaattgccctcactggtcactttataatcttttggcaccagtatcctcccagacccgtgtgtcatcccagggcttgtgaaagtcctcactggaccgagtctcttcagaactggctctgtctccttcaccaccatcactctcaatgccaccttctgggggtagcccctactcatcttctctactgatgcttccttattatttttccatgctctctgctttccccagacttcttcccttctttcttaaaggaatgtggtaaatttgccagcagggcccgtgccgctccaggatgagagtaaagagaaaccagcctttctcctctacgtactgcatcactgtttgccacacctaccaaagccaggacagaggctggggcagacagaggaaaggagggagcttacgccaagcaggaaaaacgagggagtggagaatgccccattctcacttatctgattatttccttttggtttcattctactgtagcctgtaaacttggagtttcatgtaaggacttgcttagattcaagtttaacatttctggtaaaaatattttaaaagggaagttatgtacttcattttgcattatattgagaggtatataatgtcaggttgtcccattattagtaatgcctggttttatcatctggttaagatggtgaccactagatatcttcattattaaaagtattcttttccaaatatcctggtcctccaaagtctttcatctagtggacttgacactcattaatgatatgtgcctaaatcaaatattttgtttaaaaatgttgattttctaattatgtcactatttctatatttatcaactgagattttgtaaagaactttctcttatcacctgggtgaacttctataaaggcagagcaaatgcttaattctttccttttaactgccaattttcagatgaagaaattgatgttacagagcacaaggggcttgctgcctaatgtgctggaacccaatactgtgacagcaggtttttgagaaaggaaaagctttttatggctggcccactgataaggagacaggagtccagctcaaatctgtctcctcatgctggctttaatgcagtaattttattagaaaaggtgtagggagtggattctgggattagtaggtgatcggtggaaggaaagggaggtctggaaagtcctcaggcatggcgcagttacctcttcatgccctcgtaggtcacttgcaaattcaggaggagttaatatgaaacatgtggtgggaattcaggctgtgatgtcagaaaactccatctgtgaaaactccagttggccatattggttccgactgatttcagccagttttatcttacaagtggagggcgttttattattttagtaagttgcctcttttcttatctgccatcttgcaaactcaagcatttctgttagtcattagcttctttaactctggagcatggtttcactgaggcactagtcatctcctgtggtggaagaaatgtgagctcttcttctttcctcctcgcccccacccttgtttaatgtcactttggactcttggatatttatttatttaataatttatagtcagttatagacatttctttttgaagttacttggtcggtgggatctgctttgggctgcttctgtgtcctgtagatatcctctttgtctttgagtcttccttgctttttggctcaggaagattgctaggttttctcgcgtttgttggcatttttatcagaattattcaattccacatattaacctgaggtatagtaacatctatgttgttgaattgttccatccaagaatgtggaacatctttcagtttgtttaaaaatacttttatgtctttgaggagtgtttcagaattttcttcatgctagttttgcacatttcttgttaagatatttatgaagtatttaattcttgttacttctctttcgttttatcttccagctgttttgtgatttctttgtgaggttttggtctcatagaatgaattgggaagtattctttcctcttggattttttggaggattttgcatagaattggtagtatttcttccttgtttggtagaattcatccaagcctggacctttctttatgagaagacttttaactacagtttccttttctttcaaagagatggagctatttaggttatccatttcttcttgagtcagctgtggtattttttgtcttttaaggaatttgtccattttatctaagttgctgactttattggcataaagttcttcgtaatagtcccttattatctttttcatgtctatagaatctagtgacatgatgtgattcctgatattggtaattcatgtatttctgtatttcttttttttcctgatcagtgtggctggaagtttatcaattttattcatcttctcagatacctaacttttggttttattgcctttttttctgtattattttgttttgtatttcattgatttgcatgttgatttctattctttctactttttttctgcttatgttgtaattttctgtttttctagtttctaaagggagaagtggaaattattgatttgagaactttcattttatcatattgagacatttggtgctatgaacttccacctaagtattgctttagtggcatcccacaaaatctgatatgttttatttcattttcattcactttaaaatactttctaatttcctttttatttcttctttgatatatgggttagatagaagtgtgtaatatagtttccaaatatctgaggattttctagagatctttctgttactgagttctaatttaactcaattgtggtcaggaaatatgctttgtattacttgaatttttaaaaagtgactgaaatttgttgtatgttccagaatatgatctattttggtatatgttccatgtgtacttgagaagaatgtgttctgctgttgttgagtagagtgttcgaaaatattaattaggtaataccggttgagagagttgatattttttgcctacttgttttatcagttagagagaggtgttgagatctccaactctgacagtgaatttgtgtacttttttgctgttttatcagtttttgccatgtgtattttgaagctctgttatattcatgaacactggagactatgatatccctttgactaagtacacactgtgtacattgttgagggtgcccccagtgtgccctagtgcacaccaagggtacaaacgctgtgccttctatgccagtattagcggagaactgagtctctgctctccatggctgcagccctcatggagtgttgaattcggcatctagcctgacctggtgccaccactgtgggcagctggcctgggaaatgggggaacaagatgcgatttccacagagatgaggtgagatggctgcctggtcccagccacagctgctcctcagagctctccttcccctttaaaccttgtgaaccgttacagagccctgtgtgtccccactctgcctcccccacctcagcccacactgctgccatcccctctctggccttatccttttctgtcctccccactctagctccgctgcagctttagtgagttcctctctgttccttgactgtatcaggctttctgtggcctcacattcttggtgtgcccctcctgcctgcagtgttactgccccagatcttagcgtgggtcctgggggtcatgtctctctgagcctgattcactgacagcttctcagtgaggctttacccactttgctacacctagaagccctcactctccccatttctcacctgcctgcctcaatttttcttcatagcactgtctatcacactgagtttacttatttaggtagtttatatgtttaagagaagtaacttccatggggcagtattttggtttattttgttcaggactgtcatggcacatagtaggcttgcacataaatatcacaaagagaatgggtggctcccaaaggccatgcagttgaggggctcttagatagactcttctgggcctgttatcttaaagctctttctgtttctttagctaaaggattctcagccgcattggccaggatctttttggtcaaagctcttgcagttctctgttgcctctagaggaaaagatgcagcttcaggatgctgcagagcagagctgcaggctggcccttcttgtgggaccaaagcaaggcgacagcgagggcctgagcctctccaccaggagtgggaagccctgccctcatcccgcctcccagggcctggggaggccccaggaggctggtggggcctatttcctaggccactgtgctgttccagagctgccactgctggtcttccaccactgccttgattccttttctcttacaacccagaggaagggcatcagagttccccttctaaagtacatgactgtgtacttctctctggaaataaaaagcctcacaaattcaacgtctggcagagtactttctacttttgtacctagggtaggttacttggctacacaaataaaaatgaaatttgtgtttaggtacttagtgtctatgtcatcctctcattacaaggcaaacatcaggaacttgtgccatttctcatctgagatggcttataagacatagtttttgcagaataccaactgttctataaaaattgcttccaagacactaattatattactttcagttttaaaaatgtttattttgaaataattttacattgtacagagaactcctgtacagtctttatacagaatttattcatttataacattatttgccattaaaaaatcatttttctttctctttctctctctctctctctgtgtataatgttaatagaccccttgatgtttatacaacatgtgtgtgtgtatatacacatatatatatatatgtgtatatatgtgtatatacgcaggtcataaaatcgtcaaggggaatattaacattctgaatctcaaagtgccgggattacaagcatgagccaccacaccctggcctacctttatgtgatgtggtgtggtggctcatgtttgtacctagcaatttgaaaggctgaggcaggcagatcacttcagcccagaagttccagaccagcctgggcatcatggtgaaacccggcctctacaaaaaaatacaaaaattagctgggcatgattacatgcacctgtagtctcagctacttgagaggctgagggtgggaggatcgagagttccagggttcagtgagacatgattgtgaccctgcactccagcctgggcaacagagcaagaccctgtctcaaaaaaaaaaaaaaagaaatatgtatgtagaattctgtatgttgggatccatacgcatgtagaattatcccatcactctattcttgaggagttaggacctgttaggtgctaggtctgtctcagtggactgtctagaacttcagagaagagggctcgccattcactattgcaaacaaatacagcatagcgttgattaatttttatgtttgcattcctcatacttaaaatatgcccttaataatgatgaatacgataataatagggaaaatttttgagcactcattataggtttctgctaaatgtttcgtgttatttcacttccttttcacagcacgcctgagctgtgggtactttcacctccccatgttattgatgaggaatcagaaggtggtagagagtcaggtctgtgttctgtaaagctagtaggtggcacagtctgcactcaggtccgcgcgactccagagctgggtatgtcctgcttcctgtaatatgcttcctgtatatttttgccttttaaatgatgtgcttttagagtgtatcttcttgtgtgtgtgtgtgactgtcagtgtatttccaaagttttggcactgtaagtgtggtcagggtaggctgttgacttgctggagtaacatttaagccaattttgtgttaacgttaataaaccccttgatggttatatgattgttataacgcataagaggttaagttaaatgagggagaatgggaaactgagttaggaataattggccttttgtgattttccccccagtaaaaagatgacaaagtaggatttccaaggtggactcaaatatatttctacttcccatggttgcactactaggagtcagcagagggtgctgttgccatcagagtgtctttgtaacatttttaaaagtattatacaaatagaatgtcctctgtagtttttgagaaactctcttgtggtaccatgtggtatatttagtaaatttcagctatgtcattgcgtttgggtataaatcactttgcccccattttttaaaaaagcctttctccctatcaaggataaaatgttctgtcgtcacgtctgtggaatgtaggtggctctctgctctcttcatcctccgagagacctgtgaagcctggctcgacgctaaccaggcaggctgtagggagctgcaggaagtaaagggatgaggctgggtcttctggggttcatctattaacaaaccgttattgaatgcaggacatgggccacacagagggaagccctgcctccatgtgatccctgcctgatagggttagggacagagagaggcttggtaatccaggcacaagcatgagtggggaggggtggcatgagggatttctggaatgttctgaggaagggcacaccaggaggagctggggtggggatgaagtgaccagttgcagtgtccagacaggttactgggagggtccaggccgaggtagtagggttgagtggaaaggataaaacttcaactatgacataatttattaatagagccagaatttggtcattctgtatggacatttccaggattctatttttgaataagggattttatggatgctccaattaagtccaccaagtcattgcaatcctattaaaaaccccaatagaaatttattatcaaacttgcaaagtagcatctaaaaaatcactttggaaatgcacatatgcatatgaaatggctgagaaattttgtttcaaatttttaatgagaaagtataatcttttctatgtatacaggctacagaaaaacaatacaataaaaaatcatgtagccaccacagtatagaaatagaccagtaccacaaactttgaagcagcctgcatgtccccaacctgctctcatttgcttcttttcctgccagagggaaccaccattctgtctgttgtgttaattgttcccttgcttttccttttttttggtaattaaacatctttgtattgtgaaatgacacacagagaaatgcataagacagataattgtaaagaaaacacctgtgtgatcaccatccaggtcttaagttttgaaaatgaattgagagggggctggcttagcagatgttaaccactctgaaactacagtgaccaagaaagtacagtatcactaaagaaatagatacccaggagagtggagcaaaacatctttcacatcttttgcagttccagatttttctgtcaaattatttttgtgtacataaaccctttattcatattttaataaatcttagactcatagaaaaagtcatgagtagctatttaaattatacattatgcattatgatatatctatatatcagtgtatatcttcatcctttaaaagatacatatgtatttctttagaaagtatggaatgcgttgtgtagaataatttgccttatactggctaaaaggatctctagaattgaatatgtagggaatgcaaataatcaaaggattcgtgtttgttttcaggcagaacaatcccagtgaagtattcagagtgagttctggcaatttgatgtcatccacctcttggtcacgatattttctctgaacaaaatatcccttagttctattttcttaactctgtcccatgaactttggtacaaggtcctttgattttttttcagtgtctgttactaaaaacaaaccagaagaacccatttaactcttggtgcctgggattaggttctcaagtcacagagtgggaggaatatttccaaactgactcagtggtaaatgctcagaaataagcatcacctcattggctgaccagcaacatctcccagctcagccagtgctgcagtcatccattttgaggcaacagctcgtgtctcttagctttgagttctgacatgtctccagcgggctcagctcccaggccagtggacactaagttttgctctacttttcttcctctgttgtcctttcagatctgaggatgttctattttggcgtggttaggaggaccgtaggtcctctaattccataaaatattgctcatgcttctagacattatctccctcagtaagaagctgtgtctagggaaaggctttttgacctctcagcactacctgatagtgaataaaaaggatctgtgtcctttctttttttccttatgggtttatttgactgcttctccttggaactttgtcatactcctcctccaaggaactgggaagtgtcctttctttgtatttttatgtgttctgccactttgtcaagtcatggctatgtggaaaattttaaaaaggatctaatttcttttcaaagaaaaatgtatgatccctagacttgcacatattgttacctgcttctttgtgtattgccactaaaattaagttaaaaagaagtttagatgaagaagtattttgctatctgaattggatttatgagaggaaagagggaatgtgggtaaatagtgaaggaaatactgaaagagtgatttgtaaatgaaaacttaaggtgaacttgtaacagtgcctgtgggtttttctgtatagcttttgttttctattcttttggaaatgtaaatagatgacattggctccctaatttcagtgattcactaggaggactcccaggactcaggatatagttgcattattggttaagatttatgacagtgaaaggatacagaacaaagtcagccaagttaaaaagggcatggggtgaaatctgcaggaaaccagtgcaagctaagagtccttccccatggagtcaacacaaagtgctcttaattcctccaagaatgagttgtgaccagacatgtgaaatgttgtctatcattagacagctctaatgagagctcattagagactcagcaccccgggtttttactctgggcttgtcacataggcagtctctgcctggcactagcagaattccagactctcagaagcaaagaggatgttcagcattaaccacactgtacaaattgtttaggtacagggaccacccttactggttagggaatggtgggtgagaacactcctgaaatccaaatgcctagaccacatccaagggccaggctggcaagcagatcttcctaagaattgacagtatgaggcctgctgtgtgaactattttcagcatagctgtccatgagcactttgatgaggtgatggtgccaccctgtgaaagagaagacaggaaatagtccagttgtgtctttgaagtgtaaatagagcttgccaaagggcctgatcagcaatgcaaagtatgaagaaatgtatatttatttgatctttgtatcaggctaatgattaccaattttcagaagctgaaggaaaaatgttttgcatggtacagtatgttgtagtatttttatcagtattgagaggaagaggaatactaaagaatctaagggaggtaaatcttaaataacaaagtatgctgcttctatcatttgagtttttctaaaaatagactgtactttttagggcagttttaggttcacagcaaaactgggaggaaggtacagagatttcccatatagcttctgccccacaaaaccataacctctcccattattaatatcctgcactagagtggacaatgttgacatgtcataatcacacaaggtcctaccatagtttatggcagggtttactcttggtgttatatatttaatgagttttgacaaatattaatggtctgtattcactattacagtagtatacagagcagtttcactaccctaaaaatcctctgagcttcacctattcatccttccctcctccctaattcctggcaaccactagcctttttgctgtctccatactttttccttttttagaatatcatatggttggaatcatacagtattaaccttttcagaccagcgtctttcggttagtaataagcatttatgttttctccatgtcttttcatggcttgatagttaatttccttttagtgctgaataatatcacattgtctggatgtaccacagtttattcatctactgaaagacatcttggttgcttccaagttttagcaattatgcataaagctgctataagcatccatttgcaggttttcatggacacaagtttttaactcctttcagtaaataccaaggagtgtggttgctggatcatgtggtacgagtacgtttaattttgtaagaactggccaaactgtcttccaaagtgactgtagcattttgcatcactaacagccataaatgaaagttactgttgctccacagtcttaccagcatttggtgttgtcagtgtcctggattttggccattcttttagattcttttggattttctaccaagatggtcatgtcatctctgaacaaagagttttatttcttccttcccaatcaggataccttctatttccttttcttgtcttattgcattagctaggacttccaggatgatgtggaaaagcactgatgagaggagtcatccttgctctgttgctgatcttaatgagaaagtttcgagtttctcaccataaagcacaatgttaactacagggttgatgtagctattctttattaagttgagaaagttcccctgtattcctgtttttttcctggattttgttgaatgctgtttctgtgtgtattgttatgcttatgtgatttttcttcttaagcctgttgtgtgatggattgcattaattgattttcaatgttgaaccagctgtgatgaccttggagaaattctacttgatcacaatatacaattatttttctacattgttgaatttgacttgccaatattttgttgaggattgttgcatctttattcatgagagatacttgtctatagttttcttttcttgcaatgtttttggtttcgaaattagagcaaagctggcctcatagagtgaattagcaagtattccctttgcttctatcttttgaaagagattttagagaattgatattatttcttccttaaatatttggtagaatttaccagtgaacccatttgggcctggtgttttctgttttacaaggttattaattattgattcaatttctttaatagctataggcctgttcagattatctatttcttcttatgtgaattttggcagatggtgtctttcaaggaattggtccatttcatctagattatcaaatgtgtgggcattgctttgttcatagtattctcctattatctttttaatatccatgggagctacactgatattcccatttttcatttctgatattaacaatttgtattctcttgttttttcttagtttaccttgctagatgcttattgcttttattgttatttccaaaaaaaccagcttttggtttcatggatttttctgcattgatcttctgtttttaattttactgattattgctttaatttttattatttcttttttttcttcttagtttggatttaatttgctcacatttttctagtttcttaaggtgtgaaagcttacattgttgatttcagatctttcttcttttctaatatatgaatttaatgccataaatatccatttaagcactgcttttactgcctcccacaaaatttgtgaagttgtgttttcattctcatttacttcaaaacattttaaattttttcttgggatttcttttttgacccctgggttatttagaaatctgttattcagtctccaagtactttggaattttccagctaactttctgttattgatatctagtttaattgtatcagtttgcagacgttgtatgatttccagtcttgtaaatttgttaaggtgtgttttatgtttttttttctttttttttttttttttgagacagagactcaggtgatctgcctgcctcggcctcccaagtgctgggattataggtgtgaggcaccgcacttggccaaggtgtgttttatggttttatggcccataatgtggtctatctttgtaaatgttccatgtgagcttgagaagaatgtgcattctgctcttgttgtatgatgtagtctgtaaatattcattataccccgttgatttatgacattgttgagttcacttatgtccttactgattttctgcctgctggatctgtcaatttctgatagagaggtgttgatgtctccaactataatagtggactagtttatttctctttgctgttctattagtttttgccgcagatattttgatgttctgttgttaatcacatacacattaagaattgttatggcattttggaaagttgatctctttatcagtatgtgatggcccctttttatccctggtaagtttccttgctctgaagtatgctctgtctgacagatagctacttatgttttcttttgattggtgttagcttggtatattttttttccttccacttaatttgtatgtatctttacatttaaagtgagtttctcataggcaatatatagttaggtcttgttttttttttctaccaactctgagaatctctgtctcttaattggtatatttagaccactggtgtttaaagttattatcgatatagttggagagatatataccatattttttattgttttctatttgttacttttgttctttattcctgtttatgtattctatgctttttccgcattttgtagttttaattgagcattttatatgattccattttgtcttctttcttagcatatcacttatacttctttttaaacttgtatagtggttgccttacaatttaccatatttaccacaaatccagtttcactttcaaataacattctgccacttcatggttagtgcaaataccttataataacaaaataatccaaattcctccctcccaatctttgtattactgctgtttctcatttcacttatacataaacatatatatatatatatatatatgcacacatatgtgtatatatatatatatatgcacacatatgtatatatattagaatatattattactactactgttttgggcaaactgttatctgttaggtcaattatgaataaggaagtgaaagcttttattttttcacttattccttcagtgctctttatttctttatgtagatctaagtttctgatctttatcgttttccttttttttaaattattatactttaagttctagggtacaggtgcacaacatgcaggtttgttacataggtatacatgtgccatgttggtttgctgcactcatcaactcgtcatctacattaggtatttctcctaatgctatccctcccccagccccccatcccctgacagaccccggtgtgtgatgttccctgccctgtgtccatgtgttctcgttgttcaactcccacctacgagtgagaacatgcagtgtttggttttctgtccttgtgatagtttgttgagaatgatagtttccagcttcatccatgtccctgcaaaggacatgaactcatccttttttatggctgcatagtattccatggtgtatatgtgccacattttcttaatccagtctatgattgatgaacatttgggttggttccaagtctttgctattgtgaatagtgccacaataaacgtatgtgtgcatgtgtctttatagtagcatgatttataatcctttgggtatatacccagtaatgggattgctgggtcaagtggtatttctagttctagatccttgaggaattgccacactgtcttccacagtggttgcactaatttacactcccaccaacagtgtaaaagcattcctgtttctccatatcttctcaagcatctgttgtttcctggctttttaatgatcaccattctaactggcgtgagatggtgtcttattatggttttgatttgcatttatctgatgaccagtgatgagcattttttcatatgtctattggctgtataaatgtcttcttttgagaagtgtctgttcatatccttcacccactttttgatggggttatttttttcttgcaaatttgtttaagttctttgtagattctggatattggccctttgtcagatgatcattttccttttctttgaagaacttcttttacaaggcaggtctagtggcaacaaattccttcaatatttgtttttctaagaaaacctttatttcccttgcacttttgatagataattttgcagggtagagaattcttcattggtggattttttctctcaacacttaatacttcaaatgttttactgtattctcttcttacttgcctggtttctgaggaaaagtcagatgtaattcttatctttggtcctgtataggtaatgtgttcttttcctctggtttctttcaggatcttaacatttttgattttctgtagtttgaagattatacacttaggtgtagttttggggagcatttatcctgtttggtgttctctgagcttcctgtatctatggtttgatgtctgacttttaacttggggacatcttcagtcattactgtttcaagtatttcttccgtttccttctctttcttcttattatggtatttccattgcatgtaaattacaccttttgtggttttcttgtagttattggatattctgttctgtttttttttttccgtctttttttttctctttgcttttcaattttagaggtttatattaaaatatccttaagttcagaaattatttactcagctctagcctactaataagcccaacaaaggtattcttcatctctgttaccgggtttttaatctctggcatttattttggttctctcttagagtttccacttttctgtttacattgcttacctattcttgcatgctgtctttttttaaaaaattttttttatctcttacagtccttagtctgttaatcatagttgttttaaattcccagtctgataattccaacatccctgtcacagctgagtctggttctgacgcttgctctgtctcttcatactgtgtgttttgctttttagtatgccttgtaattttttcttgatagctggacatgatgtcctgggtaaaaggaaccacaaaaaatagtaatgtggtggtaaggtgtgtgtgtgtggtaagcattctctagtcctttggttagatctcagtctctgagtgagcctgtgaccccagattgtgaacttcacaggcgcttctcagtcccccgctttacaacctccagaatggctagagagagggggctgcagtttagtgtttctcttccttcaggtaggttaggctctgataattcccctagtaggttattctctagttagtttctcttgaggaaaagccttgttaagtagcacagaatgctctggtacattttggtgttacctttcccctcccttttccagaggaatagaggaatatttttctgatactcactgtgagaaccaggtgaagcttctagaggtaaaactcacataagtgtgcccacaccccttgactgggtccccctgaagtttttaactctcagacttgcccacactgagtctctagcagcttatcatttacagctcaggtttcccttttttttatactggttgctatggaggttttggctcaatagagctacgcgtctctgtattctcctgtctgtctctccaattttgggacagtggtttgccctgtgacttcacttttcttatagatctaacaagacttgatttttacttgttaggatggagtggtgacttccaacgtttttaaaaatggtctggaaaccagtcacattttactttttatctgagttgctgttaaaatatttttttaaaaaactaatgtcttctttaacttcagcttttgaaattccacatataagtgggatcatgcggtatttgtttctctgttctttggttatttcactgaatataatgtcttctagattcatccatattattacaaatgacagaatttgttgttttttttttttttacagaatatcactgtgtaccccataaatatatttaattattttcaattaaaagtgaaataaaacaaaaaataattatctttttgatatgcgatttgaaaattcagaatatgtagaatttataaagaagcaaataatcattcaggaaaactattgtttatattttggttcattttcacatatatagctctgtttatatccttagacaacattatgtgaacaatattacattctttttccttttaaattgcattgtgtttttcaaatgccactaaatagttcttgaaaatttgtataatattccattgtttgggttttttataatttattgacccattctcctaatgttggacatttagtatccacttttcatgattatagcactgttatcatgaccattattttgaaaaatatctattgatttgagaggtgaaaaggacatctgattgttttaaatttccatatgcctgaatgttagattgactattttaaaaactgactatcacagaggtttatggtttttatagcaaccatattgcaggctgtttaaggggaatcttcttaggatctgacttcagtaccacctcttaactatgtgtttaaccttaatcaattaccacagtgtccttgcttgcaaaataaggaaaacattagtacctaccttatgaggtactaaagaatgcttcacatgtgcttggtgctgttattgttgttcattatcatatttcttttctaattgaatattcattattcatgttcaattggttccattgttttaaatgtttataagatttatatgcattacatttgttgaaaatcttttcccattttatcttttgccttctaattttgtatatattgttttgaatctcagaggtttttaattgcatgtcagtaattaatgttgcatctttcaaatttttgtaaatatggtaagttctactcttgaataaaaggcaaatactcagctatattttctttagattgagtatttctcctttttcaacctacacttccttttgattaacataaaaattacacatagcctacagattcctgtacccttacctcttaggattattcttgtctgttaagaataagtgcaccttcttttatctctactgggcaagaagatacttcaagcttttcttgttcattttgtcatgaaaatatgttcccaatataaaatttcttactaatgaactttatcaaagatttcttgattatttttatccatttatgcttttagatgtttttaatattcacctggccagattttaaaatatcttctttgtattttgagcagattcatattaaatctgtattaatttggaatggatatatttttatttggagttttcatctatccctccaactacagacataccttgctttattgttctttgttttattatgcttcacacatattgcatttaaaaaatattttgggggccaggcacagtgtctcatgcctgtaatcccagcactttgggaggctgagatgggcaggtcacaaggtcaggagtttgagaccagcctgaccaacatgctgaaaccctacctctcctaaaaatacaaaaaaaaaaccataagctgggtatggtggcacacacctgtaatcccagctactcaggaggctgaggcaggagaatcgtttgaacctgggaggcagaggttgcagtgagccaagatcatgcaactgcactccagcctgggtaacagggcaagactccatctcaaaaaaaaacctttgggaaataatttttttaaattgatgcctaatagatgtacatattttcaggatacatgtgataatacatttatataacttttgcagatcaaataatatacttgtgaggttcatcattttaagggtttttatgttagaaacatttgaattatttaattctaactattttgaaatatataataggcaatcatagactgtagtcactctactggtctaacactaggttttatctcttctgtcaaactatgtatttgtacccattaacttctcctcatctctgtccttccttgcctccagtaatgactagtctactctctgtcttcatgagatacacattttaagctcccacatataagtgagaacgtgcaatatttgttttcctgttcttagattattttacttaatataattacctccagtttcatccatgttgctgcagatgacaggatttcattcattttagtggctgaataatatttaattttgtatatatttcacattttccttattcattcagccattgatttacacttagattaattccatattttagttattgtgaatagtgctgcagtagacatgggatggtgcagacatgttaaagcactctattattactgtattgtatcctgtcccttcccttagatctattaatatttgatttatataattgggagctctgctgttggatgcacagatatttataattgttgtatccttttgccaaattgacccctttatcattatttagtgaccttctttctccattattaccgtctattttatcctgatttgtagtttatttggtagaagcacagctacactttttcttttttggtttgcagttgtatggaatatctttttttaaccctttcatttcagtaaacgtgtgtcttcataggtgaagtgggtctcttgtaggcagcatatagttagattctatttctttatccattctgccactctgccttttaattggagaattgagtcaatttacattcagtgttgttactgataaggaaacacttactactgccactttgttgcttgttttctggttgttttgtaacccttctgtccttttcttcctgtctttttttgttgttatattatctggtagaatattttaatttgttgctttttatttttagttaatctattaataggttttttcattcttgtaccatgaggcttataaaaacatcttatagatataacaagttattttaaagagatgaaaacttagaacacaaagaaaagaatagacgcaaataaagaaatgagaaaaaaattacatactttaattaccactcctcaccttatgttttgacctttagttgtctcagtttacatatttttatattacctatctcctaacacgttgctgtagctgttattgctgatagatttgtcttttgggcttcatagtagagttatgaatggattgcacaccacagttacagtgttagaatattctgagttttgtgcttaattttaccagtaagttttctatcttccaatgttttcttttcacatattagtatttatttcttccagactgaataactccttttagcatttcttataagataggtctggtgttggtgaattgcctcagcttttgtttgtgtgggagatactttatctgtccttcatatttgaaagatagattttccagatacaatattcttggatggcaattttctttttctttcagcactttgaaaatgtcatttcattccctcctggcctgtatggtttctattgagaaatctattgccagatgaatttgtgctcttttacgttatttgcttcttttctcttgctgcttttaggatcctctctttgtgcttgacctttgagtatttgattattatatgtcctggagtagtcttatttgagtcaaatctgtttggtgttgtctagtattcttgtacctggatatatctttctcaagttttggaaagttttctgttattatttatttgagtaagatttctactacttgttcttgctcaactttcaatcgaacaccaatagttattagacttggccttttgaggtaattttctatatcttgtaggcagtcttcattccttttcattcttttttcttttttcctctgactaagtgttttcaaaaggcctgccttctacctcactgatacttttctttgcttgatccattctgtttttgagagcctcctatgaatttttcagttcagcaaaagtattcattagttccaagatttctgtttgactttttataattatttcaatctgtttgctaaatttctctgatacatttctgaattgcttttctttttttaaaaaaattttatttccacaggtttttgggggaacaggtggtatctggttacatgagtaagttatttagtggtgatttgtgaaattttggtgcacccgtctcctcagcagtatacaatgaacccaatttgtagtcttttatccctcacccacttcccaccctttccccttgagtccccaaagtccattgtgtcattacgcctttgcatcctcatagcttagttcccacttatgagtgaaaacatgtgatgtttggttttccattcctgagttacttcacttagaataatagtctccagtcccatccaggttgctgcaaatgccattgattcatccctttttatgctgagtagtattccattgtatacatatacaccacagtttctttatccatttgttgattgatgggcatttgtgtgggttccacatttttgcaattgtgaactgtgctgctataaaaatgcatgagcaagtatcttttttgtataatgacttattttcctctggttagatacccagtagtggaattgctggatcaaatggtagttctacttttagttctttaaggagtctccacactattttccacagtggttgtactagtttacattcccttcagcagtacaggagttttccctttgtgccacatcaatgccagcatctgttatgttttgattttttgattatggcctttcttgcaggagtaaggtattatcgcattgtggttttgatttgcactaccctgatcattagtgatgctgagcattttttttgtgtttgttggccatttgtatatcttcttttgagaattatctattcatatccttagcccactttttgatgggattgtttttttcttgctaatttgtttgaatttttgtagattctggatgttagtcctttgtcagatgtatagatggtgaagattttcccccactctgtaggttgtctgtttactaactgttcttttgccgtgaaaaagctctttagtttaattaagtcccagctatttatctttatttttattgcatttccttttgggttcttggtcatgaaatccttgactaagccaatgtctagaagggtttttccagtgttatcttctagagtttttatagtttcacgccttaggtttaagtctttgattcatcttgagttgatttttgtgtatggcaggagatgaggatcccatttcattctcctacatgtgacttgccaattatcccagcacatttgttgaatagggtatcctttccccactgtatgtttttgtttgctttgttcaagatcaattgactgtaagtatttgggtttgtttctggattctctattctgttccactggtctatgtgcctatttttataccagtaccatgctgttttggtgactgtggccttatagtatagtttgaaatcaggttaatgtgttgccaccagatttgttctttttgcttagtcttgctttggctatgcaggctcttttttgtttccatatgaattttgggattgttttttctagttttgtgaagaattatggtggtattttgatgggaattgtattgaatttatagatcgcttttggcaatatggtcattttcacaatatcaattctacccatccatgagcatgggatgtgttttcatttgtttgtgtcatctgtgatttctttcagcagtgttttgtagttttccttgtaggcttttattacattgaggtatgtgctttgtatgccaattttgctgagagctctaatcataaagccatgctgcattttgtcaaatgcttttacagcatctactgagatgatcatgtgatttttgtttgtaattctgtttatgtggtgtatcacatttattggcttgcattatgtaaaaccatccttgcatccctggtatgaaacccacttgatcatggtggattatctttttgatatgttgttggattcagttagttagtattttgttaaggatttttgcatctgtgttcatcagggatattggtctttagttttcttttttggttatgtcctatcctggttttagtatgagggtgatactggcttcatagaatgatctggggaggattctttctttctctatcttgtggaatagtgtcaataggattggtaccaattctttgagtgtctggtagaattcagctgtgaatccatctgtccctggacttttttgttggtggtaatttttaaattaccatttcaatctcactgcttgttactggtctgttcagagtatctaattctttctgatttaagctaggagggttgtatctttccgggaatttatccatctcacctaggttttctagtttatgtgcataaaggtgttcatagtagccttgaatgatcttttctatttctgtggtatcagttgtaatatctcccatttcatttctaattgttcttatttgggttttctctcttcttgattaatcttgctaatggtctatcaattttatttattttttcaaagaaccaccattttgtttcatttatcttttgtattttttttgtttcaatttcatttagttctcctctgatcttggttatttcctttattctgccgagtttgggtttggtttgttcttttttctctagttccttgaggtatgaccttagattgtctatttgtgcttttccagactttttgatgtagggatttagggctatgaactttcctcttagcaccacttttgctgtatcctagaggtttgataggttgtctcattttgtcattcagttcaaataatttttaaatttccatcttgatcttattgttgacccagtgctcactcaggagcaggttatttaatttccatgtatttgtgtggctttgaaggtttcttttggagttgatttccgtttttattccactgtagtctgagagagtacctgatataatttcagttttcttaaattcattgagacttgttttgtggcttatcatatggcctatcttggagaaagttccatgcactgatgaatagaatgtatattctgtggttgctgggtataatgttctgtaagtatctgttatgtccatttgttccagggtatagtttaaatccattgtttctttgttgactttctgtcttgatgacctgtctagagctgtcagtggagtattgaagtttcccactgttattgtgttgctgtgtatctcatttcttaggtctagtagtaattgttttataaatttgggagctccagtgttaggtgcatatatttttaggactgtgatattttcctgttggacaaagcgttttatcattacataatgtccccctttgtctttttaaactgctgttgctgtaaagtttgttttaatgatataagaatagctacttttgcttgctgttggtgtccatttgcatggaatgtattttcccacccctttaccttaagtttatgtgagtccttatgtgttaggtgagtttcttgaaagcagcaactagtaggttggtgaattatctattctgccattctgtatcttttaaatggagcatttaggccacattcaatgttagtattgggatgtaaggtactattccattcattgtgctatttgttgcctgtatacctttttttaattgtatttttgttttataggtcctgtgagatttatgcttttagaggttttgttttatgtgtttccaggatttgtttcaagatttagccctccttttggccgttcttgtagtgctggcttgatagtggcaaattctctcagtgttagtttatctgaagaagactgtatctttctttcatttatgaagcttaatttcactggatacaaaatttttggctgatagttgttttgtttaaggaggcttaacatagggccccaatcccttctagcttgtagaatttctgctgagaaatctgttgttaatctgatagatttttataggttacctggtgcttttgcctcacagctcttaagattctttcctttgtcttaacttttgttttttttctttgagatggagtctcgctctttgcccatactggagtgcagtggcgtaatcttggctcagtgcaacctttacctcctgggttcaagtgattctcctgcctcagcctcctgaatagctgggactaaaggcatgtgccaccacgcccagctaatttttgtatttttagtatagatggagttctgctatgttggccaagctagtcttgaactcctggcctcaagtgatctgcccaccttggcctcccaaagtgctgggattacagatgtgagccaccgcgccttgcctactttgtcttaactttagataacctgatgacagtgtgcctagatggtgatctttttgtgatgaatctcccaggtgttctttgtgcttcttatatttggatgtctaggtctctagcaaggccagtgaagtttccctgattattcccccaaatatgttttccaaacttttagatttctcttctttcccaggaatgccaattattcttaggtttggtcatttaacatatcttcaaacttcttggaggctttgttcattttttcttattcttttttctgtgtctttgttagactgggttaattcaaaaaccttgtctttgagctctgaagttctttcttctgccatgttcagttctattgctgagactttcctgagcattttgcatttctctaagtgcatttatttcctgaagttttaattgttttttatttatgctctcaatttcactgaagatttcccccctcatttcttatatctttttttggtttccttaaattggactttacctttctctggtgcctccttgattagcttattaactgaccttctggattctttttcaggtaaatcaaggattttttcttggtttggatttattgctggtaagctagtgtgatttttgggggatattagccttgttttgtcgtattacctgaattgtttttctggttctttctcatttgggtaggctatgttagaaggaaggtctagggttcaaggctgctgttcagattcttttgtcccatggggtgttctcttgatgtagtactctctgtgttttcctagggatgtggtttcctgagggctaagttgtagtgattgttatctctcttctggatctagccatctggtaggtctacctgctccaggctggtactgggggaaggagggggtgtctgcacagagtcctgtgatgtgaactgtctgcaggtctctcagccatggataccagctcctgttccagtggaggtggcaagggagtgaagtggactctgcaagggtccttagttgtaattttgtttattgcactatttttgtgctagttggcctcctgccaggaggttgtgcttttaagagagcatcggctgtagtagtatagggaggatcaggtggtaggtggggccctagaactcccaagagtatatgccctttgtcttcagctaccagggtgggcagggaaggaccatcaggtggagacagggctaggcgtatctgagctcagactctccttgggtgggtcttgctgtggctgctgtgggggatggaggtgtggttcccacatcaatggagctgtgttcccaggaagactatggctgcctctgctgtgtcatgcaggttgtcagggaagcggggcaaagccaatagtcacaggcctcacccagctcccacgcaacctaaaaggctgatctcacttccaccgcacccgcccccctcatcctcccaaccccccaaccccccaacagcaccaagtctgtttccaggcagtggctgtgcagggctgagaacttgccccagcctacctgcctctcaactgtgaaagcaaggagggctttcgtgcctcccaacctgtggagtctgcacaccggattcacaccctcccccaagttctggccaggagacattgcgttcagctggagttgttacaaagtttagctggaggtttccttttccttttggtcttttcccagttcctctggcaaccctccccaaggatccttcctaggcaaggcagaaatggcttccttgtggatccagagagcccacagggcttttcccactgcttcctctgccccagtatttcactcggctctctaaactgactcagctccaggtaaggacccgtgatctagaccttctcccgtgatctagaccttcaagttctccaatgagggtgtgttttcggggtgggtgattcctctttcctacttccatagcttgggtactcacagtatttggtgtgtgtcctgtatcctgcaggagtaatctgcttctttcagagggtctgtgtcttttctcatctttccttgtttatcaacatgtttattttcctgaattgcttttctgtgttatcttggagatcactgagtttccttaaaactaccattttgaattattggtcagaaagctcacatatcgccatcttgttagggtcagttactgttttttgttgttgtttgttttttgtgttttttttttttgtttgctttgggagattatggctccctgttcgctcttctttcttgtggctatatggctatatctttccactgaatgattagttatttattccagtcttctctgtctggcttttgtttttttttatgggatgtatttgcttagatattatttactgccaagttgttggctcctttttggctctaggtggtgccttaagcccattttcaccttggctgtagtaactaattggagtactacttgtctcagatgcaggaggccccaaagagtatatcctggcggtgtgagaaggctggctaggggtttgtgcccaggaaccagtggaacacccatcctgtagtgtggtgctactgaacagccacagtgatttggcatctcctttgtctgagttactgagctgcatttccagggctggggatgatagtctcacctctccattttgactttgtctgtcctcaaggatatttctctctcaggcacgctcagtacttcccatggcttaaagtagggacaggtctcctgccagggaacccaagatggtggggaagctggttgtccaccttaatctcatggtttgcattgtggagaccatgagttgcaggaaaattttcgacgcccttggttatgggtagaatcgggggaggggtgtcacagatgtgaaatccaattctatcaccatctgctcagggtctttcacttctctgtggcctcagggactatctcattcttgtgtttgagttctggaatatttctggtgataatcttagcattgtgcatttgtttcagttttctgttgaggggagtgaatccagcttgcttctgtgctaccatgttggatctggaagtctaagatattgtagtttttacagcttcaaagtttgtggcacctctgcatgaagcacatctattggtgccagttttctaatagcatgtactcactttgaatttctatgtcacatgttggtaattcccaatgttttaaactttttcattattattattatatctgttccggtgatttgtgatcagagatctttgatgttactattgtaactgttttggggcacctcagacagtgcccatgtaagatggcaaacctaatagataactgttgtatgtgttctgactactccactggccagctgttcagccgtccttctccctcccctcaggcctttctattccctggtaaaaaagaatgttgaaattaggccagttaataatcctacagtggcctctaagcattcaagtgaagagttgcatgtctctcactttacatcaaaagctagaagtgattaagtttagtgaggaaggcatgttaaaagccaagagaggttgaaagctaggcctcttgcaccaaacagccaagtcattaatacaaaggaaaagttcttgaaggaaattaaagtgccactccagtgaacatacaaatgataaaaaatcaaaacagccttatggctgatatgaagaaagctttagttgttgaatggaagatccagctggccacaatattcccttaagccagtacctaatccagagcaaggacctaactcccttttattctgtgaatgctgataaaaggtaggaagctgcagaagaaaagtttgaagctagcagaggttggattataaggtttaagaaaacaagaaatatccacagcataaaagtgcaaggtacagcagcaagtgctgaggggaagttgcagcaagttctccggaagatctagttaagatcattgatgaaggtggctacactaaacaatggattctcaatttagatgagacagtcttccatgggaaggagccactatcgaggactttcatagctagagaagagaagtcactgcctggcttcaaaggacaggttgactttcttgttcatggctaatgcagctgtttactttaagttcaagccaatcctcttttaccattctgaaatcctagggatcttaaggaggctgctaaatctactttgtctctgctgtataaatgagacaacacagccgagatgacagcatatctgtttatagcatggtttactgaataagtccactattgagacccacttctcagaaagcaagattcctgtattagtctgttctcacattgctaaaaagaaatactcaggattaggtaatttataaagaaaagatattttattggctcgaggttctgtaggctgtacaggatatagaatggcatcagcttttaaggaggcctcgggaagcttacaatcagggtggaaggcgaagtggggagtaggcacatcatatggcaaaagctggagcaagagaaaggaggggagaggccacatacttttaaacaaccagattttgcaagaattcactcactatcataagaatagtaccaagagggtggcactaaagcattcatgagaaatctaccctccaatacagtcagctcccaccaggccctacctccaacactggagattacatttcaacatgaaattttggcagagatacatatctagactatatcaatttctttcaaggtattactgctcattgagaatacatctagtcatgcaagagctctgatggagatgtacaaaaagattaatgttgttttcatgcctgctaacgcaacatccattctgtaatccataaagggtaatttcatccattaagtcttatttaagcaatacattttataagtctgtagtctctcttttgtctctctcttgtctttttacaagtctatagttttataagtctatagtttccagagatggtgattcatttgatggatctgggcaaagtcaattgaaaacctttcagaaaggattcactattctagatgccattaagaacgcacatgattcaagggaggaggtcaaaatatcaacattaacaggagtttggaagaagttgattctaaccctcatggatgactttgagaggttcaagacttcactggaggaagaaactgcagatgtggtggaaatagcaagagaactacagttagaagtggggcctgctgtgactaaattgctttaatctcatgataaaacttgaatggataaggagttgcttcttacagatgagcagggaaagtggtttcttgaatggagcagggtgatcttgcccatgaaatgaggccagactcacctgagcacccttatgtctgctggcctctcccagggccccaacttggctgtacctgcttgcagtgctgccttggaagcccaaatatggcttggacccacatcatagctcctgcactggcagaccacacctgaccatcagagagctccagcagagtggccctcgctgacacgcaccagccacatgcattcattcctcattgcagactaccctatgccactttgctagcatgtacttgtctgcagccacccccccccccattgttttgccagcacacgtgtatgagtgaaccttgccttacctttctttccagcatgtgggtgtatgtgcactccaccatgctattgctgctggcatgagcacacccaccacccgcctgttgctgttgtccatgtgcattactggcacaaacatgtgcatggacaacagcaggcctgcccccaccctgtgttgccacttctgctggtatgaacacatgcatggaggtcgccagctctgcgcctgccagcaccctgcccctgtgccaacacagctgtgggtgtgaatgtgtgtatggaccctagcagcctgcccccttctctgccccacccccttctctgggcccaccagccctgtgtctcagctgacaagcatgcaccctgctgtgctgctgctgctgctgctcgcccatgcaaacaagcatggatcctgctgccaccacatgatgctttatctggcaccacccatcagagtgttgtgaccagcattctgggaacactttggctcttctgacacagcaggtttccatcctgaggggggtcaaagaacaaagctggggtcatgatatcagtcttccagagttaaaacatgcagcctaggggtgctgagctgagcgttggcccccacaaaatctaccagaaatgaaacgagtcaactcagcctaccttacgtcacaatcatacccccacggacatcaaagataaaagcaaaaacatacagctatccaaaggacagcaacttcgaagattgaagaaacatcagcccacacagatgagaaagaaccattgcaagaactgtggcaactcaggaagccagagtgtcttctcacctccaaacgaccacactagttcccccacaatggttcttaaccaggctgaaatgactaaaatgacagaaatattattcagaatatggataagaacaaaaatcatcaacattcagaagaatgtcaaaacccaatccaagaaatctaaggactacaataaaatgacacagaagatggaaaatgaaatggccatgtaagaaagaaccaaactgagctgatgtagctgaaaaactcacttcaagaatttcagaatgcaatcacaagtattaacaacagaatcaaccaagcatgaggaaagaatctgagcttaaagaccagctctacaaaagaactcagtcagacaaaaataaggaaaaaacaagaagaatgaaaaaaatctccaagaaatatgggattaaagagaccaaatctacgatgcatcggcctccctgaaagacatggagagaaagcaaacgccttgaaaaacatattttatgataaggtctgtgaaaattccctcaacctctctagagaggccaacattcaaattcaggaagtgcagagaacccttgtgaaacactacacaagaagaccatccccaagacatgtagtcatcggattctccaaggtcaaaatgaaagaaaaaacattaaaggcagctgggggaaggggcatgttacctgcaaagggagcttcatcaaactaacagtggaccttttagcagaaaccctacagaaaagaatgagtgcctttagtcagcattcttgaagaaaataattttcaactaagaatttgatatccagacaaatgaagcttcataagggaaagagaaataagatccttttcagacaagcaaatgctaagagattttgataccatcagacctgccttacaagaggtcctcaaggtagttgtaaacatgaaagactattactgaccactacaaaaacacattaagtacatagaccagtgacactataaagcaaccacacaaataaatatacatagtaaatgctgacaacatgatgacagcaacaaatctagacacagcagcacaaatcttgaatataatcaggctaaatagcccaattaaaaggcacagagtgacaagtggatttagagaagcaagacccaatggtttgctgtcttcgggacacccatctcacatgcagtgacacctatagactcaagggatgtagaatgagaaaaatctaccaagcaaacagaaaagagaaaaaaagcaggggttactattccaacttcagacgaaacagactttaaaccaacaaaaatcaaaattgagaaagaagggcattacataatgataaagggctcaattcaacacgaagaactaactctcctaaatatgtatgcacccaacacaggaacacccagatttatatagcaagttcttagagacctatgaagagacttagataaccaaacaataatagtgggagactttagtaccccactaacagtatttgatcatcaaggcagaaaactaacaaagatattcaggacctgaacttgacacttgaccaaatagccatgtacagaacacttcaccccaaaacaacagaatatacgctcttctcatctgtgcatggcatatactccaaaatcgaccacacaaccagacataaaacaatcatcagcaaatgaaaataaagaaaactaaaatcataccaaccatgctcttggaccacagcacaataaaaatagaaatcaatactaagaaaataactcaaaaccatacaattacatggaaattagacaacttgctcctgagtgactttttgggaaatgattgaggcagaaataaagaaattatttgaaactaatgagaacaaagatacaatatatcaaaatctctgcgacaaagctaaggcagtgttatgaaggaagtttatagcactaaacacccacatcgaaaagttagaaagatctcagattaacaatataacatcacaactggaggaactagaaaaccaagagcaaatcaaccccaaagttagcagaagacaagagataaccaaaatcagagctgaactaaaggaaattgagatgtgaaaaattgtacaaaatattaatgaattcaggagttgtttttttgaaaaaattaagacagactgctagctagagttataaaaaatagagaagatacaaataaatacaatcagaaatgacaaagggggcattaccactgaccctagaggaatacaaaaaccctgagactattatgagcacctctatgcacgtaaagctagaaaacatagaagaaatggataaattcctgggcgcatacaccctcccaagactgaaccaggaagaaattgaatccctgaacagatcagtaatgagttcaaaaattgaatcagtaataaaaagcctgccaaccaaaagaaagccacagaccagaaggactcacagccaaattctaccagctgtataaagaagagctggtactattcctagggaaactattccaaaaaattgaggtggagggactcctctctaagtcattctgtgaggccagcatcatcctgataccaaaacctggcagagacacaattaaaaagaaaacttcaggccaatatccttgatgaacatagatgccaaaatcctcaacaaaatactagcaaactgaatatagcagcacatcaaaaagctaatccaccatgatcaagtaggttttatctccaggatgcaaggttggttcaacatatgcaaatcgataaatgtgactcataacataaagaaaactaaaaacaaaaaccacatgattatcaatagatgcagaaaaagcttttgataaaattcaacatcacttcatgataaaaaccttcaagaaactaggcattgaaggaacatacttcaaaataataacagccatctatttcaaaaccaatattatactgaatgggcaaaaactggaagcattccccttgaaaactggaacaagacaaggatgccctctctcaccactccaacatagtactggaagtcctggctagagcaatcagacaagacaaagaaataaaggcatccaaataggaagtcaaattatccctgtttgcaggcaagatgattatatgcctaaaaccccccatagtctctgctcaaaagctctttgatctgataaacaacttcaccgaagtttcaggatacaaaattaatgtacaaaaattagtagcatttctgtacaccaacaacatccatgctgacagccaaatcaagaacacattcacattcacaattgccacaaaaagaataaaatacctaggggaacaacgcacactggggcctgtcgaggggtgtgtgtgtggaaagagagagcatcaggataaatagctaaggcatgtggggcttaatacctaagtgataggttgataggtgcagcaaaccaccatgacacacatttatctgtgtaacaaacctgtacgtcatgcacatgtatcccagaacttaaattaagagaaaaagaataaaatacctacaaataggaatacagctgaccagggaggtgaaagacttctatgagatctattttataattctgtgagaattacaaaacactgctcagtgaaattcaggatgacacaaatggaaaaacattcatgctgatggataggaaaaatcaatattgttaaaatagccagactgcctaaagtaatttatagattcagtgttattcctatcaaactaccaatgacattctccacagaattagataaaaactatttaaaaattcatatggaacaaaaaaagagcccaaatagtcaaggcaatcctaagcaaaaagaacaaagctggaggcatcacatttcctgacttcaaactatattacaaggctacagtagccaaaacagcatggtacttgcataaaaacagacacatagaccaatggaacagaatacagtgcccagaaataatgccacacacacctacaaccatctgatcttcaacaaagagacaaaaacatgcaatggggaaaggacttcctattcaataaatgatgcagggataactggctagccatatgcagatgattgaagctggaccaattccttacaccacatataaaaatcaactcaagatgtattgaagactgaaatgtaaaacctaaaactataaaatccctggaagatagcctaataaataccattctgaacataggactggcaaagatttcatgatgaagacaccaaaaataattgcaacaaaaccaaaaattgacaaatgggacttactttaaagagcttctgcacagcaaaagaaactatcaaccaagtaaacagacacctatcaaatgggataaaacatttgcaaactgtgcatttgataaaggtctaacatccagcatctgtaaggaacttaaattcacaagcaaaaaaaaccccattaaaaagtaggcaaaggacatgaacagacaattttcaaaagaagacgtacatgctgccaacaagcatatgataaaatgctcaacatcactaatcattagagaagtgcaaatcaaaaccacagtgagataccatcttataccaatcagaatggctattattaaaaattcaaaaaaatgacacaggctcacaaggttgtggagaaaagggaacacttatacactgctggtgtgaatgtaaattagttcagccattgtggaaagcagtttggcaatttctcagagaactgcaaagagaattaccatttgacctagcaatcccattattgggtatgttcccaaaggactataagttattctaccatgaagacacatgcatgtatctgttcactacagcactattcacaatagcaaagacatagagtcaacttaaatgcccatcagtggtagactggataaaatgtggtacttgtataccatgcaatattatgcagccatgtcctttacaccaacatagatggagctagaggccattatcttaagtgaactaatgaacagaaaacaaaataccgtatgttcttacttataagtgaaagctaaacatagagtacatatgaacacaaagaagggaacaacagataccaccaggtcctacttgagggtggagggttggaggaaggtgaagatccaaaaactacctatcgggtactatgcttattacttgggtgatgaaataatctctacaaacccctgcaacatgcggtttacctatataacaaacctccacatgcacacccgaaccaaaataaaagtttaaaaaaatgccacagccacattcagcaactaccatcctgatcagtcatcagccatcaacattgaggcaagaccttccaccagcaaaaagataatgctttgcggaaggctcagatggtcattagcattttttagcaataaagtatttttgaattaaaatatgtacattattttttagacataatgctattgcacatttaaaagagtatagtataaacataacttttatatgcattgggaaaccagaaaatttatgtgacttgcttttttgtgatatttgctttattcctgtggtctagaactgaatctgcggtacgtctgagatatgcttgtgtttaagtttccctctagtaccctggagaaatgcttttatgtagatcctgcatctttctccatttattaatacttatttttgtgttgcctttgtgaacaaattcttattatgtttccatattttgttagatgtgctctatatcctatagactttctgtaatatagtttctattaaaataccaattaaaaactattcagtgctggctgggcatggtggctcacgcctataatcccagtactttgggaggctgaggtgggcggatcatgaggtcaggagatcgagaccattctggctaacacggtgaaaccccatctctactaaaaatacaaaaaattagtcaggcgtggtggcgggcgcctgtagtcccagctacttggggggctgaacccaggaggcagagcttgcagtgagttgagatcgcaccactgcactgcagcctgtgcgacagagtgagactccgtctaaaaacaaaacaaaacaaaacgctattcagtgcttactctgtaagacacaatagaaaatgtcaagggtatgaaaaacaagttatgggcctcagaggtaggagattgtttagctctttagcagcagaacctgagaagtgcaggtgatctccttatgaaattcttctttaatgtttttgagtttttttcagttatttttgtatatatcatgttattgtcttttttattgttgtaattccaaaaataggtgacttttcgttccatcttgatattatcaagtttcttgatattaattttttttctgtgtctagttcagattatactccccaagaatttataataggtaaagcattagaaacagtatactcctttctgagtggtaattacctagaaaagtcaaagcagataattcattatagcatatttattagtacttgttagtacatgttttcttggtttgtacatctgatgacttattatgaaagtgttacaaattagtgtttctcatttgatgaaatctaatcaattttaaatttcctggttgttttttcctgttttaaaactttttctatcccaggttataaagatattcttctttgtttttcctaccattgttatggtttcagcttttgcatttcggtttgttatctgtgttttgtgtaaattagaagataagttgatgttctttcccagtgtggatgtccagttgtttttgtaccatttgtgaaaagactttctttgctcatcaaatcattttgatgactttgtcaaaaatcaattgcttgtaaaagtgtaggtctatttctgaaccaatctattccattttattgatctgtgtgtcttttttttgttgttttgagacggagtctcactctgttgcccagactggagtgcagtggtgcgatctcggctcactgcaacttctgcctccttggttcaagcgattctcccacctcagcctcctgagtagctgggattacagatgcctgccaccacacctggctaatttttgtatttttagtaggatggtgtttcaccatgttggccaggctggtctcggactcctgccctcaggtgatccacctaccttggcctcccaaagtgctgggattacaggtgtgagccactgcacccagccaatctgtgtgtctttataaataatcccacactgtcttgatttctgtagctctatagtaagtcttgaagtcaacttttttttttccaagattgttttggctattttaggtccatagcattttcatatggagtttagaatcatcttgccaatattattatttatataagtattaattatttataaaccattttctgaagtacctattgggattatgcttgtgattgtgtgaaactataatagataagtttgggtaattggacatcttcactatattgggtcttccagtctacaaacatggcacatctccacattctgcttgacaatgcacttgacagtctttagatagaatattattattgagataaagtatagagggtacttaacacacttagcttggcatacataatcaactactgcataatgttaatattatcagttccattcatcctcacaaggccttatcaagtgctgtttgtatccgtattttactgagttcggaacttgaccgtggttatacagttaataaatggctgagcagggtttggaatgaggtctttatgagtctaaaggccatgcttaccagtacagtgtcactggaaaccaaggatggtgagcctcaaattgtattttgctgaattttgcagatggtcttgtgtattggtaagttaagattagagtctccaagaacagagtttattctgaatgacttaaggagcacgggaatttaatgaaggctatacttgctcatagtctctctaggagagccacactctgtgtttatagatgcaaagccatgctctgtggcttctcttgtgaaactatcagcagtatagtaaccattagcagcctcagaacctctgctcctgcccgcctgaggcgcaggcccctgccactgcctctgccagcagatggctcttcccgttctcttcctcctctcatgctcatttccgactccaggtttacaggaacacatgtgtctcactgaaggagcctgcatcaccagtgaccggcttataaggagggctgggagcagaggctgtgggactcataggctgagccattacttcaagtattgggaagccatagtgattccccagtgtatcctgcttgctaatttataaataggcttttctcttgggagtagtatgaaaacaaacatgagaatctgaatctgcattataaattattggctagtaattaattagtgctatgttttgcatatttcttactctattgtaacatagactctggacacagaacagggtttggatcatgtttctgccgttgaccagggatctgaccttgggcgagttactgttaacctctctgcatcagttttatcacctatgaattcagaaaattatattacccagttaatattattattaaggtgttaaagtattcttctaagctgttaagtgtctaactcagtggttggtatacaataagtactcaaaaatacacctattttatatacacacactttcacacatctgttccatgtgcagactgtttaaatgtaggaagagcttaacctttctctgtcttataagtggttacagagggttggcggaaagagctctgacctttggagacaccacagtgttataattgttctgaagtgggagaatacctggtaataacaaaataacagtctctgcttcctacagggatttgaggtttattagctcaggcagttgccactgagacgttattggctgctgtatttggagtgcattttctgccgtgtcctggggacaagctgtgtggaagatgagctcctggttttctgtaggcgccgtcggctgcctgcctttgccgcaccagtcagaggcctcccttggttttgcacgtggctgcagtagtgcagggcagagcagagtcacatctggtccattcagaatgtcattactgtgcctccactgaggcctcgcttttcatacacttcctccctgcttccgtcgagccctgctgaggtgacgaggtgatgaggtgacagcagagctgttgcctgggaagggtccgtgtcatttggcatttcttcctatgcctggggagagtggaagggaagctacacagctcttgctaattactcagcattagagaggaaaatgtgggctgcctctgtccttggaacagaagtaagacgtggagaaaccagcagtgtggcatctgggcaaggagctcccgtttgcggggctggaaaccctgcctctgcgtcctctttcacttaaagcatattactgggtcacaaaagaggccccaggcaaagtgtgggctttaaccttctggtgacactgaagttggagaacactgtataacatttctagagcagagctttggctcccaaggcagcttggctttggttttattttgtctcatgaaataaccaggccagggctggagaacatttgctcttttccatgatttttctgtttgctttgccctgtgacttgcatcttccctttgttcagacttccatctctggagaattctcgggtatgagttgtgttgctgtcggttggtttgtgtgagaagcaactgatggtcgcttctcagggtgcgttcagacagaaccaggaagcttgtgtctgtgtgagaccgagtggtgctgcggctctccctgccacaagaggcctgtggcagcagggctagtgtgctgtgtgggtgcgagggctcctccgtgtggccaggctgccagtagctggcttggagctggcagcagagggccagggtttggcctccagctaggtgggcatgtgcacggactctcactcagttacaagcatgtgcagaggtgttggtttatttcatgtgagtttcttccactcctcttcatgttcgcctgctctccagccccttgtttctttgccatttctgcacctgctttcttcagctgtgtaattctagatatcggtttccaacactgttggcttacccacatcagaagaaccctttcctccttcagcgaccacctttccatcagtgacaggtggctatccaggctcgcctcagccagcttcccctgactcacctttgacatcacctttctgggcacttgttaatgtttctgcctctgggacacagatgcatcactctggcctcaagccagaggctgggattgctgtgcccatgttgccctcatcgctgaggccagggcttaccagggtgaggtatccttataaagtcgccgactgaacgtgcttggtttgtcatcttgcactggaagacagtgattgaaacaatcttatatcttttcaggaaatattgaaaatggacatgtgaagctcattgttatacatttaaaaaataacagagaacacctacctcttattggaaaagttggcctctcgtggaaaactgatatttttgatggctgtataaaggtaaaaacagaaccgttttcttttcttcaagtaacttgatttctatataataaaaagtctgtttatatatataaattatattgtcatatatgtatgatgtttcttttatagttctggatttattgttctggtttctgaaggttggtgcacattctgttagccattgacagccagtggattcactcatgagatgcttattgagtacctttcatttgtcactgagtatggtggagttggaggggcaggtagtctgcagcagcatttcagaacactgttgatcacagtcccctactctctcaaagcccctctgttttgtggaaagagagtggaactgaaggttggaccacgcaggcagcatctactcaaaacatcttgatcatccatgtaccaatttaaaacttattgcagttataaattcttagtccaggatatagggatttccttgaactgttaaataaagattagccacatgggtgggagagttgacttagtggttgggaagtagcagggaaggagggaggaggaggaagaggagaaagatgttctcacagttttgctttcttctgtccttgtgcccatggctgctcctggttcttgtcactctccaactttattttatgggatgaacaagattttcattgtcccagggaccagtgggatcaatctcctgtgactgcgggggcctcctgtaacatggctttatacggcgctatgcatgcgcaccttgttagaactattaatgatgacgactgggaccaagagtggtgttatcatgaagcactgtcccttgagccacttgatatttgatgcaatgagatattttacaaatcctatttattcatagcaaatgtttaagttttggtaaaaatgatgtttatcacacaccatgttgtttcatgcctttaagagcacagacctaccttctttctttttcttcagatttcaataaagcctataataaaagtaggtactaagataaaatattcacgtcaaaatagaccttgaggatcaagaaaggcagaatgtgaatgtgactgtcttttaaagggtcagcataatttttaaaaataatttgttctgtgttttctggtagtccagagaaagatgagagcagtcatttagttctcattgggagaaaaaagggaaatgtagtaattatacaaagaaagctttatcccagttctgatcattaaaaacaaaatttccaatgggactttatgtagggcagactaagctacataatggacccaccctgaatagcatcttagcagcagatgcactcacagatttctcatagaagttctcagagaagctgaagatacggcttcaaaattggacctttacatgagctccaagcagtgattctgtaggttgctaaaccaatgtgactgaggtgcacaggtgtttagaaaaacagcttgatctgaaagcaggattttgagtttttaaagtagagaatggattgcatgtccctggacagttttccccataaattccttctctcagatgggctttgggaaaagatagcagatagctcaaaagcttgtaccttctcccttgggcctggagggtagatgtggtttattttctgtttgccttttatgctcttggattcagtattaagactaagccgtcctcagaattcccaaaagaataaaaagtcagatcagtgatgtcatatgtcttgtatttgctgtgcagctcaggtatttctctccaggaatctgatcaccctaagaatagtgaaatgataacatttattttaagaaattgcttggaaggagttaaaaactttttttttaaagcatggacataagcttagaaagtttcttaggtacatatgacttttaaaaaaatgtaaaataaaaacccggctccttctggaaattgtagacacaacctctggtgaggagcttctactaaatagtttacgatgcctgtcagagcataggctactgagaaagtacgtcacccaaatacgatgctggtggaaggacaaagaagtgagaaaatattaatgataatgacggaggatgctgcctagttgtgtcgtgttggttgaagtgatgtgcagtcgtgaaaggacatctgatgtccttgggacctgctgttcccatgagaatctccgtcttcctccaacctcagagttgagtgacctccaacacttactggtgtggaggtaattcaggtggaaagtatctttagtttgagttcctagagcaaaaactcaacagatcataagtttatgtggtaaattattaaactttaaaattctttaaaaatcacattctaagtaggtcagttttttattctttttttaaaaaactcaaaagatactgataattattacaataatattatgaatgagctgtattttaattgtggtaaaataaacataaaatttaccaccttcaccacttgacttctatatttcagtggcttacataccttctcattgttgtataaccatcactactgtctaatctccagaacttttcatttaaagatgctttcagtggccacgtgttagtactgaatccatgcaggacgcttgctctgtaagtggttaccatgctattttacaaagtcatgttgaaacagctaggctaccctctcaaggtaaccttgctgcagtcttcagcataagtcaagtaatcaaagtgaaatactctcctgctctgtctcctcccagcgcctatcagaatttcagatggatggattttcttttggtgaggcttttcccgtatgtttcttttatgtttttctttcactccttggcatttttgatgttattttaatgttacttctaaatctatatggagattggcatcaatttttatttagactagatatttcagtgtagttctgtggttctgctttatgtaagaacagctgagttcagtagagcctgctgtgggtacatcgtgggtcagcatgttgtgggtggccgtggcccatgagaaaggcatcctggccacttcacttgacaagcactgcagctgcatgggtgattaaggctgctggtgctgatacaaccgaaaatcgcaggaagaacagaacagtcccacacgtgcgagtgctgcactctccccagacactgagttttgagcctggcgtagttcactggtccatgggagcgcaggtgaggagagacttcctcctgcaaggagggtgaggtctgccgactgctcagatgtgtgcctcctggacgttcagggtgagagggactgatttaggagagggatgattgaaaacaagttctgtgaggagaaagaggaaaggggccagtgggaggaaggctcatgagaggttctgacatgcatccccccccagaaggttgggagtgatttattctggagaaggaacccagtggagaaagagatgcttcggacaggatgggaaataaggagcgagcttctagaggtgaggggcagctggcccggggaggggtgcgagacccactgtgccgctgcggctggtgctgaggcgggcctcttcctagctggctgtcctgcctggggtgggctagcacccggggacaggagggacagtgactggggggcattggaaaggctgctggggcaggtcgggggggggccttgaaaccctcaggaaagaatttggattttggtgtatctgtggatgttgttaaagagtttgatgtgcctatcgtgtgctaggccatgttttaggttaggagggaattggagaatgctggactttgagaactaggagggcttcagaggagagtcagctcccagctcttgatctggcagcagaggaggtgggagagcagaaagactgagacacccaccgacggcttagggctgtgagcagcgtcctcaccaaggagcccttgtgccccaccggccgctccttcctgacttctgccagggtttctcctcctcaaccttctcgcaggtgatgggacccagggctccacctccttcctcccataggatctaaccaccatctctatgctggtgggtttggtgaggttgtaagtaacacagtcaagtgactgctagcccagtggctaaggtcgtgcagggtggtggggtgtggaagatggatgcaccatgcagtcccacctgctgtgttatctcagaggtgcttagacctcagagccttctctctaaaacggccacagtggtaatgcccattccaggagggctccggctgcctgccaaagacagagccatctgctggccctcagtattggcttcaactcccccattctcagcctcagtgaggctgcagtgtagggtgttttttcttattccccacctgctccccactctggtgtcctcctcgcagcccaggctctgtgtgtggtggtccctgtcatgcaggaagcagtgggtgctgtggaacaggctgtgtggggctggtcgctgctgttccaggaccactgcagccgattgcctgggaaaggcatcagggagcaaggtcaggtgtctgaggggttcctgggtggtctcactgtgtagctcatctgatgtgaggggccttaggctctggcgtgcactctcccatcagggattagtgtgtttcatgctggctgcttcttcacccatctcttctttcctggtgtttgctgcccctgatgcattagggctcctgctgtcctaccttagtgtttaataacaaccagcacctccatcactactcttaccacctccctctcattttatcacactcattcattcattcagcacatagtggttgagcttcagtgactgtgtgcatatgcaggtggccaggggcacgatgctgaaccaagctggcctaagtcctgccctcttggtgcttagcatccatctctacctgcactggccgggccgagtcagtttcagcactgcagctgtatcaagttctgcattcaacacactggtgtttctgcccattgggtacatggtcagttgagatgagagtatcagggaaacttcctcaagggactggtattcgaactgaatgctgagatggacaaagagaagatgggaagaggatctctcagcaggggagcttgggtggctctttgtcagctgggggcatggtgtgttcaagggtgaagggtcagtgtggctggagcacagatggcaagatgtgtgcaatgaggtgggatgggcggatgaggccaggtcaggccttaatggtagccggaaggaatttggttctttcttgagagccgtggaaagttgtctcagggtgatatgctcagactcatgttttgtaaaggtttgtcttctgaatatggcgaatgagtggggagatcagttagatggctgcctccttaaaggaagagcagtcacttggtttcctagtctgcttggcatgctatcacatatcaccatcagctgggtggcttttaagcaatagaaacttacttcttacagttctggaggctggaagcaccaaggtcaaagcaccagcagatgggtgtctggtgagggccctcttcctagttcctagaggcaccttctagcagtgtcctcacctggtaaaaggagtgagacagctctgtgggcctcttttataaggacctcagtcctattcatgagagctctgcccccgtgacctaatcacctcctagaggccgcactgcctaaacagtcacattggtgatcagattttaagacacggattttgggacgcacaaacattcagaccatagcacttggactagggcagtggcaatggagatggacaaaattaaagcgattcgaaagagaggtaagaactaacgggattgggtgatggttggctcgtcagggctaggagggaggcccctagaaggacgcccacatttcaggcatgcacagccagatgactgatgatggttccaccagtccctgggacgaggagtaccaggagagctttgctgggagggtcctgagtttgggcatagtcctgctggacttgagggaccgttgaaagatccagaagttgagtacgcacttgaatatttaggtcttgaacttagaaaagaagttcggcctggagataaacttttgggaatcacaggcatgttggtgataacttaggatgtgaatgtagatgagttccatttatggggagagattacatagagtgaaaatagggcctaggaccaagctgtaggaacctcagcaatgggagtgggtagagagctgcagggcttgtgggttctggatgcatttggagaggtagaattactcttcactgttctcttgaaaaactaaacactgctgagaagcagactgacagatggtcactggatttagtggccttatcaagagatgttcggtcagatgatggaaaaaggataccaggccagagtggtttgatgagtgaatgggtattaatggacaaatccagcggagacagctctttggagagggttgtctgggaagcgaggaaagagcaggggcctgcggggcccagggaggctgtttccctctctctgcctctctaagatgggagttacttgaatgtgttaaagactaaaagctgatgggaggacagaagtagtcacttgagagggacatcatgcctttgcaagatgggctacgctgcagcaggaggttactgggccacacccgggaggagcagatgagaaacacatgtgaggagaggtgggcgcagaggagctgggctgtggatctgcagtgggaagttgaggaaaacatccttctcccctgtctgtgaaggccgaggttctctgcagagatcaccctcctagcaggatgcagagggctgagggaggggatgaggtgttgttccatgaggcggagagggagccacccagagagccagggtgggaccgtcaggccgagctgaggatggtgcagctgcatgggcacccagcagctctgcgtgcagccctcccgctgtgcttggtgctcaggtccagacagatagaaaataactgcgctcctctggggctggggttttgctggacctggccctaaggtgtgttgcaaggggagtgagggaggtatgtgcattggcaagagtgttattccagcaaaggccagtgaaatctaaagtggaaaggaagaggcgggagaaggaagggctggctagtgggtgggctaggtccatgggcagtgctcttcaggcctttttacatatccactgcggtatgggcatatacagaccacacattcatgtgcaatgaaagcagcgttcatgaaatgacgtttatgcttagtgtatgtaatgcatgccgactatgttctttttcattttattttgacaaacagttgtgtcctgctaaatttacttcaggatacattaataggtcatggcttgcagggtgaaaacactgggtaaatctgaagtacagttgtagtggaagtcatccagtgagtcagctggaagacgaagggtggcagttagaagacagggtgcctgaggcatggatagtgaaagtggaccacttccgggaagtgctgtgtcggccatgtgactgtgggagtgaataactgaggtcaagtcgaggaggaggtcatggagttgaccagctcaggagttgagagtccaggatactggaggctccaccagggtccccacggatgttgggatcacttgggatgacagtgagacttggaagacttgggagagagtgagagggagaggcagacagcagggctggtgccagagtcctggaaatgagagtgggtggacaggaggctggcacatgtcagagacaggcatggagcatgggtgcagagctgcagttcagagcctcagagaagcaggtttctcagaagaggggaggggtcggcctggtggtggcagtgaagacccaggaacacaggcacactgcttctcagggtgatgcggtgcctcacgctcggaagcgctgactggttgttggtgtgatttgtgtcacatctgtagccactgtactttaacttccatgaggagagggacaatatttgtgacacatttctctgagctcccagtgctaagtcctaaactgagccctgtgagagctcctgtgtatatttgagaatgaatattaagtgatgagacacacaaaagcccaagtataatctaggttatgaagtaggccatgaaaaaccaatgatagtattctggattttgatgccacacgcagcatttctagtgagttttacagagtcacgattttctgtgaaaatcaggtctgattggcctttttatccttgtcaatctgtgtttattttgcagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgcagagtgctgtgcaatgcctttcatctcacattagaaattatgatttatgggtcatttttaagttaatgtttgaaggattcagttatattttaaaaacaaaaataacagtgaaacttcatataaaaagaagaaaaggtatttacttctcttccgcccttcgttaaaaatctaagaacttttacttaagcaaatgatcatgtgatcactctgtgtgtgtgtgtgtatgtgtgtgtaggggtgtgttcttacagataacggtttttctttttctttattggtaagaagctcaaatgagaaaatgtacttaaatattaatataaatttcattatattcactagaattagaaagtgctacattcttgacagtcagcagccatatcggtatttaataaagttaaatagaccagtggcctcattcacaaggaaagatatatctgaaatcataaggaagttataacttaaaagagcaaggcacagtacaagtccagtggggacaccagctctgtgtgagtggggatagagacggatgagttattgaaacttcctctgcagaaatattttaagaaaattgacagatgatcaggattcaaataggggtgataagtatctaagcctatgttattttagggcatttggttctacatttgttttagattgtgttggttgttttgattatatttttatcccctacttgaaagatcccctccaaggtggttttcgacgtcctgccatgttcctccttctcaggcgtgcatgagcacattccccctctctgtgtttcattcttctcctgtttagtgacctggccactttctctttggaggtatgtgtatgatagtgagcatgtgagagtgcagaataaagagcctgaagacagcaatcaagtgaagatgggggacagatattatgttcttgccccaaaaaatgagagagtaaaaggatttctgctgctgacaccgtcctccaccctcctgtcctccatgaccttgggccaaagtccttgggaagagaggaatttgaaatgcggtcagatgttgtgagcactgggctgtgttatttcatggtgtcaccaatgagggaatgtggagtgtcttccccagctgagtgagcatcaggggaagaaggaggcactggcctcagcactgagcccagatgaggactaggagtcagggaggccagggatgctgagtgccgcttacagagctgcgttggaatacaaccacgagaaaatgcatggagacccccctgaaccccctgggttaaattgtgagggactagatgtcctgacaatactggaaacatagtagagcgggggaagaagccctgttctctacctcctgtttaattatgttgggatggaggagggaaggaagcaaggacctccagggatggcacagtggagctccgtggacatgaacgcctgccttccctgctagactgctagtcctgtgagcagggacaatggttcactgcttcatctccagcacctaggagcatgccaggtgctccataatcgatactcaataacgatttgtcaaaccaatggaaaccgttatcgggatataccagcagctatgggagcatgaaggaaacagggagcaattctgaccgatgagtctgggagtcccttacatctcaggtgacatctgagttcaccctggaaggaaggtttactgggcagcaatggggaagggtgaggcggaggaggcagtgctcataaagccttggtgctttgaagagtctcatgaaaacaggtgtgcatgccacacacaactgaaagatgccagcggacagccctgtcccagtgtcacttacacatgtctgagatattaatattcagcttttaaagctgtctcttatatttgcctccatatttctaaataattttaaacatatcagattatgaattctactttttgtttctcccaggatacttcagccctggagatccatctctttttgctgtgaaatgcttgttctctagccatgctgggcagctgtcattctggggttccctgcatgcatcctccattttatggaatcctgtcttcctctttactggttcatatcctttttttcagtggtacatgttctcctgtggctttctaagaaagatgacacggaagatatattttgaatctatgaatttctgaaaaatatctgatggatagtttaattgggtaccaaactgtaggaagaaaaatgttttcactgggaactttgaagacagttgttatcattgttgctgtatctaatgccactttgccttttcttcctctgtatgtggtcttctctctttctctagtcgctgaaggcttttagggtttactcttctctcctggtatcttaaaatctcaagatgatgtgcgttggaataggttttttgcattcattatgggtcatttttatctatgaacttgtgtacttaagtcttggatttaaaaaaaatcggacagtagtttctttgctgtctttcagttttgttaactgtgattctttctggattgattctctcaaatgccttatcttttccatcttatcgtctgtcttttagtcttttgttctgctttatggaatattgcatcatttttgtattttattttttattttgatgatcagggttttactttgtaagaactctgttttctagttccttctaaagcatttgtgtctgttttataaatgtaatattttctctaaagcaggtgttggcaaactttttctgcacaggccagataataattgaggctttgtgggccatatggtgtctgctgtaactcctcaactgtgccattgtcgtgtgaagtcagctataggtggtacacaaatgggcatggttgtgttccaaaaagactttatttataaaaacagcagctgaatttggccttcaggctgtagtttgccaagttctgcacacatctctaggttattgatttcagttttcaataaagtttttatcttaactatttggcaaaaccatagtagtaataatagtcttaggcaagactcttcagtagatactaaaatatgtgggtgaaagtatgatgagaaaggagatattgacatagtctcaaagattttgccacaaaataatattagttacaaaggaaaaaataggaagttcacagtgaaggagcctaggacagcaccttaaccagtgcttagcagcgtcagcaatgggcagacgtttgcctcctgatcatgccatgagaaagacaccttatcactttgtggcattttatcaaaaatgtataacaaggatggtaacatggggaaacatcagacaaatataggttggagggaactctgcacttaaatttgtacttgtagtctacattcccctttaaaagtgtcggggtcataaaaggcaatgtctcctcgactggagggggcagatgaaagcaacgcgtgatctcagatgggatcctggatcagaagatggcactaatggaaccacaggtgaaatgcgaaaagggctgtagtttatagcatgtcagcattcatttcctgactttaatatcaaaatgtgacgtcaccatttggtgagtctgaatgacgggcatatgggaaaactttgttatatttttgcaactgttttgtaaacctgaaattgtttcaaagtaaaaagttaacaaaaaaaaaaaaaggttttcacatcttcccatgccctttgttttgtggaattcaggctgtctttgtcagtctatttgccttgctctcagggttgcctgttggagcctctgtgtctgctcatatttaagactgaggccctcagaagtgcagcaggaggtcagccgagggaacccacttgtgcaggaggtctgccgaggggacccacttgtcaactgatgggtacactggagtaattgggccctgcactgcgtttggtactgggacctccaaatatgcgtattaggaagtctgttctttagggctgccagtttcttcacaggagaattctcccatttcacaagagcccagggttgcacaagagtccctcgtgtaaagggtgtggagaggggcttgctgtggttacagcctggagaaagtaaacctgccacagcttgggccatgctgagaagggaacagcatgtccagatagagttggacttgattctttacatgatcggaagttcttaaatgttttgctttgttttcatatacaaaggtaatacattcaaataataggaagatataaatcagaatataaatgaaaattttgtttctaaactactccacctccatttggccaaagcaaactgtcattggttggacgtggtttccacacagatgggaaaggatggattggagcaggaggacgtgaaggcagggataacaggtgggaggtcgtggtgggaatctgagcagaagtaacatttgtgtgcttttggcctcctatgattaagggtgtgagaaagggaagtggaccaggacatgaagcaaaagatcttaggggaaaataatttaccttagtagtatttaggtgaccagagctttccaaacgttagcaatttgaaaacaactgggaaatctactttgggagacacttaaaaatgtctttctccaggttcctaaatgacaagacaatatatattttttttaaatcaaggagttcagtttgataattatttttagtttttttcttttgaagcactctcaaaacttacagaactgttacaagtgcagttcaaataacttttttttaaatgactgaatcatttgagagtaagttgctaacaggttgccccatcacctctcaatactttaatgtatatttcctacaaacaaggatagtttcctaataacataatcacagccaccacaatcaggagatcaacacaactgatgacaatgatctcatgcttagaccgcccccattcacgtttccccagttgtcccagtaatgacctcatagcagaaggtccagttcaggatcaggtgctgtgtttggttggcccatggctctcctccccttcactctggaatggctcaccaggcttcttgactattacgaccttgatacttttgaatgtcacaggccagttatttaaaagaatgtccctcaatatgagcttgtctgataatatgtatttgatactgtttggctgtgttcccaccacatctcatattgaattgtagtttccataattcccacgtgttgtgggagggacctggtgggaggtaattgaatcataggggcagttacctccatgctgttctcatgatagtgagttctcatgagatctgatgattttataaggggcttctcccccacttcgttctacactctccttgttgctgccatgtgaagaaggacatgtttgcttccccttccaccatgaatgtaagtttcctgaggcctctccagccatacagaactgtgagtccattaaacctcttttctttataaattgcccagtctcaggtatctcttcatggcagcatgagaatggactaatacagcatctttgtcagaaaatattgcagaagtggtgctgtgttctcactgtgtcctatcggggtcataggatttcaatttgtccccttaccaaactgttccctgcaggccctggatgagaatggtgtctggcatcttctctggttacttttcccaccttagtgatgattattttgtgggaggtactttgaaactaggtaactgtcctattcattggcaaacttttaacatatttatttgtttctatcagtatagaatcatggttttctttttttcctcactgggttgtcatcagttaccattattatttatttctgtgctcaaattttctcaggtctgtctggcagaagccctggctagtgatatgtcccccatcactctctggacacttcctttctggaataaggtggttcagactcatcctgtactttccctgccacagccctggaatcagcctttcttcaaagagcgtggcttccttctggtggagagtatttggaaacaaagatgtgggtgccaggcatgctcattcctactgaggtgtcactgcttcacttcctctccaagaacagcatcaggaatgtaagtattccccctcatatgtatgctacacattcacttatatcctttttttaggttgttgcaaaagtaattgcggttttgccattacttttaatggcgaaaaccgcaattacttatgcacgaacttaatatatccgcagatattgaaaagcacgaattcactcctgtatcttcagtttcaacacagcaccacaaggtcattcttgttttctcctttggatgcttggtgctcgcatgcccacctgactcccatcatcctgaatctctttcctcctcggggcatcccatcccatctcccatcacacctctcctgcagatgcctcgcttcctctcctgggctctgacagattgtgatgagaggctcaggcacaaggagaccctctgcactatgccagggcccccacccctcatgcctcagggcgcccactcctgtttgtgcggccctctcatctactgaggctcagaaatgtcacactcaaccactgacctataggattaaagattacttttcatgcccacaacatcctggcattcggatggatgatgggcagaactcgtggttacttgcagctccaaatgagagaaggctgccagatagggctgcttgggggttgcccctggggacagggtaacagcaagctggcattgcagaagcagcctattaatggtgagctggatgtggagggagactagctaggtctggcagcctccctgtggattggctgacttgaataattctgtgggcatatcctagttgtctggtacctggccccggagccattaaggctggcacatagtggacattgacgatgagagcctgataagggaactggttggggtgtggacttaactgctcaggaagggaactgaccagcctctatcctcaaaatcgggtcaagcattaaatgggtacagcattaaaaaaaactgatatggtttggatttgtgtccccacacaaatcacatttcaaattgtaatccccatatgtctggggaagggtctgatgggaggtgattggatcatggggccagtttccccatgctgttctcgtgatagtgagtgagttctcacgagatcggatagtttaaaagtgtggcacttaaccccctcgctttctctttccggccactacgtgaagaaggtccttgcctccccttcatcttctgggagccctcccagtcatgcttcctgttaagcctgcagaactgtgagtcaattacacctcttttcttcataaattacccagtctcaggtaattctttatagcaatgtgaaaacgatacaataacaaaccaattttcagccactccttctaagccctgcctcctctaccaggcaccccagtcactccacctgggccttaaggatcgctcatcccaccagctgcaggtactgccttgctctgctccacttaatggctttaggaatccacagtgggtgaaggggagatatttctcaaggattaaatatgctaacatcatgtaagttctgtgtgtcatcactgttcacagattatacccagtagaagtactagctttttgcggggactgaccatcttaatattgtgtgtgttaatattgtgtgtgtgttaatattgtgtgaaatgcagttgtcagacacatgaaaagaaagcatttactaatcatactcctttgtcagagataaagctttttgtttgcaaagcaagaggaattattgtgctggggtatcttgactacgaagaaaaaatcacgaggcagggctcattgagctgaatcaagtcaagaaaagtaacaggtgcaaactcttaatcatgcagctggcaaagaaaacaagtttgagttacaagaaagcatacctaccactagtgtagaaaaaaaggacatgttttttatttcaagtaaactccagatgcaaaatcttgtctgattcaaaattaagtcaaagatctgaccgtcctttggaaagttgacttttatatgtaactccatagttgtctcttattttcattaacatccacctaagtctaatgatcataacttcttcagaaacaaaatgttctcctgggaaaatctatggaaactgttttcccaatacttgtaatggaaagaggttgtacctttaacacattggatggtttcaggcacctgtgaacctttggtgcctggaatatcatggcatttacctgcaggctagggagtattttgtggtcttccgtggctgcaaggagtaaccctaggttcccgtgagctatggggaatatgagccagatcactactgggtacatctcgagctgcagaagcccctggggctgcgaggcaggttcactaagcactgctctgggaattaaacacaaggcaagaaaggaggggagtgtgtaggacacccaaagaaatgagggctgctatggggaaatgaaatgcatgttcgagagcagctgaatggcagctctcctttgctcactgcagccgaggaggtccaccaggctcccggggaagagcttagaagaaaaggctgggctgtgggcaaagcaggttaaaggtgcagccacagaccatgtcaggtcccctgccaccagcacaacatgcaagctctggcagggatgcaggatgcgtgctcacacatccatcactgcagctgtgcaggatgttgtgggcgtcagtttgttcctgaatatgcgtgcagagatgagcgcatgccctgagaaatgtgtaaacattggggatttgtcaggttttagagtcacatgggatggggcacacaggtcctcagcctctttcacctgcctcagcctggacagctggcctgtgccaaccccctcactttaccttctggcctcctggtgatgataaaaatgaactccgagaggtgctcctaaggaaaatgtgtgtttactgcttgacatactgtcacatgattgagtcagtgaaacggctataagaaatacattaatctttatgtgttttgttcagaaaagtgcccagaaatgcaagatgaaacacctgtgatttctcactgacttaatcttggtaaaggagaaagtgaaaaattcaccatgaaataataatagtagctttcatttttaaaagttggaaccttattgtgtgccaggcattatgcaataagcttcacctatattttttaaaatcttcccaaaacactatgggcagttggtatgaaaatggcatttaaaatgaggaactgagcagagaggttaaatgcccagaggtgcacatctggtactggacaaagctaggattggcctggacaaagctaggattgacctgattctaaagcccatggcctgttgtcccatattgccacctgtgcacccatagtgctggacggtggatgatggattatgaacatttgacacacaaggaaaggtcatcacataggtatttagcagagcataaataaacacacgcagtgaagcttattctgcctaacagggataaggccgtttgaaagaactatgtcttaaatcaatgaaactggtatatactaacacaaagaactgagaataaccaagtcactttgaagaagcggaaggtgacagggcttgctctatcacatgggaaggctttgtgtaacaccacaggaaattagagtgccctttggtgcaagaaaagagtaaatagacaaatggggcagaacacagaactcaaacagacgcacagagaagggcagctgttttatggcaaaggtggcatctcagagcagtgggggaaggatggacattttcataatgatgccgggacaattgtgtagccatctggaagaaagaaaagtggacctacttataccatgccctaaatgtggaaagcaaagtaaggaagcttcaggaagacaatatgggcagtatttccatgttccgtcatctctgacgggcactcaagttgggaaccattcttttacttttttagaaataggactctcacttttcttaggaaacatactctctcctttgataactcttgct

SEQ ID NO: 977 - DNA, 1451 bp, Homo sapiens
gccctggcgcggtcctgtggtgaactccttgtctctatggcgactggacgcggtcggatcttgcagcagcactggctcggcctccagacgctgcgcgggcccagcaggggcggtggcgcggcccgggggcgcgccagggcctttgggtgcagaaaggggccaggggtcaagctttctgcaggctctgctgccctgaggtgccatgccggaggtggacagcactgggagagctctttctcctgctgttctgggttcctggatggaatgccttcagaaatcttgctgaagatattttcctacttggatgctgtgagccttctgtgtactggatgtgtgagcaggcgcttttatcatctagccaatgacaattttatttggatcggaatctactcaactgctttttcacctgcaagatcaaattggaaatttaattcagtagagaagatagctatgtctatgagctttctgtcagttcaggataaagaagctggttattggaagaaagaatatatcacaaaacaaatagcatctgtaaaagccgcactagctgacattctcaaacctgtcaacccttacacaggccttccagttaagaccaaagaggccctcagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacatagcccctatgaactgcctccacatagcccctttttggatgatagccccgagtatggactgcacggctaccaactccatgttgatctgcacagcggtggggttttctacctatgtggtacatttcgcaatctcttcaccaagagaggaaatattgaaaatggacatgtgaagctcattgttatacatttaaaaaataacagagaacacctacctcttattggaaaagttggcctctcgtggaaaactgatatttttgatggctgtataaagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgcag

SEQ ID NO: 978 - protein, 452 aa, Homo sapiens
ALARSCGELLVSMATGRGRILQQHWLGLQTLRGPSRGGGAARGRARAFGCRKGPGVKLSAGSAALRCHAGGGQHWESSFSCCSGFLDGMPSEILLKIFSYLDAVSLLCTGCVSRRFYHLANDNFIWIGIYSTAFSPARSNWKFNSVEKIAMSMSFLSVQDKEAGYWKKEYITKQIASVKAALADILKPVNPYTGLPVKTKEALRIFGLGWAIILKEKGGKEYIMEHVDLSINDTSVTVIWYGKKWPCLASLSTLDLCGMTPVFTDWYKTPTKHSPYELPPHSPFLDDSPEYGLHGYQLHVDLHSGGVFYLCGTFRNLFTKRGNIENGHVKLIVIHLKNNREHLPLIGKVGLSWKTDIFDGCIKSCSMMDVTLLDEHGKPFWCFSSPVCLRSPATPSDSSSFLGQTYNVDYVDAEGRVHVELVWIRETEEYLIVNLVLYLSIAKINHWFGTEY

SEQ ID NO: 979 - DNA, 22567 bp, Mus musculus
  misc_feature (1)...(22567): n = A,T,C or G
ccatggctttaaaaaaaaaaaaagaaaggaaggaaggaaatgtgttgtagatgcagaaactgactcagtacaattgcgggggcaaagtgtggcttccaggagcccagggaaaatgtcaggtccaggccctgcgtttcttacagcccggctgttgtattctggtgcctgtttttcctcgtgtaagtggagctggttctactcacattgagagggctgaaggaaatggcaggtggcttgctgcccaagaccacattgctccctacaacttgttggtctctcttgtagatcacacacagtgtcatgcctcacactgtaacagcaagctaccaatcacattaaaaaaaaaaaaaaaaaaagcaatccaggcagtggtggcgcacgcctttaatcccagcactcgggaggcagaggcaggcggatttctgagttcgaggccagcctggtctacagagagttgccaggacagccagggctacacagagagannnnnnnnnnnnnnnnnnnncctggctgtcctggaactcaggctgtagactaagctggcctcgaactcagagatccaccgaccattgcctctcgagtgctgggatcacaggcatgtgccacccctgccccgcagtgactgagctgatttgtaaagccactctcacatcaggaatgacagctgcaaggtcggagtgtgagaagtgacaagctgactgtggcattgcacactggatccaaagagaaggttgtaaaagagctgggttggtcctgtcagccccgtcaaagtccccaattcttcagaaggtggcttaacacacgggacctgggggtgctgttgagggagcaggggagccaagtcctgagctcaccgcactcggatgacgcaaagaccatagctccttccagaacatcccaaggccctgccctactgtgaagttagggtcagtcttacctctctgggtttgggtttggttttggttttttcttcaagacaggatttctccatgtagccctgactctcctggaccaggctgtccttgaactcaagagatccacctgcctctacctcttgagtgctaggactaaaggcatgcgctaccacacctagcctgaagtacctttctgtcttgaaggtagccccccctgcatcccagttttgtaggttcccttgaggccacacacgtcacctgacacttgcagagtgcttcacgcttcacagggctgtgctctcgcagtggcagctcctgtcaccctcccagcaggcctacaggcttcatgagagccaaaggtgtgccctttggggcacagcctgcattgccctgagctctgtgtggtccaagagatggaaacacaggggtttatgcctgaggaagcagcagtcctgtgagctgaaaaacctccctcactgcagactgccaaggtgctctgtcagtaccacaggtctgactcaggcgaccctgacaagacattcagtcattggggagtgggaggggggacagcacaggtggatccagaaatagggggaaggctgcaagcaaatgagaacatgtgcactgtccctagagatggactggaaggccagccttctcttagggactaacattgttcccagaccacagtaccctgggtcctaaagtggggtcgggagaggcggtgctgctggagcaacatctgagctaaagaaagcatggggacactgttatgtcacctgctgacaacaggaagctgctctcctcttaacccgctctgctagtgtgatgtgcacatctccgcctcaggtccctgtgccacattttctttgccacctggtgccatttaacaagagaaatggcatcacattctccagcgagggcctgggagccttccaggcgctggggagcttcaggctgtcgctgctgccagctccctgccaagcttggcagggaccgtggaactagaggcacctctctggggtttgggctggcctgctgctgatgcacagcagagctgagtgacacttaaatggcaggcaggtgccctcagaccttaccaaagacatcggggagcagttgctcctggcagtatgtctgactaaggacttgacactagtgtacccaggactggggcctgctgctgaagtggagttgttgggtgactccgacccaactgaccctagaagctaccaggtgcctgctacctgtgttaggactaagattctcccgagagagcttgatttacatcacaggttccccgggctaggctacctgctatgagcagttcttagacccctacaggaagcccagctctctgcaggaggatgcagagacccaagagttctggcagctgtccagtgggacttcttgtccctgccttagtgatggctagccattcctatagagacaagggatctgcaggatggcatatccagtaagctccacctggctgggtgcggtagccagcagatgtgagagggactagtttttcaggccagcctgggctacagcatagaaccagttcataagacggggaaggctgatgggacggtttgtaggctagaagcatttgctgtgtgagtctgtcttccacataaaggtaggaaataatgcattgaaacttgtcctctagcctcacatcattcaatatgaatacattttgcaaggggtggggccgtagctcagttggtaaatgcctgccgtgtgtgtgtgtgtgtgtgtgtgtgtgtgtgtgtgtgtgtgtgtgtgtgtgtgtgtgtgtgagtgagagagaggttcagggtcatcgacaatgtagttcatttgaggccagtctgggctgtatgagaccctatctgatgtgtgtgtgtgtgtgtgtgtgtgtgtgtgagagagagagagaggttcagggtcatcgacaatgtagttcatttgaggccagtctgggctgcatgagaccctatctgattgtgtgtgtgtgtgtgtgtgtgtgtgtgtgtgtgtgtgtgtgtgtgtgagtgtgtgtgagagaggttcagggtcatcgatgatgtagttcatttgaggccagtcagggctgcatgagaccctatctgatgtgtgtgtgtgtgtgtgtgtgtgtgtgtgagagagagagagagagagagagagagaggttcagggtcattgacgatgtagttcatttgaggccagtcagggctgtatgagaccctatctgatacaaaccagggctgtcaaggcaggatggctcagctggtaagagtgtttgctgccaggcctgacgccctgaatttcatttccagaactcactcctgcaaattgtcctttgacctccctgtgcgtgcacatgcccaccaccccaccaatgccatttataaaaatacaattcagagcaaaacacttaacagcccgcatacacacacttcagcagaggccggagctgcgtagtgaagagagagaggaccgggtctgaggggctggctcaccagcaggctcccgcgtgcttgtgagtacggaggtcagcttcagtgtcttcctctgctgccttatttttgagtcagcctctctcacagaactcgaagtaattatccgagatagcatcacacccctgtcttcttcttgtccctgccttagtgatggtggtcacaccccttgtaccctccttgagttttcctccacagcccttcttaccctccacctactagaatggttccttgctggaatttggcgctatgggctgcctgatgctgcttgctgctccaggacttactgggtgtctggtgcatagttggtactttccagatggtgaagtagccatccatggggtctccagaaggcccagggcccaaccccaggtcattctgcaagctggggaagctcccactcctcctccacagcctcactgcgggtacacagctgcctattggggcccctgggtgggacttgacgctgcagccaagaggctgaaggtctgtggtctcttgtctagtactgaaggccctgtgtccccacaccaaggccaggcttacagaatgacagaactggaacccagtgcacagtgggtgtgtagggagagggggctgggcgtgagtaggccaggctgtggagagtgaatgggacattgcttcctggaagggcatggcctgccattgactggcctgggctcaaaagagaagagacaggggcctccctgaccactgttgtgcccggggctcctgctgcagactctgtcccgatcccccaccattcccatccctcttcagtgaacggaaagcctgacattgtccttccctctgtctccactgacggggactttccaacatcatccccatttctcagaactagatacaagacggggagggcaagggagcgtctactctgagaactggacactgataaacagggtggggctggaaggatgcacgtgaagatcctgggcactgggaaggccccagggcagtccgtgttatgactcatgtctcaaatgaacaaaaagccatcgagtgtgtccccggggctgtgcagggagcacgggcactgggggactgccaccacttcaaatccagaaactctggtgttgatgggctcttaatgagcggcaggtattaaagctaaaaccggccttgccgcttgagaacaccccaggcaggtctcagcagtttcatatgcggatctgggaggctgggcctctctgtccccaggggactgcctcccccacccccaccacactgggcttgtcccacagacacagagtagccttacttccctgaccctgtctctgaagcatgaaggacatgtaacaggctctgcagtcaggtgggtgcagacccccatcaaggcctttgttcctgctggtgcatcctgtaagagctctctgcccctgaaagcctgtgtcttcctcagaaactgggtaggttttcagggcaagaattccaaaccctacccccaccccgaaatgaattacccttggggaaggaaaagcctggtgtcagggactttaatcccaacactgagacacgggagaggcaggtggatctctgagaggcctcgaatctgggcctagaatgcccttagctctagcacttggtggaaaggtcgggagttcaagaagatcacccttggctaaattgtgagttcaaagccagcgcttagcaaatgaaaaggtggagaccagcaagacaaaaatttgattaggaagcggtttcagcgacaaagtccctttttttttttttttctttaatttttcaagacagggtttctctgtatagccctggctgtcctggaactcactttgtaaaccaggctggcctcgaactcagaaatccacctgcctctgcctcccgagtgctgggattaagaggtgtgcaccaccatgcccggcgtttttttaaatttttatttttggtttgtcaagatggcttctctgtagccctgactttggtggagctcactctgtagaccaggctggccccctaagtgctgggatgggaggtgtgtgccagcaccaccaggcttaaaaatccgtcattttatattcaagaatatgacatgaacaggctgttaagaggtgctcacttcacgagccagccacctgagcgtgcctccgacaattctcgagagctgccctctgacatggtatgcaccgggacacacgtgtgcttcgctcacacatgtcatacacacaaataataataaaataaaattttggtgttttgtgtaacccaacctggccttggactcctgatcctcctgccccacccccccccaccccccaagggctggctctctggataccatccttagcagcatgggaaggaaagagaagaatacgctgaagttctatcaaaagtttgaagtaaaaattgcactttttggtttttcttaatgggtgaaagttgggctggtgggatgtccctgtaggcccagctacaaaagaggtagaggtaggaagcttgcttgagccctgaagtctgaggccagcctcggcaccaaggcaagatcctgtcctaaacagatatataaataacattaaaaaaaaaaaagccaggggctggagagatggctcagtggttaagagcactgactgttcttccagaggtcctgggttcaattcccagcaaccacatggtggctcacaaccatctgtaatgggatgcaatgccctcttctggtgtgtctgaagacagccacagtgtactcacatacattaaataaataaataaatcttttttttttttttttttttttggcttttttcaagacagggtttctctgtatagccctggctgtcctggaactcactttgtagaccaggctggccttgagctcagaaatccgcctgcctctgcctcccgagtgctgggattaaaggcctctgctaccatgcccagcaaataaataaatctttaaaaaagaaaaaaaagaaaagaaaagaaaaaagagcaagacaaaatcctgttaaaaggaaaatgtgtaagccctacagcgaatttgaaactaatttcttgaggctggtgagatggcttagagggcaagagcactgactgcacttccgaaggtactgagttcaaatcccagcaaccacatggtggctcacaaccatctgtaatgagatctgatgcatctgaagacagctacagtgtacttatgtataataataaataaatcattgggctggagcgagcagaggttctaaattcaattcccaacaaccacatgaaggctcacaaccatatctgtacagctaccgtgtgttcacatacataaaacaagaaagaaactaatttcctgattatctcatactcaaaagtggcacagaagggcttctggcttgagaaggtggctagaggggacacagaagccacgccacccccagactaagccctgtgctgttgtctgtcacttgtctgagtcaactccttttcaagaagctggtagtaaatccatgtgatgcagaggatgagtttaaaagtgactgagcctgctgggcgtggtggcgcacgcctttgatcccagcactcgggaggcagaggcagaggcagaggcagaggcaggcggatttctgagttcaaggccagcctggtctacagagtgagttccaggacagccagggctacacagagaaactctgtttcgagaaaaaaaagaaaaaaggaaaagaagaaagaaagaaagaaagaaagaaagaaagaaagaaagaaagaaagaaaggaagaaagaaaggaagaaagaaaatacattgaaggtttagcctaacatttcctgcatccgtgagctctttctccccatccccttctcttcccctcctggtcttgttctctcttgatctctgggtcttatgtaggtcaggatggactcctcaagccccttatgccgccaaaggatagccttgaacttctgccccccccccccccccacctccctaggttcctagcgcatgcagtgctggggccagaacccagagctttgtgcatgctagacaaatgttctaccaactgatagcattagtccccaaatctctcttcttcctttgggggggggggtttcaagacagggtttaacccaggctggcctcgcaaatctctcttcttaaccatgagaggaaaccatccaagcagagattcaaggaccaccacaacctctgccccacccccactgcagacagaggttcaagtgaaaatacctagctgaggtcaggcacctggacacaccacagacatgaatcccacaggccttttgctgtcctgtccccacacacacacacacacacacacacacacacacacacgcacacaccccaccccacccccacccccggcttagtctggcacctgtctcaatgggacccctaggaaatgcctgacagacaaatatttgtgtcaagtgactaattttgcttctgtccttccagatgtcaaaactccctctctggctgaggtgaagggctttgtaattgtgactgggagttccagccctcttgcttgatgccccgagatgagccctgtctgctgcaggagctggagcagccaatgatcttcatcctgtaggaaagtaagtcctgcttgcaggctggcttctttggtgtggtccatgtgcattatcctagccctgaattcctgtaagcctcagtctgctcagctccagtgtcggacaccaaagctaggatgcctggcacataagcaaggctccatggccctaacagtgataagtaacagcggcccagtagtgatagaggtgggtgagggcagaaggttgctgcaaagtgtctggtctttaccttcatgcctctgtcctatgagaagggctgtccctgccctggctcctctcctaaccctttccctccccccacatccccatacacccacactcacacccacacccaccctcccagacccacttctcctttgcagctacgctgacgcctacaccttcctgctgtggagttgctggtccataggcaagggggtggacaggcaatgggccagaacccctagaagcccatttctgtggtggtcctcactcagcgtctccatctcctcttaacaactttgatcccctcactccgtggtcagtcctgcatcatccccagaactggactaaagcaccagcctccttgcctctccatccagtctccatctgacatcccactaaagcacaaggcagagagagacacacactcaaaacacaagaggtctcctcaccaccaggcctccactccagctggaccccatccatctatccctagcaacgccgctctcacctttctctcagcactcctcaagcagtggccacgttggttggtttccagtatgtgtggcctggagggcatgtttccctgccccttgcagctgctaaagatatctctaagcccctagccctgagggctcagaggtctatatggcccaccttgaggcccaccagggaactccaggccccagctcctagctggcagctccctctggcatttcccaggccatgacccctggggagggggctgcacatatcccaagacccccagagagcttgtttgtgtgactgtgactggggctgggtctgagagacgctgatgagagagacaagtgggagagaacatggaggtttgggggggggggggcagagcctgatacaacaggcacagatgtgaacaagcttatgatctaagaaaggacctgcagggacagggaggtcccttgctaatcctcaggtcttcccagggctctgcttgctgaaagctagtgtggctctccagcaccctgcgaccagagtccaagttttctgctggtccagcctgccccacaggtctgagcacaacttagcctccccatttaaggcaccgggcttttgctcacgttctaccctacactggccactagtctttacctctctaccaacaccatgtcattttctcaatcgaaccttcctgttatggttggtgctgactggcactggtggacctcaggccagaccccgtgcctacccactcccgtggagtccaggatgactggcaatctgtccccattactctcaaaggggactctgcccaggaggtagggcagggcagagggcatggatatggaagattagagagggcagtgagattaggaagtcttttatttatcggtgtccctccagcacccctgtgggcattcccatgggccactcaagatgatctgatgtctcaaccctgggaagggcagagcaggaagcaggagggacttggaggcagatggttagtggaaacaattggtcttggtgaggcacagcagcagggggctggaaaaggtaggcggctacagggtccctctgctgtccaagagcaggctccagtgtgacccccagcgcagatgatgctcagctgtctgtcgtctgcggtgacagttgagtggtttaatgcaggaaccacaggtgaaagaggtctggggttccaggcgaggtcgcagctccaccccagtggtcccaccccagcaggcaagggcggggcggaggatgctgcgtcgcggtttcattctagactacagggcacacagcccagactcggaactgtcccagctgcatgaggcggcgacatgggcgccaggagactaccgggtccgaagccagaggagccgggacagctcggtgcccacccagtgcaatcagaccgagtgcttcgaccctctggtgagaaactgcgtgtacctgtgagctcttccacacgccggacactggacatagtaagcaaaggcatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtccctgcaggtccttttttagatcataagcttgttcacatctgtgcctgttgtatcaggctctgcccccccccccccaaacctccatgttctctcccacttgtctctctcatcagcgtctctcagacccagccccagtcacagtcacacaaacaagctctactgggggtcttgggatatgtgcagccccctccccaggggtcatgttgtgggggggacgacacaggactgagggagacctggagttgactctgatgctgtcataaagcagggaggacagtacagcccaagccttaatccaagcaagaagacccagaggccaaaaagagatgtttgggacggaggtgtctgccctgacatttgggagcccaagggcctgatgctaggttatgccctgtgggctgaccagacacccctctccctcacctcatcttatcaagtctctgaactcagcacttcctgtgttgaagacctgtcacgtgctgttccccgtcctcctcctagggccgtcccagaggaggcttctagaacgggcgtggggggggggggggctgtgattccgtccttcctgccttatcttacctgctccctctcccaccccagagtccctggaaaatgtctttgtaccctcctcagaaacccctcatgcctcagctcctacctggcctccgctcaaagaagatgcagacagcgccctgccacgccacagcgtcccggtgcccgccacagaactgggctccaccgagctggtgaccaccaagacagctggcccagagcaatagcagcagtggaggctggaacccagggatctctactgggcttgtggacttcacccaacagcttgggaaagaacttggcccttcagtgacggagtcctttgcctggggggcgaacccggcagaaccagacactacaggccacatgagattgcttttgtgttagctcttgacttgagaacgttccatttctgagatggtttttaagcctgtgtgccttcagatggttggatagacttgagggttgcatatttaatctctgtagtgagtcggagactggaaacttaatctcgttctaaaaattttggattactgggctggaggtatggctcagcagttcggtttgtgtgctgttctagccgaggactccagttgttcagcttcccggaactcagatctggcagcttaagaccacctgtcactccagcccctggaacatccttgcctccaaaggcaccagcactcatttgctctagagcacacacacacacacacacacacacacacacacacacacacatatgcatgcatgcacacttaaaaatgtcaaaattagcggctggagaaattcatggtcaacagcgcttactgtgattccagaggatgagagtttgattcccagaatgcactgcgggtggctcattactgagcataacttttgcttcaggggacctgatgcctctggacttcatgggcatctgtattcacgtgcacatcctacacacacacacacacacacacacagacatacacacacacacactcttttacaaatgataaaatataagataggcatggtggtacacacctttaatcccaacattggggaagcaaaggcaggcaggtaactgagttggaggccatcctggtctacatagcaagttccaggctaaccagagctaaatggtgagaccaagtctcaaaataatactccccccccaaaaaaaaaaaacttttaaattttgatttttttcttttattattattttttatattaatttcatggtgtttagaagtggtatacttagatggtgactaagaggaggtaaagccatcaggactgagcccctaacatacaaggagaaagcagagacaatgaacacgcccctctcctgctgtgtgccagctctggaccaccagccagagggcaatcatcagatgtgggccctagaaccttcagagccgaaagctaaatcaatctcatttctttgtaaagctatttagccttaggtgttttgttacggtgatataaaatggactaacacaggcactatgagtaagaagcttttctttgagctgggaaaggtactgttaaaccaaaattaatctgaataaaaaaaggctaaggggaagacacttactctgtgcctgggtgctgtgtttctttaactcctgctgggggcgctgttctgctttgaagatgactcaagtggcagcaacagctgatggtctggctgtggtatctggtacaagcttcactgtaattttatatttcaccatattggggaccggacccgcactaaacggcactctacagtgagcgttgccctaactgtaagatcagtttttagaataagcagggactaggggagaggcctcggtagggtagtgatgagtctcggttgtctgtaacccaggaagaaccatggatttctttgacccagtctgctaggacgtaagatgccatcttcaccgtgatggctgtttctagagacctgtgattcataggcagacgtctgtagtctcaggttggagtctaaatttaagcagatggaacatcctggcggtgatctccctccgagacccgctggaggccgtactcagcagtgtggtgtgctgagcagtgacctgtacagcactccttcacagagaggccaaggcaggcctgtggctctgcagcaagccgagctaagatggtcctttgtgttccctctgtggactgctctccccttgagctgggctttctcagccaagctggccccaggctcaacaccacccttgtggaagctgtcccctgacagtggggctctttgttctgaagccactgatcctctctacccagtacctggggtacattgcacactcagagggagccatcatgtctcctgcctgccctcctgctcccggggaagctgcactctagcatgtatgggaaggagcactgacctgcgagtcataggtggagtccttctgcagagtcttgtctgagttctgaccctgccttccagtctctttgaacccacagctgcctggcagcacttggctctcctgtgcagtcccttcctagtttagaaaatggtacccagtggcagtttagagcgtccagaacctggacatttatttccaagatgttcttctctccaggggttgtgtgagtagggtgagatccgatgacaacagcaggtgacaggcatcagccaggccattgctgtccactagtgctagcctggggctggaggagtctgaactgaccctggctacctgtattagctatagccagggtctaggctctgacggcgaaaaaaaactagtgaaacccccatggggtcatggcatacaaacctttggcacctttccatcccagctaagcggctggctggtacacagtttccctcagtctcagtttcttttgagaaatgggggatgggtacaaagttctttttcgggtctcccggctggaagggacctgagagaagtctcacacgcgtccccgtctcacaatgaggaaaccgaagcctaggcagccagagaacctggcattatcatttttgtgaagaagaagggagcagggcagtggtggcgcacgcctttaatcttagcacttgggaagcagaggcaggtggatttctgagtttgaggccagcctgctggtctattgagtgagttccaggacagccaggactatacagagaaaccctgtctcaaaaaaaaaaaaaaaaaaaaaaaacaacaccaaaacaaaactgaaagagaagaagagggagctctttgggaaaggcaggaaaagcaagtggaggggggacaaggagcaggaacactacactcccccccacacacacacacacacaagggctgcaccaccaggcaggcagtgaagtcggcaccccctccctgtttgtcatagatgttactttctgaggatctttgtccacctttcttcacttcatctccatgacaatggctggaaggtggggagggggggactcatgtttggttaaaacaattattaaatctaaatcaagacagtcattttgcatatgagtgggaaggtgcattgtggcagtccttactggaggctgaggagagctgaccatggcccagaggaccagcctctgcgtgtgtagtgtgtgctgtcatctataatgtcagctataaccgtcacatactcaaaagccctgtctccagtcaaagatggctcatggacggaggaaaggtgcttgctgctgagcctggaaacccaaatgtgatcctagaccctatgtggtggaaggggaggactgaatcccgtaaggtgacccttgacctccactagtgtgccctgtcccccacccccaactttttcctttaagtcctatcttgaacgtcacatacagtaggtttctgtcttgaaacactcccaattgggcttttcgatgcttgtcaagttttccatctgagcatctggtcccttgcaggctctgctggtgtcacaggcatagagcaagcgcctcctttctgcaaaaaacctgtgtggtctctcttgccagaaggaccaaagtgacaacggccttgacctttctaatgacctctgagagtccggatggtctcacatctatctgtaagagtggatcagagacacaaatcacaatgagtgatgggcggagcttaatggaggtttctgcccctacctggtatgcctacccaacccaacggggtcggggtggcggggaggtcacctacgcaagctgtgtcctttcctttggatggtctggtttccccaaggtccccagggactaacaggtgggggcagagggctgaagtctcagttccttttggtgcttcctgcaggccgttttcacttcctgcctggcagctccaagactgggggcgcaaggaggaggtggggggcccactagagaagccagaggggaagccctgctgactccccccacacgcatacacgcccgcacgcacgcacgcacgcacgcgcaccagacggtactgtccttagaagctgatagcatgtctcaaggcctgcctctatatcaagagctagggctcgtggctggggatgtggctcggttggtggagtccttgcttagatgcttgaggttcttagttctgcctccagcacagtataaaactggcacagtggctcacacctgtaatcccagcatttggaagatggatgcaggaagacgaggacttcaagaccatactcagctaagtatccagttcagagatcgtgtcttacaaaaaaacaaaaacaaaaacagctcctaaagcctacccagctgggctggagagatggctcagtggttaagagcactgactgctctcccagaggacctgagttcaattcccagcaaccacatggtggctcacagccatctgtaatcagatctgatgccctcttctggtgtgtctgaagacagctacagtgttctcatataaataaaataaataaatctttgtgtgccctctgtggactgttctccccttgacctgggctttctcagccaagctcgtttttggccccaggactctgctgcaggggcgggacaggatggatccctcagttttagagaacctgggaaaagctccagattcaggtccgccaagcatctctgcagcgggagaaagtctgtctgtgcagggcaggaggtcagagcccgactactagctgttaggtcggaaagatggggcggggtgggcgtggggcagaggcatggagaggcggggctgagggctggccaggttgccaaagggagagagtggccagaggtccaaggatgcagacttacaaaaggctggtccggtaggagaaatctgttctttgttgttgttgttttggtttgagttttgttgttgttgttgtttttgttgttggtggttttttgtttgtttgtttgtttgtttttttgagacacgatctcatgtagtccaggctaggctcgaactctctgtgtagcccaaaatgacctgaactcctgatctggtcttccccttacaagtgatggtgttcgctgccacaccagactttttcttttctttcttcctttcttcctttctttctttctttctttctttctttctttctttctttctttctttctttctttttttttttccgagacagggtttctctgtatagccctggctgtcctggaactcagactttttcttttcgtggtgttgaggatagaatcccttgtgcacactaggcgagctctctactgttgaagctacaaacaccagctcctcctcgagctcttttcgcagtcttccagtgccttcaggtaactgcagctggagcaagaggggcctggatgtgtgaaatcacacacttcagcatgttgtacaaaagagaagggtcaggccaccccaacagcccacgttctgagctgactgggagttaccccccagacatgagctgataaaacttccctgacctcctggctgccctgtctaacctccaccagccctgctgtcctagctctggcctctgggggaatcctgaagggggactaacacggtgggtgcaaactaggaggggagttacctgaacgggaagggcgaaggccaggatacagaatgactggggctagcaggttgagtcgcagcgcccagccccccaatcctgctgctcccttgagacctcaggagcctggtcgccccctccctcccacaggcagctggagcctgagtcacgagctgcctctcaggagacaaaggcagcctagggccctccctccagaccccctcctggtgccagcatctgcactagcagggagtctaacatccccccaatctctggaggaaatggaagacagtgagtttaggagtcaccttctcccttgagtggcacccaatgtcactatcttctcccaggtggttgcctatactggctgtttccagtcgggcctttcagcttctctttgtagctctgtgaaagaactgctagtcgtccatcttgctgatgagaaaataaggtctagaaagatgaatcggccctcatagagtagggattgtaacaggtctacagtgacacagggcatcatcgagagggcaggaaacaggagaaaggagaagcaacagtggctgaagggaggccttctgcacaggttgcctgtgtgcaggtcatgggggaagaagcgcctccctgggatcctgggggcttctagcgctgcaaaggcgggctcagggctcatagcgtggctccaggccagaccctggtcctgtctggctgtgtgccagccttaacaagccactttcttaggtttctgtctagtaaattccaaaccttcctgtccacaaccgtacagaataacagactggtcacctaacattgaagacacagatgtggagacccagcacctgcttttgctaatgtccatagagtttcgggggggcccccaggctcccacagccagagttaggcagggaaatgcccatgcaaaccccgtagtgcagtgatggcccctgagagcggcacccttgcccccccacatgcactccctcactcacaaccaggagcacactccgacaccgcctgcacacttgcacgcgcacacacactcggctgccagccctgggagctgggggcggggcgggtgcccttcaggcagacactcggctcctcttgcccgccccgtggggctcattgcagatgccaggggttattttaagcctggatcaatggacgattttttggtgacacaggcttgggagggaaagagacagggggcggatgccctagagctttgctgcgctcagaggccctggagtccaggataatggggtctcaccttcactgggctgcattatctctagatgcccctagcccagctcacggccatgtacccgaagtgggagtatcagctgcgtggagagtcagaccccagaacaaagacaagcagtgtcttttaagttactcttcctctgctgcccatcaccccaagaccatgtgtccacacagacaggcatctagagtttggcacagaccctatagttgttggcacctgtggtagttggctcaccgtagaacccacagaatcaggctaagctggggagagacctggggatgggggtgaggtttggaatcagtccctggaccaatggaaacaccacatagatttgcaggtcaacaagaggtcacccgtggagcaaatgccaagacaatagggggaagagaagaccccagaagagacgcagccacgggagactctgtacattgggagatgacacagttccaaagtacggnnnnnnnnnnnnnnnnnnnntttccaaaggtacggctcagagatgggagtggagggaggccaccctcagaatctccccccccccccccaacaaacaccaacgtagcttggcagagcgacaggaacctactgcacacacagcacagtggtggcagttgtcccatccttaggaaagccagggaaggaagcagagaaggatgcgtcagaaagcacagctatgaagttctgattggagcaacaacaccccaactgaaaacaagtcatgacatagtctgtaatgtgatgccctgcaatgcgttgtcctggtgggtgatgggattaaagcgcttccttcgtgtctctgtccatcttgtccatcacctccctttctgaatgacaatgtagaaagtctttttatggggatagggtctccaggactggattgggaatcacatgggtgtgtgtgcgtgtgtccagggaggggaagaggtcctctttcgccagggtgaacggagacagcctgggtgggggtagttaccctcctcccagccttaacccactaatacctgacattcctgtcagctcctcatctcacacaacaggacttgatcctccttaagatgcagatcctttctctccctctctcataccctccccgttcctaagctgattccaggctccagaggaggagaggtgggaaggagaagaaagggccctagaacagctaaattccccatcaaacaggagttagaagtatcatttcacggttccattcagcaggtattgacaggcacctgagctgagctggggacagagggctcgactggaaccctagcccttgccctcctggtgtccccatctggatagtgagaggtaatctctacctcctggaaggaatggattatgaatctgtccttcagagaaaggtcttgatttatttcactggtttttggggggtgggttgtttttgttttgttttttgagagaacatctcatgtggttcgagctggtcttgaactcctaatcctcaagtctacaggtatgcacgaccagaaccaaattgccagctttccttcccttcttcttcttccttcccttcccttcccttcccttcccttcccttcccttcccttcccttcccttcccttcccttcccttccctttccttcattcctttctttttctttttttctttttctttttcttctttttttgttttttggtttttttttccaagacagggtttctctgtgtagccctggctgtcctggaactcacactgtagaccaggctggcctcgaactcagaaatctgcctgcctctgcctcccaagtgctgggattaaaggtgttctttcttttcttgaaacagaattttccaataaagactgggctagcctggaactcaccgtgtagacctgtggttctcaacctaggggttgggtgtcgaatatcctacatatcagatatttacactacgattcatgacagtagcaagattacagttataaaggagcaattaaacaattttatggtgggggtcaccatgaggaactatgtcacagggttgcagcatcaggaaggttgaggacctctgatttagattaattttgcctcaaggaatccccctgctttgtccttagtgtgtgaaaggacactattttgttctgtttgctttttgagacagggtctcagcacattgccctggctggtcaaagttgtgagcccaagtggtcctccttcttcaacctctccgcaagccttcagtactgctatgccattgctggcaccaagaagacctttttgttgttgttggttttttttttttttttgtttttttgttttttttttttttctcgagacagggtttctctgtatagccttggctgtcctggaactcactttgtagaccaggctggcctcgaactcagaaatccatctgcctctgcctcccaagtgctgggattaaaggtgagtgccaccactgcctggctccaagaagaccttttgaccttaaccatagcaactgaggcagggagaggcaatgactggcatcagggtcatattctccttagcagctcagcgggggagtggtggaatggggcattgagccatgcctcctcattctttccctaagcttgtgaaaggacctgggagtcccagggagtgagagttgaggacagacaggggagtacaactggcctggtccccaggacctgctcagccttctatagcagaggccgcggaggggagccgaccacttgagggctctggccagactgtttccagaactgggacatcctaggaccccagccaaatgtccaggttttagaatcagggcacatgctctggggcagaccagagaggggttgatcaaagcttgattctgccatttttgtgttgggggtccttattgtgccttcctcattcatgtcaggaccagacacaggaatggaacattggggcgtgtgtgtgtgtgtgtgtgtgtgtgtgtgtgtgtgtgtgtgtttgtgagtcccttcccagtgaattccaggctgctttgatctctatgcctctgtccccttacttaaaaaagcagggaatcgctcatccaaggttgccaagatccgaatccccagatcttaagctgagccccctcgagggcccaattccgacaacagtttgagggaggtcttggagagggtccctggtcgggcgcgcttgctgcactgaccttacagaacccctccctcccggcgcagcggccgcgctcctcccccggttctgcctccctcccgccctcctcccctcgctccctcccgcccgcccgagcccgcgccgagcccgcgccggagccggagccggagccagagcgcgggcaccgcggagcgggcggcgggaagacagaggtgtccggcgacccgccgcccggcgcagtctccaaaagacccaggccccgcacgccctcccgggtcagagggagctggggactgtgcaggcgagcactcgccgcccgcctccaccgtgcgcagtccgaggtgagccccggaggaaaacgcgcccaccggagatccagccccgcgtactctacaccgagctcacttgtgtctggaaccgcagacgcaccaggaggcgtcggcggggagactgcgccgggcagctgggcgaccgagcgaccggtcccggagggctgggggagcctggcagagcggccacgcgccgagccatgcgccgggcgcaatagcagaaggagcgggctgcatggagcgcgctggggcgcggggacagcgctgtggccggcgctcgcatgggctcccgctcgcactccgactggcgctgctgctggcagggtcgccgtcgggccgcgcgggggctcccgaggagcaggagatcgcagggtccggtaccgtggcaccggcgggaggcgaccgctgccgcggctattacgacgtgatgggccagtgggacccgcccttcaactgcagctcgggcgtctacagcttctgctgcggcacgtgcggctaccgcttctgttgccacgacggcccgcgccgcctggaccagagccgctgctccaactacgacacaccggcctgggtgcagactggccggccgcccgcccgcgcccgtgacaccgccgccccgcgcgacccggcccgggagcgcagccacactgcggtctacgcggtgtgcggtgtcgccgctctactcgtgctggtcggcatcggggcgcgcctgggcctggagagagcgcacagcccccgcgctcggcgcacggtgaccaggtgagtgcgcccgcttgcctgcccgcccgtcctgtcttcactgtccctagctggctccaaatttcactgcaactgcatccttctggaccctctaaatctttggcctctccgcagtccctttctctttttgttttgttttgttcttttggacctct

SEQ ID NO: 980 - DNA, 1627 bp, Mus musculus
atgggcgccaggagactaccgggtccgaagccagaggagccgggacagctcggtgcccacccagtgcaatcagaccgagtgcttcgaccctctgagtccctggaaaatgtctttgtaccctcctcagaaacccctcatgcctcagctcctacctggcctccgctcaaagaagatgcagacagcgccctgccacgccacagcgtcccggtgcccgccacagaactgggctccaccgagctggtgaccaccaagacagctggcccagagcaatagcagcagtggaggctggaacccagggatctctactgggcttgtggacttcacccaacagcttgggaaagaacttggcccttcagtgacggagtcctttgcctggggggcgaacccggcagaaccagacactacaggccacatgagattgcttttgtgttagctcttgacttgagaacgttccatttctgagatggtttttaagcctgtgtgccttcagatggttggatagacttgagggttgcatatttaatctctgtagtgagtcggagactggaaacttaatctcgttctaaaaattttggattactgggctggaggtatggctcagcagttcggtttgtgtgctgttctagccgaggactccagttgttcagcttcccggaactcagatctggcagcttaagaccacctgtcactccagcccctggaacatccttgcctccaaaggcaccagcactcatttgctctagagcacacacacacacacacacacacacacacacacacacacacatatgcatgcatgcacacttaaaaatgtcaaaattagcggctggagaaattcatggtcaacagcgcttactgtgattccagaggatgagagtttgattcccagaatgcactgcgggtggctcattactgagcataacttttgcttcaggggacctgatgcctctggacttcatgggcatctgtattcacgtgcacatcctacacacacacacacacacacacacagacatacacacacacacactcttttacaaatgataaaatataagataggcatggtggtacacacctttaatcccaacattggggaagcaaaggcaggcaggtaactgagttggaggccatcctggtctacatagcaagttccaggctaaccagagctaaatggtgagaccaagtctcaaaataatactccccccccaaaaaaaaaaaacttttaaattttgatttttttcttttattattattttttatattaatttcatggtgtttagaagtggtatacttagatggtgactaagaggaggtaaagccatcaggactgagcccctaacatacaaggagaaagcagagacaatgaacacgcccctctcctgctgtgtgccagctctggaccaccagccagagggcaatcatcagatgtgggccctagaaccttcagagccgaaagctaaatcaatctcatttctttgtaaagctatttagccttaggtgttttgttacggtgatataaaatggactaacacaggcactatgagtaagaagcttttctttgagctgggaaaggtactgttaaaccaaaattaatctgaataaaaaaaggctaaggggaagacactta

SEQ ID NO: 981 - protein, 123 aa, Mus musculus
STHTHTHTHTHTHTHMHACTLKNVKISGWRNSWSTALTVIPEDESLIPRMHCGWLITEHNFCFRGPDASGLHGHLYSRAHPTHTHTHTHRHTHTHTLLQMIKYKIGMVVHTFNPNIGEAKAGR

SEQ ID NO: 982 - DNA, 21542 bp, Homo sapiens
cctcccgagcagctgagattacaggtgcacgccaccatgcccagctaatttttgtatttttagtagacacaggtttcgccatgttggccaggctggtctcaaactcctgacctcacgtgatctgccacccttggcctcccaaagtgctgggattacaggtgtgagagtcaccgcggccggcctaaggcctctctgctttgatgtcaccatcgcagctgggcccatgcccttcactgaggggtgggccgccttctaactccttgtaggtgtcggggatgcggccctatctgcccctttctgtaggttccttctggaacttagctcaggccccacccctagtgctcagtaagggtttgtagacacctggctgacttcctggcagtcccttgggctccgctgaggacttcagccacgtagattccggtcgaggccccacatgtcacccgacatttgcaggcacgtcatgcttcacagagctcttctcacacagcagacctgtgaggtagatgatgtttccccaattcacagttcatgaaacagaccgttgtcatgggaggtgtgtcacagtcacacagctaactggcagcagagccagccccactctgcttctctccagtttttctgtgtgcctgcctaatccttgaagaaaggtttggaggccaggcgcagtggctcacgcctgtaatcccaacactttgggaggccacggtgggcagatcacttgaggtcaggagttcgagaccagcctgagtaacacggtgaaaccccgcctttactaaaaatacaaaattagccgagcatggtgccatgcgcctgtaatcccagctacttgggaggctgaggcaggagaatcacttgaaaccaggaggcagaggttgcagtgagctgagattgcaccactgcactccagcctgggtgacagagagactccatctcaaaaaaaaaaaaaaaagatttgggcatctccactggccaggccctgagctggaatacagaaggtggagacagcccgtgtgctccagaaagcagcagtctgcaagccatggttcctgcctcaggatgggaccactagaacacagcatcgcgagagggcagggggtggcaggataggcccgagggcagaggcccttagcgtgggagcagagtggtgcaggctctgggcctgagcaggccttcgcccgcagcaaaaagcccctcgggcacttggtcggggaagccagcctctgcttgaggaggggaggctccagggcagaaggaagaggctggaggtgaaccttcactttggtccctgaagggatgggcagtagcagcagagcccggaaggccagccttcccagagagtgaccttgtctttggcccttctgtccttggccagaatgcgtgtctttgcagggtaactggagggtagagtaggtctttggcggggctgatggaatgggtgtccaagcaggggaggaaggcggtgtggatgcagcctgcctgatctgggatgtcactttttgctggcgaccaggaggagaggccttcccccacaccccctcccccccatgcccgcatggggcacctctctcaggtccctgtgccacattttccttgccacctggtaccatttaacaagagaagtggcatcgcattctccagccaagagtctgggaaccttccaagcactggggaacacagtgctgtcactgccgccagctcccagctgagcttggcaggggccctggaaccaggaggcctcccctctagagttgggggctggcctgcccctgcctcacagcagagctgagccacacttaaatggcaggcaggtgccctcagacctgctgtccctggaaggcgggggatgggtggccagagagtggggttgcttcacgccatctggagacccagtgacattgtccaggagacagtttggctgagggaagtaatggaagatcagtgtgtgccggaattggggcttggtactgaggtaaggtggagggagatgggagaggctgggcttggctgcttgcttggtggcgtgacctcaggcaggtcactcaccctcggcaagcctcagttcctcagctgtagcgtggcgccaggctaaccgatgcctttcttcctagctagttgaggactggcaatgaagaagccactattttatgtatttatttagagatggggtcttgctatgctgcccaggctggtctcaaattgctggcctcaagcccattattttgaacataaagctttaaacaaatgtcagatgcctcagggtggccatggtcatgacgtggtcattgcaggatgttgaaggcgggcaagaaccccctaggcctacaggctgggaatgggggggcgaaggctactggaagcggcgcctcttcagctgggcctggaagctgccccgtccgtgctcttataagctggaaggaaggtggtgtttgggccccactcttagaggagtagagcttactcggagtcacacactcatttgtccccctcattccacctggctgtgagcagtccttgggaccccagggagttcacgttctccatggccagtggtccaggcccgagtgtcctggcctcaatctgatggtgtttcccatccctaccaaggaggcaggaccttcctagcaaggaggggctctgcagcctgggccccgtgtctcctgcacccccggtgagcagaggcaggagcagcccagctgcagaggggaagtggtgcagtgggaacaggagcagcctccgagtcccaccgacttggggtctgtggctgatctgcagtgtgacttggggcagcccacttccctctccaagccccactgcctgccccccttttcaggtcttgtgaggctcggagagaaactgaagagcctgactccatgccagcccttccaccctctacagacagtggctcggtacgggctggcaggctggtgggcgaggagagccgtggggttcttgagacaaggccctgttacagttgcccccaacccacacgcatcaggggtgctgggccaggcctgctggcagggctcgagcacaaagggacgttttctggaaggttctgttggcttagcccctcccctccagtgtaccctggggtcagaaggacacaggcagagagtctctgtgaaagaatgtctcacacttgggggctgagggagacagtggggtgggctgccaggctgtgtaccctaagtctgcgggtcccacctgagtatgggatgctgtggactgggggctgctgagggcagctccctggggagagtgggtaggtacttcccagagccccggacctgcacaggaggcagccttccctggaccgccctcttccatcaaagggtatgccagccgaacttggggcccctgcgagctggccaggcccaaggggtcccccagccctcctcctccaatatgcttggccagcctccctgtgaggacacagacccctgggcctcacccccacccccaccccctctccctgccgctgtccgcacacgggaagaggaccccactgatgtgtgtagtgtggcaggctcaggggctgcctggcgggcccctttactctagcctgctttccctctttgtaaagtgggaccagtcgtgctagccccacacagggctgagggaggagacggccgggtagggagatgctttgcgcacagcccttttcctggtcactgggccttctctgcttcccccagacatccttggggatcgctccaccctgtcctctgttccgaggtcaccatccaccaggccttctctgactcccctgtttgaaattgcacccataaccctcgagcaccctgcccttctgactttttctccccagcactccttacctccccacccactacgttgtgtcccatttgggtttcctctctgcttccctgctatttccccagaacccaaaacagctcctggtgcctggtaggtgctaagtgagtgagtggcgagtgacggggaggcatccgcgcaggggtcggcctctgcgttcacaagggccttcctgcgtggtaccctgaataaggcctgggaggttggccctgggggcccccgttcctctcccccttgcctaccctggccttacagcctccctctacttcacacacctggcccccaagaggtgggggctttgctccctgtggctaaagggctgtggtctgccctctagtctcacatggagggcccatgtcctctatcccggggccatgctgagagtggctggggtgccctggccagaccctgtggagtgcaggagcgcgcgtgtgtgcgcacgtgtgcatggagtggcgggctggatgacaggcagctccagcccatgaagacccaggcaaggatttgtgactgcttcatggaagggcgtgacctgccctcccctggtgtgggttcggggaggaacgggatctggggactcccaggcctctgcctctgggtcacactgctctggactcgccaggactttgtgctgattccgtggccactctgccctctcccaatgaaccgaggcccacggcactgcatcctttcccctggccccagcaagaggtactctgtagcattgtacttgtttgtgggggcttttaaatacaggagaagggaaaggaaataaccacaaggggtggtcctggcgctgtcatgagacaaaatggagccaagagagctgactcgaagccctgcaggcccaacccagccagcagagccatctccactgctgaccccattcctggaacacgggaaaagctgtttgtgtgtacacctacacgagggggcaaaggcacagaaccaggcagtgaagaaaggctcccaagggaaaacagagactccctctggggaccgtggggaaacgccctttgtcactcatagacttctgtattgtttgcaggtttttcctgagcacgtgttcaggtactactgcataattacaacgaaaactgattttgaagtacagagtgcatcccaggccccagagcagtttcacatccagatctgggggactgggcctctctgtccccaaggactgctccccatgacactgtgcttgtcccatccccagagtgctctcactttccccaaccccgtccctgaagcatgtagggcccaggccacgcttcacagtcaggtggacacagaccccctgcaggcccctcccatctgctggctcatcttgagagggcccttgccccttaaagcctctgttttctcatctggaaaatgtcctaatagtacctgcatcagatccttgtgagggtgtcttcaggagaattggggcacaaaaatcgacagaaacccccttctctctgaagaccccaaactatcttgttattttattattattttttttttttctgagatggggtctcgctctgtcagccaggctggagtgcagtggcacgacctcagctcactgtaacctctggcttccgggttcaaacaattcttcctgcctcagcctcccaagtagctgggattacaggcgccagctacgacacccggctaatttttttttttttttaaatttcttatagagagagggtttcaccatgttggccaggctggtctcaaactcctgacttctggtgatccacccgcctcggtctcccaaagtgttgggattacaggcatgagccaccacaccaggcccaaattatctttttaaaaagagtattcagtgaattaaaagtagagcatggtggccgggtgcagtggctcacgcctgtaatcccagcactttgggaggccgaggcgcgcaggtcgcttgagaccaggagttcgagaccagcctggccaacatggtgaagccccgtctctactaaaatgcaaaagttagctgggcatggtggcacgtgcctgttatccgagctactggggtggctgaggcacgagaatcgcttgaacccaggaggtggaggttgcagtgagccaagatcgtgccattgcattccagcctgggcaacagagcgagactccatctcaaaaaaaaaaaaaaaagacttgaataaagaaattaggccaggagtggtggctcatgcctgtaatcccagcactttgggaggccaaagtgggcagatcacctgaggtcaggagtttgagactagcctccccaacatggcgaaaccccacctctcctaaaaatacaaaaaattagccgggcctggtggcaggtgcctgtaatcccacgtactcaggaggctgaggcaggagaatcgcttgaacctgggagttgggtgttgcagtgagctgagttgggtgttgcttatcgcactgctgtattccagcctgggcgataagagtgaaactccatctcaaaaaaaaagaaaagaaattaggccaggcgtgttggccaaggtgggtggatcacttgaggtcaggagttcaagaccagcctggctagcatggtgaaaccccatttctactaaaaatacaaaaaaatttagccaggcatggtggcccgtgcctgtagtcccagctacgtgggaggctgaggcaggagaatggcttgaacccaggaggcagaggctgcagtgagccgagatcacgccactgcactccagcctgggtgacagagccagactccgtctcaaaaaaaaaagggacgcggtggctcacgtctgtaatcccatcactttgggagggcgaggcgggcagatctcgaggtgaggagatcaagaccatcctggctaacggtgaaaccccgtctctactaaaaatacaaaaaatttgccgggcatggtggcgggcgcctgtagtcccagctactcgggaggctgaggcaggagaatggcgtgaacctgggaggcggagcttgcagtgagcggagattgcgccactgcactccagcctgggcgacagagagagactccgtctcaaaaaaaaaaaaaaaaaaaaaaaaaagccacggggaaataagaatacattgaggagtaaactaacattccccacattggtctgattgtgaattcttcttaactgttttgtcatccaagtagcgacacagggcctgctgcagccccccacccccaccccatttaggaggcccaagtggaaaggttcatgtgaggccaggcacctgcacacaacacagacacgaatcccgcaggccttttgtcccggcacctggcccagcacatagggagcgcccagcaaacatttgtgtcacatgagtgggtgtctcatttgtgtctgctgctcttagcagctggcctccctctctggccaaggtaagggaccctggaactctgacagtgggctccagccctcccactctctctggccttgagagcagtctcctcgagtctctgctgggggtcagagcagccagtgcttctgctgtgaaacgcagacctggggcaggcggaccccctcctcctaactcctgtaaattctcccgactctggcctcactgggccaccctctccagggacaggttccccgttcctgggttcccacaagcctcagtctgcccacatggctggcacaagggctaaatgagctgcctggtactcagtcaggcctctgcagccctcactaatgggtaataccagcaccaacatggatggacgtgtatgtgggtggcagggttatggctcagtcttctggctttgtccccacctctctgcctcacagagaggccttccctgccctggctcccctccagggtcctgtcccccatccctgtaccgtacacccacgctcacccacacctgcccccacccccacatcaccatacacccacgctcacccacacctgcccccagccccacttctcctttgcagctcccctccgcccacaccttcctgcctgggagctgctggcccatgtacaggggatggagagggtgggccagcgcccaccagtcagggctggctgactggggttctttgtgaaccttcagggtctcccaagctggaaacctgggggtcggccttgctcccctcactccatggccagccgctgcatcatcccctgccctgggccacctgccctggacgtgggccacagtgccagagagagggacccttgcaggtacagctcagaatctccctcctacccagacacccccaggttctgtactgccccgggactggtgccctgcccatccgcagcccggatgctccctcctccctcccagcatcccctgtggcagtggccatgcctgcccccagagcagctcaggctcccctttcatctctccaagccttagcccctgcagccctccgcctggagtgtttgcctccccctcgctgctgctcagggtctccctctgcccccaggctccctccccagcccctgagtttctcctctcactgtgcttccccagccctgagtgcttaggggtctgggtggcatgtgtggcatttaaccccatgctctctgctgagccctgagctcccagagttccctccagccctggccctggggagggggtagcatgtgaccaggagggcggaggggcttgtgtgtgtttctgagacgcagtctgagagagacacgggtgacagacagttggggaccccaaacactggggagcagagatagacaggaggggcccgcagtgagacacagaggtgagcaggagaggacacatagccctggagaaaaggagcaggtgtgggcgggcttccctccactgcagtcacagttccctcactcataggcagatcttcctgggtcctccctgcacaaagccccagtggctccctcgtgtcccccagccacagtccaagctccctaatgtgctagataaggccccagtccagcctttcggtcccagcactccctggacttcctgtttgggcctccaagcctttgctcccctttggccttcacccccatctgctccctagacctcagtccatctggcaaacacttcaccatcgccctctccatgaagccttccggcccaccttccaggatgacgtgagctggtgcccttgctgcgaggctgtcttcccccatcagcacaagtgtgagattccctcagggcagacccacatgctacttgggcctggtacaagtgtctgatgtcaggctgggcactgtggcttcacacctataatcccagcactttgggaggccgaggagggcggatcacctgaggtcaggagttcgagaccagcctggccaaatggtgaaaccccacctctactaaaaatacaaaaattagccgggcatggtggtgcatgcctgtaatcccagttactcgggaggctgaggcaggagaatcgcttgaatctgggaggcagaggttgcagtgagccgagattgcaccactgcacagagccagactctttttcaaaaaaaaaaaaaaaaaaagcaggtgtctgatatccccaaccagctctgtccaggaagggcaggaagagaggaggagacaggtgggttgggggagatggcaggggagcactcggggtcatggagaggctttggctagacggagcagaggaaccactcagggtctgtgtcctggctgcggggtccatccccctccctacccaagaggaggctctggtctgcccccagacacctcccagcacccagcagagggcccacccaggcggtgctggttgaggggctgaattggggaaccacaggtagaaagagaggccaggccgggtgcggtggctcacgcctgtaatcctagcactttgggaggccgaggcaggtggatcacgaggtcaggagttcaaaaccagtctgaccaagatggtgaaaccccgtctctactaaaaatacaaaaattagccgggcgtggcagtgggcgcctacaatctcagctactcgggaggctgaggcagagaattgtttgaacccgggaggcagagcttgcagtgagccgagatagcgccattgcactccagcctgggcgacagagcgagactccgtctcaaaaaaaaaaaaagaaaagaaaggggggccccaggcgagctcggtcccacccagcaggcgggggcggggcagggcagagtgctccccccgccccccgcttcctccccgagggccccggagcccagctcagcctcagtccccgcagcttgtgcggcggcgtcggcaccatgaggcgagggccccggagcctgcggggcagggacgcgccagcccccacgccctgcgtcccggccgagtgcttcgacctgctggtccgccactgcgtggcctgcgggctcctgcgcacgccgcggccgaaaccgggtaagggggacccacggggcgcgcggcgccggcagctgcggggagaacggggccccgatcgccagggcgcaggcagagccccgacccccgggggcgccgagggctgaaaggaccctgtgggcagggcctggaggggcccgcgatcaccgcgtggccctcaccgccgcctctctccctccccttgtccaccgccccccggctgtccctcccctccccggccagcctcgcccccctccgcccctccccgtccccgctcctccctcccctcggccccctggcctccctccctgtcccctcccgaagcagccggggccagcagccctgcgcccaggacggcgctgcagccgcaggagtcggtgggcgcgggggccggcgaggcggcgctgcccctgcccgggctgctctttggcgcccccgcgctgctgggcctggcactggtcctggcgctggtcctggtgggtctggtgagctggaggcggcgacagcggcggcttcgcggcgcgtcctccgcagaggcccccgacggagacaaggacggtgagttccgtgtgtaggggaaccagtctgagcggggcgcaggggctggggtgtcgggacggtctagggggagatgcatggcccctgagggggagagaagggctttaaggggaaacggagacagagtggaaaagagtttgcgctgaggagctcaggctggggagggagacatagtcctgcccctgagaccctggtcggagccaggaacagctctgccctgacagaccccagtgtgaggaagagacaggttgcaggaagggggccccgtctgagggaggagtctgtcctgccctttgggagtctaacggagcttggttcccccataaatccctgaagagtttgccagactgagccccagctccccaactccctgccctgccagctccccactggccaggcctctggactcagggtcagccaggtgccacccctccccaccctgcattgggcttcatttgacggaggactgcccctccagaggagtcttctaggggagggagggaaggctgtgactgagtacggagcctctaccccctctgcctgcagccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatagcagggagccggcaggaggtggcccctgccctccctctggacccccagccaggggcttggaaatcaaattcagctcttcactccagcatgcacatgccctctttctgggaccaggctaaccctgcagaagcacagacactacagaccacagcattcagcccccatggagtttggtgtgcttgcctttggcttcagacctcaccatctttgacagcccttgaaggtggtagcccagctcctgttcctgtgccttcaaaaggctggggcactatgagtaaaagaccgcttttaaaatggggaaggcaccattaagccaaaatgaatctgaaaaaagaccaagtgggaggatgcctaatttgtagttgggtggttttttgtgtttgtttgattttttttttttttttttttttttttttttgagacgagtcttgctctgtcgccaggctggagtacagtggcgcgatctcgcctcactgtaacctccgactccttggttcaagtgattctcctgcctcagcctcccgaatagctgggattacaggcacgcaccaccacagccagctaatttttgtatttttagtagagacgggatttcaccatgttggccaggatggtctcgatctcctgacctcgtgatccgccctgctcggcctcccaaagtgctgggattacaggcatgagccaccatgcccggccttgttttgtgttttggttttttttgagacagggtcttgctgtatcacgcaggctggagtgcaacgatgggtccccagctaattgcagcctgggctcaagcaatctttctgcttcagcctcctgagtaggtgggactacaggtgctccaccttgcccagctaattttttttttttttttttttttgagacagagtctcgctctgtcgcctaggctggagtgcagtgacgcaatttcggctcacttcaagctccgcctcctgggttcacaccattctcctgcctgagcctcctgagtagctgggactataggcgcccgccatcacgcccggctaattttttttgtatttttagtagagacggggtgtcaccgtattagccaggatggtctcgatctcctgacctcgtgatccgcccgcctcagcctcccaaagtgctaggattacaggcgtgagccaccgtggctggccttttttttttttttaaagacagggtctcggtatgttgcccaggccagtctcaaactcctggcctcaggcagtcctccccgaagggctgggattataggcaggaggcgccgggcctggcctctatttctttaatacctgccctcagagccgtcctgcttttaaactgatgcaaatggcagcagtgaataatcaattcatgggttcgcttgctttgggatttagtacaagattattttaagaaataacaaaggagaaaagattgagctggattttgctgattctcaggtatctgtaccccagggtcaaccctgagattggcccaatctgccagaacctaagatgccattttgaccccagtggcagcttccagagccacaagcctgcatttgggaggaggtgcgcagcctccagggctggactccaaactcgagctgaaggaacatgctggcaggtagctctctcagggtccacctggggttccagctgctccaagacacagcacatttagccataaacatggaagggctgggacctacaggaggctcctttgtgtagaggccagggcaggcgtgtgaccttgaaccaggtggacatgaggtcccttgaactcccttctctctctggcttgttcccctgaagcactggccccccagtgctgggcttatttggccatcctgtgccagccccctggtcacccaccgtcacagtggaagctgctccctcctcttacaatggtgttccttgctctggggtctggggacaagaccatctctttccactcctggacgacactgtgcactcagtcagccgcctcctacctgccctcctgcacagggtcagaacctcctgacctggacttcgccctgggcagcttccttggaacttgttgcagcttagcatctttggaagggagcactggactaggagtcagaaggtggagttctgggtgctgttttcccactcttgggccctgggcatgttctgttctgtgcatcagatgttttctgcctgcctccccctgagctgccaccagagccacctgtagacccctgcttctcctgcccctcctgtcccttgccaggcctctggactcagtgcttcctgtcccaaggacctgttgtgtgcccagcttggaagacagtggccactcacatccaggtctctgcctggctatttgctccatgaacccatctcagatgcccctgcccccagggagccaggtgacagggtgaggtcaagtgacaagcagtaggtgtgggagaggtttggtggggtcaggcccacatgggcccagccatccactccccttccatctggagttgggggagtctgagctgctcctggccaccccatctgccccaccccatcttttcctggccaccccagctcccaccccatcttctcctggccaccccatctcccaccccatcttctcttgacaccccatctcccaccccatcttctcctggccaccccatctcccaccccatcttctcctggccaccccatcttctcctggccaccccatctcccccaccccatcttctcctggacacccccatctcccaccccatcttttgctacagccagggttagctcagcaggtgaaaaccccgagggtgggtgaaacccctctggggctcagacatgcaaaccttgggcatctctctgtcccagctggccccgccagccggtaggaagtttcccctgagttctcagttttttcttctgaaaaatgaggggttgtatgcaaggttctcctcctggcctgtggtccccagagaagggcaggaaggaaccttagataattctcatatgcatttaacagacgaggaaactgagacccagagccgtcacatcaatacctcatttgatcttcataagagcacctggaggaggggggtggggtgtttgtgtttgtttaaatttttttttgtgaaaaaaatgaagataggcattttgtagacaatctggaagttctggaccggaatccatgatgtagtcagggaagaaatgacccgtgtccagtaaccccaggcctcgagtgtgtggtgtatttttctacataattgtaatcattctatacatacaaattcatgtcttgaccatcatattaatatttggtaagtttctctctctttagagactccacaataaagttttcaacatggtaaggttttccacctgggcatttggatactttggtttttgctgttgtggccaagacggcacaggccacatgcgcctgtgcaggagtctctgtttcccagcacagttgttgcgccaaaggccttgactttttttttttttttttgagatggagtttcactcttgttgcccaggctggagtgcaatggtgcaatctcggctcaccgtaggctcctcctcccaggttcaagcgattctcctgcctcagcctcccgagtagctgggattacaggcatgcactaccacactcagctaattttgtacttttagtagagatgaggtttctccatgttggccaggctggtctcaaactcccgacctcaggtgatctgcccgccttggcctcccaaagtgctgggattacaggcatgagccaccgcgcccagccagccttgacctttttgttttgtttttttttttgagacggagtctcgctctgtcgcccaggttggggtgcagtggtgcaatctcggctcactgcaaactctgcctcccgggttcacgccattctcctgcctcagcctcctgagtagctgggactacaggcgcccgccaccacgcctggctaatttttttgtatttttagtagagacagggtttcaccatattagccaggatggtctcgatctcctgacctcatgatccgtccacctcggcctcccaaagtgctgggattacaggcgtgagccatcgtgcccggcccagccttgacctttttaaaggtccctgttggtccaaattttctcctgaaaatctagaccatttcacatccatgaggagggattatatggtccagtttgcagataggaaaagagaggccctgtgaggtaatgggatccggcccaagatacaacaggtgggtggtggagctgggcgaaccctgggctcctgcgcttggcggccatgcctgcccagcagaatgtcattggcccggaccccctccttgggagcggagaactcggggactgatgccaggccccactccctggtttcatcactactcagattttctccccaactgttctctcattttgataagagggatcccagacagactctggaagcgccgttttgcgggtgggaactgaagggaaaaggcctctctctgagcctgtgtttcgggccagcttttcctgaaggagggtctgattcccaccaggtccccagggccctggccggtgggggcaggcctggctgaagtctcgcttcctcctggggcttcctgcaggcccctttcacttcctgcctggtagccagaggctgggggctccaggaggggttgtggaggcccagctggtgaggccagggaggaaggcctgaccccccactttcgtttcagcagggatggctcaacacagcactatccctgcaagctggtagcatctcactgggcctcaactctctgggcccctcttcccatctgcaaaatggggctcttgaggcccacctagctgtccttggagattgaagaggtcctgtggcatgtagggacagagggacccctgctagagccagggaacgcccccagcagggaggtgtgagcaggcctggtcctgccctcatgacccgagggtggggagagaatgggggtgcggtagaaacgactgccccaaatagcggaatagcggggcagagtcggggagcaaccgggaggagagagatgccagagttccccgcccctacgctttcctcccgggactccgaagggcgctcagtggttggcgtgggggacggggggagggacgctactggggtcccgggacccagaggaaccttgggcatctctccactcccctaggctgcggataatctgggatccaggcccgaatccagcgacttcggggcaagcgagtctctgcgcggcttccgccgtcagccccggccaccaccggccccgggagatttggacgtggggcgggggtagggggtgctgccaaggggcggggtcaagaagagaggcggggctgagggacccccaagcctcaaggtggccggaaaggggcggggccagcggcatgcctaaggggtggagtcaaggccaaggggcgaggaaaaagcttgggaccggataaggggcgggaccaaggccaagggcgcctgcttcgggctcccgacctctgcgccctcgggagtccgggtcctcacgcgcatcccgagccctgggggcctggatgcggcccacggccccgactcaagggcgaggctcaggggggagggcgcaagacgcctccgcacagaactgtgaccgaggagcaggggggctgccggggagggcgcacctgtccccgtgcacgcgctgtggcctccgtggagctctgtcctctcttggttcccgcgctaaggtctcggtgtccgctccggattcgcacgtacactgagggctttggagcctcccagtcccgccgctccctggcgacctcaggagcccgggcgccccctccctcccacgggcagctggagcctgagtcagagttgcctcgcgggagacaaagacagccgtgggccctccctccagaacccctcctggtatcggcatttgcaccagcagggagcccagagtccccaagagcctctgcttcttgggtaactgcatcattgaggaaatggaagtgaaattagcttaggaatgaggccttggaggcttgtgggtggcatccgcggtcacggtcttctcagcctggcttcagtgtctctggggcccactgcttctccctgtaaccctgccgaaatgctggtagcccatcttgcagatgacaaaactgaggcctagaaaggttgaatggccctgaagagcaggaattccaacccggtcagcctggctccaaaataaaggataaaggctgggcgcagtggctcgcacctgtaatcccagcactttgggaagccaaagcgggccgataacttgaagtcaggagttcgagaccagccctgccaacatggtgaaacccccgtctctactaaaaatacaaaaattaggccgggccccgtggctcacgcctgtaatcccagaattttgggaggccgaggcgggcggatcacctgaggtcaggagttcgcgacccgcctgatcaatacggtgaaaccctgtctctactaaaaattacaaaaattagccaggcgtggtggcgtgcacctgtaatctcagcaactccggaggctgaggcaggagaatcgcttgaacctgggaggcggaggttggagtgagccaagatcgcgccactggactccagctgggcgacagtgtgagactccgtctcaaaacaaaacaaaacaaaaattagccaggcatggtggcgggtccttataaatcccagctactcgggaggctgaggcaggagaattggttgaatccaggaggcagaggttgcagtgagccgagatcacaccactgcactccagcctgggcaacacagagagactccgtttcataaataaataaataaaacctagaaactctgggcatgtggggctggaaaggggttccaggaagagagggcagcctgcgtgaccagacagggggcaaatgagcctgggtcaggtgttggcaagggccctgtcgtggggtaggagtgcctcccgggtgtgctgaactggccagaatgtggattcgggactcatagtgcaggttccaggccagaccctgcccttcctggctgtgtgccagtcacagcaagtcacttcctctctctgagtcttgagtttctctctaggaaatcccaaacctttcccagggctcagcagagctggcagactggtcacccaccacctaaaatggggacactgaggcccagcacaggctgtttgtcatgtccacacctctcagggcccccagccttccccagccagaactgagcaccaggtgagggctggacatggaggaaggccgttcgtgcacaggagcatgtatgctgacaaacacgtgtgcacacacatgcccaccgtgcagggaaggccctcatagtcatgctagccccagacatgcacactcttgctgtcacccaaacacgcgcagacacccgcacactcgagctgccagcattgggagctgggggcggggcgggtgcccttcaggagcagggactcggctcctctgcccgccccgcggggcttgctgcagatgccaggggttattttaagcctggatcaatggatgagttttggtgacacaggcttagtggtagtggaggggggcaggcagaagagataaggggtggctgccctggagccttgatggggtgagagaccccggggtccagggcaaaggggtcactcctcggccgggctgctctatctccagatcccctcacccggcacatggccaggcacctggggcagtgtcagctgaatgggcgatcagatcccaggactcagccagtcagggtcagctgggctctgtgttcacagctgccctctcctgctccactcactccccgcggccaggtgttcccatggagagaagagggtatccagtgcctggcacagacccagtagttatggttacctatggctgctggctgaccactgaatcagattgagacggggaggaaggtgtgtgtgtggtggggggtggggggtggtgttgggggttggacatcagtccctgggaggggctggaatccacttccttcattggacaaatggctgtcactatgtatatgtatgtgaaggcctgatggggtcaacatgaggaaagcacccagtgccaggacggtgggggcaggagggtgtccaggaagggggagcactgggagacttgctctgacccctcactctaacttggaagaggccccagttccaagggggcagagacaagcctctttcaacccagtgcccggcaacgggtgggaaaggtgggagaagaggcccccctcagagctcctgcagcctccagggcagtgggcagagggcggtggggacttcaataccagtgatacgggttgtgccacggattccatttctaggaatggccctaaggaaaggaagcaggaaaggacgctccagaaagtagagctcagaagctctgagaagaatcacaaatgagaaggtttttttttgtttttttttttttgtttgtttgtttgtttttttaagacggagtctcaatctgtttcccaggctggagggcaatggtgtgatctcagctcactgcaaactctgcctcccaggttcaagcgattctctggcctcagccttccgagtagctgggattacaggcatatgccaccatgcccagctaatttttgtatttttagtagaggtggggtttcaccatgttggtcagcctagtctccaactcctgaccttgtgatccacctgcctcagcctcccaaagtgttgggattacaggcgtgagccactgcccccagccaaacgaaaagtttaaggatggcaaaaagtaaaccacaaactagttacaatccagcatgtaaatgtggcatattttagtgtggttgtctctggacatgggattaaagcaatttcatttaattcctttgttcatctgtgttttttcttctaaactggtaataaggggtcctttaatgagggtgggttttcggggctggatgggaagtgtgtgtacatgtgtgtgcacatgtgtgtgtgtaggtggagggagcaggctgtctttggccagggcacaaggagaagctctgagtggggaggtcacctcctcttcctgtctgaacccattaatacctgaaattagtctgtcagcccctcatgtcaggcaacagacttgatcctccttaaaatgtaaatccttcctcttcttctcccccaccttctccactttcataagctggtcccagttgctgagagaaggacggatggaaaggggaccaggagggaccctagggagccccaaatgtttcatctcacagaaactaggcgctggagtcctttcattcatttattcattcagcaaatgccgacagaggcctgagctgcacactgggtgaattgcacgcccagtccttgccctcctgctgtttccgtctggacagagggaggttccatatcgacccctatctcctggaaggggcagattatgagtctgccctccaggaagagtctttgatgttaagatgagatactgaggcagggagaagccaagcaccaggaccttctccagttcaactcaaccccgaaaacaccactgggccgtgctgggaccgggtccgggctccttagggcccccacaccctacccctcggtttgtgaaaggacctgcgggtgggcgcagggcggaggtcttccttttccaggctttccttttccagggcaggggcgagcccagtccccctctcctcacacctggggagggagcagatcgcggaagtgcgtcagccaagccgtgcccatcgacgcagggatggggacatccctggaccccagcccagcgttcgaggggttctggaactgggctcgcgccgtggggtaaatccttggccctctgaagcggcgctgccaggggaagtccttcccatttgacaggtgggaaaatcgaggcgccgagaggggaaggggccctccttatgttatgatcagaacggacagaggggacgggaaggaggtgagagggtggccctgcccgtcccggggcaattccgggctgctttgacctccgcgcctgtaaggtacaggtccccgcacctgtaagacagggacgctctagtcgcgggccctagaactgatccccttcgagcgccca

SEQ ID NO: 983 - DNA, 690 bp, Homo sapiens
ccggagcccagctcagcctcagtccccgcagcttgtgcggcggcgtcggcaccatgaggcgagggccccggagcctgcggggcagggacgcgccagcccccacgccctgcgtcccggccgagtgcttcgacctgctggtccgccactgcgtggcctgcgggctcctgcgcacgccgcggccgaaaccggccggggccagcagccctgcgcccaggacggcgctgcagccgcaggagtcggtgggcgcgggggccggcgaggcggcgctgcccctgcccgggctgctctttggcgcccccgcgctgctgggcctggcactggtcctggcgctggtcctggtgggtctggtgagctggaggcggcgacagcggcggcttcgcggcgcgtcctccgcagaggcccccgacggagacaaggacgccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatagcagggagccggcaggaggtggcccctgccctccctctggacccccagccaggggcttggaaatcaaattcagctcttcactc

SEQ ID NO: 984 - protein, 184 aa, Homo sapiens
MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGASSAEAPDGDKDAPEPLDKVIILSPGISDATAPAWPPPGEDPGTTPPGHSVPVPATELGSTELVTTKTAGPEQQ

SEQ ID NO: 985 - DNA, 202251 bp, Mus musculus
  misc_feature (1)...(202251): n = A,T,C or G
cctgacctctgctgacaggagtgctcctcaacacggactgtgcagcagagtcctctggggacttgtaacccaatccatgtgcctctctcaccccagcaagcatgactcggttggctggccagcaccaggcatggggttattctccaagtgggtgtattgttgccagttgggagctagggtcatggagcatcaattctcagtattttatgtgtctgctgaccctcatctggtggttgatatagcaagtctcagtgggggtcatgtattccaagaggtaagtgaactcctctgcatggcagctcagcacctttcctcctgccatcccacctaccatctctgccgattacctttaaagaaacatgaggagatacaaatggttactggttggatggtattgacagagagtcctgaaaatccagttctagccatttacttaaagaaaactagagaaaagagaaggggatcccttatgcagcacaggcccactgggaaggtttggggggggggtacaatcaagagtgtcctgtttaagccttgaaggaacaaaatgaagggcaggaaatatgtgacatcgaagcagaagatgacttggggtaaagtccaagtgtgaagatctgagtctgtgtccacagagccctactggagctgggcgtatacgtctggaatcccagaactcctacagcatgctggaaggagacaggagtgtccccagaagctcatccatccagctaacttggcagattcagtagtgagcaagaaagaccatctcaagcaaggtagaggtgaagaccaatacccgtgcttgtcctctgctcaaccccctcacactcgaacataaaaggaagtgtccgtacatagttaaacagtgttggtcaaactgcactctctgatggttatcgctagacaggtctatggggctctgccagctcttgagacatcaccatcactagaggtggcattcaggtggctcccaccacaacgtgactgctcatggtcagagaggctgctcagctaccgtccgggcaattcctcccattcggtaggtctgaggagggtagcctcattgtgaggtgatggggctgcaagccttcctgttctgggaaccttagctattcttattttgacatcttcagcctttgaaaaagaaccagcgaggttaggggccagcagcctggtatcatcagtttttagacagacagtccgtaaatgattaacccgtgtacaagcagagcagagacagataccaaatgagagcagagatgccaggcctcagcctacatttagttaccctctggccatctgcaagcccaaggaaggagtcagtggttggcggcctgtctggtgcacagcaggtgctccgagggcggagggccaatctggctgctctgttcactggggctgttttcccttttgtgtgctcagtttttatagccagccgtttgttgtgttctgccagtctcctactcacggtgtagctcagctccttagtacgcgcaagaggctaacctcggggatccctcctgacactggagatgctcaagcatccgtctccctggagacgcccttagctatcttgactgtggggcttttggaatgactcctccttgcttaacaaagacatttccagccatcccagtgactcaggagaccatcaactacccgcggcagaagctcactgttctcagctctgggtctgtccacatagtctaagagtgtgtcgggactacggattctcagattcatagaccagacttgctgaacagaagccctgagatcgatcaagcacctatctgctttgttgggcccacagtgctcaaggcccagacctagtgctctgtgtgtgtgtgcgcatatgcatgcacatttgtgtgtctgtgtctctctgtatgtgtatgtgtgcgtgcatgtgtacatgtgtatatatgtctgagtgtgtgtatgtaggcacacgtgtgtgtgatttctccagtcacatttgagtgtctgtcacatttcctccatttcctccatctgctgagatacacatttaattctaactagagggggcttgtcttgagtgtgcataccagtctgggaaatgacctcagatctccaccctttgttggtgtctcgctcccgtgtggaaggagtttaggaacacacaggttgtccattgtgtccccccagtattctggactgagaaacagannnnnnnnnnnnnnnnnnnncttatctctctgagctcctgcagttgtcttcattgtgttgagcaaaaatgaagggagttggctcctgcctgctggcttaagcatcatcgattgcatgagcacaacacttagtttacccagtgaagctaaagctgagggatcatgagggaaatgtgggagtcggtctatctatctatctatttatctatctatctatctatctatctatcatctatatatatatcaatatctatttatcatctctctatctatcatctttagctctatctatctctatcatctatctatatctatctaccacctccatttatctatcatctatctatatctatcatctatctgccatctacctattatttacctggtatatatctattttcttttatctatctgtccatcatctatctatatctatcatttatctatcatctaatctatctatctatctatctatctatctatctatctatctgtcatctatctgtcatctattatctatcatctatctatatctatcatctatctatatatctatctagcatctattatctagcatctatctatatctagcatctatctatatctatctatctatcatctatctaatctatctatctatctatctatctatctatctatctatctatctatctctatcatctctctacctctatatcatctattatttctctacctatatctatctatcacctctatctatcatctatctatctgtcatctatctattatttacctattatctatcatctacccatcatccgcccatctctctctctctctctctctctctctctctctctctctctctctctctctttaagatagtgtctctatggcgctccagctgtcctggaactcattgtgtagaccaggccagcctctaatgcttagaaatcgactcacttctgcctcccaagttctggggttaaaggcatgcactcctatgcctggctttgaaatggagagtcttgtttcattacctcatcggaacgctgaagtgacccagcgataagtccatgtgcagtcaataatcaacacacagcaggagccgaccctaagaagggtcagaccagagnnnnnnnnnnnnnnnnnnnnatacataaagctgctataaatagctgcacacagtatttggggtgacgtagcctttctcatattatttgaataaatatgcagaagtcagatggcttagtctaccttatgaaaaactttccagagtgaaaagaggcatttttattccccagggcagcaaagaagaggctgagaatcatcccctaagaccttctggtcagtgacatgtcaagtttcactagctctcatgcagaaattacccagagtcctcctcagccacagaccaggggaaaggattttgagtttttaaaggcaccaagtgccttggtgcaagaggaacagggtcaccctgccctcctgcgagaccatacagggacaacatggaggaggggagaggcactaccttgttttctcaagcaggagatttgaaagaacaaaagaggagctcacgaggctctcacccctcagtcacaatgttacaggcacagatcggatctgcgcttccctaaccaggggctgtcacccctcagtcacaatgttacaggcacagattggatctgcgcttccctaaccaggggctagcagtgtggagcagaaatgataacttcagtgcttggagcctcaggactgagagggctggagaagggcagactgtgctgacagcatccctggcatctgctaggctgccaggctgccacggtgcttgtgtgggtagccctgagctgggttttctgtgggaagcagggttggaaggtcctctgctcagtgagacagcaattaccagaacttttctctactccttgcttctcttcctccaagcccttgtcttaccttaattctgctgcttctattgttcttcctttaatcttcggacttctaagattgctcttccttggtaggtctgacaatagatcccaccctgtccaccttctggggaccctgccctgcctccacaacaattttgaagaggccatactatttttattttatttttttaattgggggtgggatgggagtggggaagaccctcactgtttctcaggccagccctgagctcacactgactcccctgtctcaggtcatgtgccagtttttcattacacccaacgatgactttttaattttaaaattagttagacttcaaaaattgccttagcaaagaagtatcccaaggaaaaccaaagagttaattcattgtggtatggggagtcggggcaggcacttaattttaaaaggctctgtgaatccacagagaggcagaaaggggctaacctggatgagagagggattaagccttgtctgcattctgcctgttgcagtgggaaccttggaatagctggtgttgacagcgtgggatgggaaacttgcaacagggtggtaaccttgtaaccttttgggttgtgatacctgctgctttgaaaggcttgggagttatttgcggagagaccagatgtctaggcctctcttcccacaactgccaactcgggtacagcattcctcaagtgagccttatcattttaagaatggaagcagagggccggcgctgaccctgtgtgtatagcatccccagtgctcaggtatgccaccttagatgagcttctgtgactcaccgtggcacactgggggggttggatccctttcccttggcaggtgtccaacttgatcaatttcccaggctaggagcctggggatgttttattctttgcctccctcctggggataatgacttttcctggataccaggaattccacagcctgtaactgaacaggtagagggaggagtgcagagggaaggcaagccaatgccctgcctaaatgtactaccttctgtgacttagcactattcagtgcgcttgggcctagtcaccttaattagccaggtggagctggggcccatctgcctcatttcccttctatctgacaatcacttgctgtgcctcagtttacaccagtgctataacctctgctccatcagcagccagtgtctttgtgcactggagagcatacaccactacagttttggcccgtgactggatggcacatgaactccactgtgaacacagcggagctcatttagaaaggaagatgaaaagggcttctattaaactcgagatgctaatctcgaaatgccaccagcattcttccggttcaattacacacttaatgaaacacgcagaccctcccgagccttccttgcagaccttctgatggatgctatgactctgggaagataacgcactgaatgattcctcctgagaaatcagtcgctgcttcctctttcctgttttgaacatgaagggttttttaaaagtgtattgtgtgagtacaatatgcagggtatatctttggtgccacataaatatttacttaatatttaaaactccctgtcatgagaacagtggcacccactttcctcatggtaaaataagagctgccactcttttcaaatccttcaggatttcattttgtgtggttgcttttttgccttcctgttggtactgccagtcaagtcagtctgcccagaccagggaactatggaaaggcaagcttaaatggactcccagaggttgagcattccccaggcccaggttgactaacactggaccatgtaacttagtgctgttttatttagctcaaagtttaagagggaaacatgctatcaccgtgggaagacggtgctcggctgcatgggctggctacattgtatccacactggctacatagtatccacattggttacagtgtatccacactggctacattgtatccacactggttacattgtatccacactggttacgttgtatccacagtcaagagtcagcattgaatgtctgtggtcagattacctgttcttttttattgatcttggatcctagcctctggggtggtgtcatctatgctcactgtgagtcgtgctacctcagactcactggacatctagagatagatgtgtccctaggtgactccagggccagtcggattaataagactaagaatcagagccctgttccttccagaccagtgttggagctggccatggcttctctctcccttgacagattaaaaatcaaaacaatgcaacacaaaacacaaaaacaaaaccaaacaagccaacaaaaaacagaaactgaaagagattaatgacttgggcagaaatttcaagtttgcaacaaaggcaaaagatattggcctatctcctgacatctacttcaattatattgcaaaaaagggggagtcagcagaggcagctgagaaagaaacccctacaacctgcttggagaactgcccctgtatgcttcggggctggtcctgcagcgagcagtgacagcagtgcccagcactggccagtggtcctgttggttctgttccaggcaagagtaaacccttgaatttgatagtccctcccacacaactgcctgaaaacacccaggaatctacggcctgacacgagcaagaatttcgtgcttggtttttgtaaagtgaaaactatctctaaaggattattaatatcgagctccttttgtgtggaaagagagaggacagtgaagatgttgaagatgtgaatccttcagtgtcccgcctgtcagcaaaagtatagtgtttagtggcaggcctccctcttcgtgagtttcaagtattcataaagtctataaggaaatggatcccttcccccaggggaggggggctgactaagtttagatgcacagaccagtaggcacacagtacataattctctttgttctttgtatcagcccatttgcagcctctcagagacgcttctccacgttgaggctgcttactattcacttcaccggtgcaaaaggtaccaggactgtgaagtttatgaactaatcggggaaatttgtaaaaggtgccagggatttgaagtttatgaactagttaaaggagttagaaggcatatctagaatgtttggggttactgaagatgtagtcaccactcagcttgtgcctctgtgggttctctcagaccagtcaggttctctgtctctacgaaagtttcaccaagtactcatactaagtggtagccgctctctaacttttggaaaccctgtctgctgtctggcagagaaagtcataaacgagacgtctgagaactgattgggacctccaggcgaaggggcgatcatgcccgctgagtgtggcacagtgcatcccgagacagcggggaacagccttcagccagctggaggtgttaagggacaccttgtgtgacttgtcagtttcctaggctaggggcctgggaatgtttttattctgtgtgtctatcctgagcttaaagacttttcctgggtaccagaaattccactgcgactctggaatgtaactcaacagatagagggagaaagctgacttcctgcttgagtttgccctcttgtggtcaggtgtagtagtgcacacctgtggtcttcgcattgtggaagcagaggttagattgtgcatgcaagccggtctggactacagaagcagacttctaggatggccatagcaagactctacctatggatcggtgagtggacggagcaaaggatggataaattaataatgtgagatgtcttctctctcctactctccagggctcctctgttcatgccagggagccaccaaaccactagggtaccagtgccttatttgatgatttaggcatagggggaaaaaaaactttgtaaaggaaactggagaacagtttataaaagatactatccagttattctagcatggtatagttcttcgctgttaccttgagcctattggttgatacaaggccaggttatagtggggatgctctatacatttcccatgttcctccggtgtttgtgcatagttttgaattgccttagatgtaatacatctttagaccactgtattaatcttaaataggttcttcctcgtttgttgactaatctagccatgcagtgaggaacgtctgcactccatggttttatagcttttgtttgtattcagtgattgacttagagctaattcctaaggaactgacaagccagatctctttgtgaatctgttcgcccttgttatgtattataatattgcttcctgaaaatgtgtgtcatgtgccgctttctctagcaataaatgaataaatcagtttccccatagcatgccggtaacacatactatcatgtggaaacaaagctgtagccttattaggtatgaaatggtctatccgtggtgcatcaataatgctctgctttacattttaaaaatccctattgagcatatctttcatatttcttctgcaaatatttttacattacatttttgagaatcatttaccccctcctctccattccatcttttctcgtgtctccttcctgctccctcttaaatttctgacctcttcttctttaattattaataacacacacacgagagagagagagagagagagagagagagagagagaggaagggagagagggagagggagggagagagggagagggagggaannnnnnnnnnnnnnnnnnnnaaaagagatagcaggtgtccatgcatcgtacatgtgtcatacatcctttccccctggctaactatgcaccctgctcccttacccaatcttcacacttggctcttggcttaagctttctcctcagtgaccacacactctttttccccagaaggtgccccctctctgcagtgatctctttctagtctcctgatttctccaggtactcctagttggccactcagaatgagacagcttttgctttgtagcctaggctgacccccgagtttccagccaccctcttgtcttggcctcctgggtggtaggattgcatgtctgatcctccatggcctgtgacttccccatacatttgacataaaatgtaacttaaaaagcaaggcagatgtgctctgtggctgaagaggtagaaatttccaagcaagttccattcagacagaccccgtgtgcaggagtgacccttggcggtcttcctgatcatcacagatgcctcctgtttgccttcatagctttacacaacctcccaccagtatccatcacccctcacagaggtatctgaaaataactagttgacttcaccccatgagggcagcagtgcagcccccatttattgagagagatgccagcagagactcatagtgggtcttactttattgtccaagatcacatcacctaaaagtgtgctaagattggaatgttagacattttgactccctagaccctcaagctgtgtgggtcaagcaaagtgatcatgagggagtggaacagctgggagcagtgtggtttgatgggccataggttgtaggtagacatgataagattcagatgaattctagggtagtggtggtgcaggcctataatcacagcacttgggaggcagaggcaggtgagaggtgtgaccctgagttcaaggccagcctggtctatagagtgagttccaggacagccagggctacacaggagaaatcctgtctcaacacacacatatacagacacccaaaacaaaacaaaaaatattgtacgtgaattctggctctgcccacccaggggcctcgcttcctttatctgatcactgagactcctcagaccatcaaacacacacacacacacacacacacacacacacactcaacccacctctgcccaaaggtcagtgttggggtgcactaacaccaccgttctcctctctgcttgtgtcttctgcagcccctaaagacaatgaagaacgagtgttcagggagcgtatgcggccaaggaagcggcaaggggctgtcaggcgcagggtccaccaggtcaatggccacaagttcatggccacctacttgcggcaacccacctactgctcccactgcagagatttcatctggtaagtccctggagaagggagggggttagtcgtggagcgggagataatgaacctcaatcaaaggtgctaatgtgaaggagagaggcgttcttctaggtatggtggtgcacacctttgaacctagtgctcaggagggtgggtctctgagttcaaggccagcctgatctacatagcaggtccaggtcagccagagctacccagtaagggggtgggggtgggggattgagatttttcccatgaaagcaaataatgaatgaagtaatgttcttccagacagacgcatcatattttaatttgaaacaaaggagtgatttctctaataaaagtccgagagcactatatatgactttaggagctggctatctagtaattttgtcatcatttttagaactctgattttaaggtttaaaaggcagacctcaagtcccactgtgaacctagacagcagacatgtgagtttcaggtacagtgaggcagggctatggatgagtaggttggactatgctgtttccaggctaactaaccttgccaggggaaggaaccctttttaatggttgattgagcccctggtcctgactacagactgcccataatccttgacaggctttgggatgcccagggtatatgccaaccaacggcaggccttatctcccatcacagagccctctgtaagcatgtcctggtgctaggattgggggaatcaccttctcacccatgaggagggggtgttttaattgaccggcttctgcctagagcaaggacgattgcttgtgactttctagaacactgctaccccaactggcgtgagtgtttgtacagaaaaccaaacgttgacgcaggcagcagccctgtacctgctccaaaagcgaggctgtccctagggccttctggaaggtgttcttaaccctgcaaattgtagtgaaattacactgctcagcagaccccggagtactcagcacagcatgggtgatggccagaagtgggtagctttgtgtgtttatctttcgacctagtaaaattccgtcttcttcctttcaggggtgtcataggaaaacagggatatcaatgtcaaggtaagaggtcttttatgaacttagctttcggaacccatggttggtttaaggttataatcccttctggaaggtgcacaatagatcggaaacctttagagcctttgtatacttctattgttcaccctctctaaggagtatggcctttctgctgtgttactgcctggccatcactcttatgccaccaaagcactgcctgtctcctggcatcccacgcagtaccccctgccatggcgtcttggccacagtggtagaaggcagcagtactttgattcccctcccctcccccatagatgtaacacttgaatagagggtcactggagtctcctgtcttgttgggagtctattgcgttgccaatcccccttcccaggctctccgaaaggtactctctcgccagcttgttggtagccctggatgcttcttgctgaatctctccatgattgtgttttggaatcatcattaaacacttgtggcttacttgaggtgttggggattgcatttctctagctcactggctatcatggtgaaggccaagttgcacagggaggtagaatgagatgcagtgatgtccagacttctctctggtgagaactgggaggacaggttggcccttcagggttgaccttaagtcttactttaagcaggacttggaagtggctctgctaatggctgctatggtttgtgaaagtatacatgcatacagttacctcctttaaccactgaggaggagccacactgcccggtgaccctgcagccagagctataggccacattatgtggacttactaagttcagtggaacttttaaagtttggcacatggtgatcataaagcagattatttttcaaagcccaagaactcctgtattgtatgctccatcgcaggcaccccaaggagtccttgtgtcatggccctgagtgagaaggacagtacagaaccttcaatagtgagggcctggtggaggactgggcagagggtggtccctgaccttagccatggcagcaggacagctgggtaaccttctcaaagcttccagcgcccttggggcatcgctttcacccttccacactcagtaagccccatagtcccagtggcagtgcatttttgagaccttgcattcaaggcttgaggagggcatccatttaggttcggacattgacagaaagggcacagctctggtcgtgtctccaccgagacctgattagatctcggggtgggatctggccggccctggtcatcattcaagcttcttctgtttttgtcgttgacagtttgcacttgcgttgtccacaagcgatgtcatgagctcattattacaaagtgcgctgggctgaagaaacaggaaacccctgacgaggtaaatatttacagtgatggaattctgtgccctcttccttatcagcctctcccttgtctgcccctgatgtgacccccacgggagccttatctctctgagctcctgcagttgtcttcattgtgttgagcaaaaatgaagggagttggctcctgcctgctggcttaagcatcatcgattgcatgagcacaacacttagtttacccagtgaagctaaagctgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctattatttacctattatctatcatctacccatcatccgcccatctctctctctctctctctctctctctctctctctctctctctctctctctttaagatagtgtctctatggcgctccagctgtcctggaactcattgtgtagaccaggccagcctctaatgcttagaaatcgactcacttctgcctcccaagttctggggttaaaggcatgcactcctatgcctggctttgaaatggagagtcttgtttcattacctcatcggaacgctgaagtgacccagcgataagtccatgtgcagtcaataatcaacacacagcaggagccgacccttaatgaagtggtcagtaccagagtgggagggacaatccaagggtgcttaggagatagagattagaatagtgtcattgggcacttactttaacacatatcattcactgccatagcaggtacaactctcatcatcctagcgcagagagcctaggaagcaatgaggtggtcacagaacttgcccaagacacagctaccgtgagaaagagctggctgcattcagactcgggtggtctggtctgtcttagagcttgaaccttgactccctgtctcttagcttaggaaccggggtcagactggctttaaggaaatttctagagctccgggaatgtggaattacacaggggagccaggtgtcccctgaggctcaggatcagtgcttcccaactctcctaaggctgtgactgtttcattcggttcctcatgttgcagtgaccctgggccataaaattatttttgttgctaagtcataactgtagcattgccactgttgctaactgtaatgtagatatctgtgtttttcaggggtctcgtgggacccatataaaaggatctttagaatcttccctccccggccccctgggggtctcagcccacaggttgaaaagcgctcatccagatagcgggcccattagtaggctagaagaccttcctggggaagatggccggtgtattgatgagtacagaggtcatctgtgccagaatgggaatttcaaaggtgtccttctgataattcccggtgcaataggcatcctatagtcataagtcactagaattaggtcagaggaaccccgggaagactagacgcttggctttagagtgaagtgagcgtataatctgagtccccaaaatcatttattcctacctacttcctaaaacaagtcagccaaatgggaatttcacatccaggacctttcccgtccttgagtctcctcttgcttccgtgttgccgctgaaagcagcaaggagcaaggctgcagcagggccttctgtgctcccaagggtaaactgaggcctggtcccacagctgtgtgcagggggtggggggctgttttgttggcctggttaaatatgaagtctagagacgacaatagagcttagttggtagagcatctagcatgcagaaggccctaggttcaacccttagcacataacccaagcacggcggtgcacacctgaaatcccaacactaggaagatagagacagaaggacagaggttcagggtcatttttggctgcatggcaagttcaaagccagcctgggatacacgagacccatctcaaggaaggaagaataccttacgacccagcagctgtttctcctgacccttgacctcggagcataacctgcagtagatggttactgtcattgctttcacatgaagatggagagggagataacgagctttactgcccgacttccttcccgtgggcattccgttgactatttactgggcacttcctgcgtggcaggcattggaccctgtccagtggaggcaaagaacacatgaaccctgactccacagtccttacaggtctcatggcctgggaaccttaggtttctgaggctttccctcactgtgtggaagggacacggcccacgagactctgggctttgcacagttcagagctcagattggaagcacacagctaccacttacatctggcaccggatgcttccttctatctttcctgacagattgaacagtgatgtctccagagaggcaatgctcctaaaagtggtccatatccccagagacaaatagtcaaggtctcaagaatggagtttcttagaatggtggggttggtacccatcccgatgttgccaccatggacagtccctgtgcttctggagtccagcatgctttggttatcactgagtgcctttcgtcaggtgacgagtctttaactcattccttcgagtcactggctttagtagtataatcagtgtagatacacacacacacacacacacacacacacacacacacaccacaaacacttgcagttccaagtgcttcatttccaacatcctctactcaaaaatgctctgctttaatagagagtttgaagacagatcgggctccacagaaagactccagctcaaataaaaaacaaaatgctctggtgatgtcaggtgccctggatgctttctttcccaccacgagcgcttgcccagttgcttgtcttgtgtcagtctgcgtactccttgctggtgcagtaaacaggaatgccgtgtcttcctgttgccctggcttttgtctgatgcgcacacatactcccatgggcatatctacttgtgagtgtgctgtcttggtgtttgcttctccatatgactctggcgtgttcttggatatgtttctcaccatctcattatcttctcactgttctgacacctgggaatctttgttggtcccagctgagatccgtacagctgtctccaaccccgttggcctcctgatcacctgggtcaactttccctacctcttcaccttggtctgccactcatacctttattaaattattcctggtcagtaagtttctcttctcatatatgtcgaccgtatatgagaactgcaggaatagagtagacggtgacctcatcagatctgaggagtcagaaaggaacatgtgtgacggacacacacaacactcgtgtgccataaatctaaggtgggtggacacaattcttctcaatagccctggggaaacttgtactctgacaggaccctaatggatggcccatagatgagagaggaataagtagcattatggctacatgggaggaccaaccatttctaggagctggataatgggggacaccataggcatggcttcatatctacacctagatcagtgtctatgtccagctctcgttgtctctgagtccgccaaggggacctttccatgccacagtcagctgatgatctaaggcaccctacgcactacccccctccctggttcctggggtcagaagcacatctttcttcccagactttcctgccctgtctcagaagggctggttcacgtggctgcctcaccaggtgggcagggagttgctctcgggaggttctgaggagactcgagaaggtgaactgtgctgactggtgactctcagctctgtagaaatcttcaagtccccttcacttctccattagtttgctgacctcactctcctatgacatcaggtggaggcgaaaaactgtccttatattccaaatgagcggtcttgaggtcccaaggaacctggaaacccaaggctgggccactgcctggacacttgagtttctgttcagtgtcctctctgtctattctgtcccacacctttctccttttcaccaatgagcaagtagcagcagagttcattagaaccccgagctctgaaatcgtacacatgggcacgcgggcctgtctttgcatctcttgcatgtttctgaatcccacagtgctttcatttccttgtcggcgaagttgaggaaccagtagccccacccgctatggtggtgggagagtttaaggcagtagtgtctaactcagtgtcctgtggccatcgatctattagccatcttcctcctccatactgtgcagaatatatgtgctactttgtggggtcttgggtttcatcttaagctgctggaagcttctcttttccaggctagacctctgtgcaacaaagccatgttgacggcacccagtgatgccttgtgaccgacttcagtgtgaggtgctcattgctaatcgcctgttgtgatcatgtagaggcctgaagtctgggagcagacctgggaagcagcctcatcttgcctgtgaattaggaagggaaagctgggccagaggagtggttcccttcaggggcctgcagtgatttgtgccttcagagaacccagggagcagtgagctccccagaggagctgagtgctgacggtgtgtcttcctgttcctgcaggtgggctcccaacggttcagcgtcaacatgccccacaagttcgggatccacaactacaaggtccccacgttctgtgaccactgtgggtccctgctctggggcctcttgcggcagggcttgcagtgtaaaggtgagtctcttcccgacccctcagcccaggatccattccctgctcccttcattttcccttttgcaaaaaaagcattctgtcctcgtagcgtttctttctagagtgggttccagatttggctggggaattggccgcatacccttgataagccattgtctcctgactgttttcccgttaagacctctcttggaagaaagtggccaggagtgtggaggacacgtgacaaggaagacttggctatgcctcataacgtggctgcaacccgggagaaacaaaatggaagatgtaaagaaaagaggcactggtccgagagggagggcatagtttttgaagattaacgaaggagtaggtataagctcgtggtcttctctctccagcctttgctcggagttgactcttggagaatgtcacactagggcattgtcacccgtgatcttactgatcctccaggggctgtgcatagatgactacatccccatggcagaaactgaggctcagaaataaggtagcatgctcacgccccaaggcttagtcacagaaatggagcccctatctcgggttccccactctgctcctgctacgccatctcccacgtgtctgttccagtgagcgtgctgggtagccccaggaatagcacaccaacgtgacatgtggaaacatattcaaagggcctcgccgtgcatatgatccagtgtgcccacagtcttagacaaccgtgagcaaagtaagatgtttacatggagagtggttttaaattaggttttgttttctgtcctgattatatgaatacataataaccatcttttaataaatgccatataaggaaataagcggggtatggacacactgatcactgaagggatgttgccaagacattgtaaatcatggttgctgtaaaaaataaaggagaataacaacgttaaagcaggcgagttcacggtctggagtgactagaccagccatgaagataagggcacgctctgtggaagagcagctgtgggaggaaggccagggctggggacaaaatggcaaatttgacctggggatgggttgtttagcttgagggagccatcatgctgctggccattcttgctgggtcggcttagcatttccaatgattggtaggagtagctgtaaagaagatgttaccctcagcctgggggtcgcaggtgtgaggagaggagagtcaaggatggaccgttagggcctgagatggtgatgctcgcataagctgcaaaggtcacaggtaggaaggaccacatgggtaggagggaagcagtaaagattggtgggaatacacccccacccccaagcactgtgtgagagcagggacagtggaaaccagcagtgaatatgcgtttaagattttatccaagtccagtggtggcacacgcctttagtcccaacactcaggaggcagaggcaggcccatctccgtgaactcaaagccagcctagatctataaagcgagttccatgacagccagggctacacagagaaacgccccgtctctctctctctctctctctctctctctctctctctctctctctctctctctttctctctctctctctctctctctctcacacacacacacacaacagttgcagagcataatacagactgtgcaggtccctgtgcccaaatcccagactggtctagcatggccctgctgctgcagccccacctgcacattttgggtgctcagctcaacaggaatacaagctaggtgacagagtgatagtggctctttaaaacgaataagagccccaccaaggcaaagtgacttgtttacttgggcatattttcatctttaagaatccagtgcaaatgaattgttatcaggcagttcagggctgagtgaggtgcagtttggtatttcctcatagtcctctgtgtgtgtgtgtgtgtgtgtgtgtgtgtgtgtgtgtgtgtgtgtgtgtgtgttgcttcatgtgaatgtcactcaggtttcattaggtcacaaatggcacactcacttcatgtttgggtctgtggcttcctggtgtcaccacagcctccaggagcctgtgctctcaatgggtacctcagtcacccactacccctatgcccagccagctttgtcccaggactaggcttctcaaagtcctttctctgccgcttcctcaagttgtctgaggcaaagtcctctttaaaaccaccagttcactagcctaccaagccaaatccatcctggggaaagacagatctgacgtttaaacaccagagggcgccccagtgaaactgaacaggcaagttagttgctcttgggcaagggagagttgtccagtattgttgggcaggcaggacagagagttgggtgttgctgatttgctgatgggggaggggtggaaagccaaacagaggcaaagtgtttgcctggactatgtgttctgcctgagcatgctcagaccttcctagtgatacctggtccagacccagaaggctatggtagagttttcttgtttgcttgtgtaactgagaaaacttctcttccgcacattcccacactgccttcatcctgagacatccattcagctggagcctctatgctgtgcccagtccagaccagtggtcacactcatgcggcaagaaggaagtctggcctcgcctactttgtttgatacaagcagtttcttatttgctttattgaccatagattgtagggacgtttgggtctcctagcaaagcagagcagaaatgtagagtcccccatagatccctgtcccccacacatgcatagaccccaccataagtgttccacaccagagtgatccactggttaacactggtggacctgtgccaacatgctaccatcgtgcgaagtccgcagtttacattgaggcttatggtgggcatcagaagacagttctacagtaacatgcatctggcagtgtggcatggaaggcagtcccctgtgtcggaggattatgaaaacagctgccgaaaacattcatgggcaggtttttggtgtagaagtaaattttcaactgattttagtataaggagaaccaccagatgtatacttgctggattctgtggtaaagagaactttttcagggttagcggcacctgagttgtctaatagctaaaatggcagtgctgttcttgctccacccttgaactagcagtgaacgagggttttatatcttacatcttgaccagtattggattggatatttacagtgttttagattttgtgtgttttaatattaatagaatattaatagaatggtgtagtagtatcatactctctctctctctctctctctctctctctctctctctctctctctctttttctctctccctccccccttccttcctggtgaacaaaaccaaacagctctttctcacttgactttgcatttataatccaattgattttgatgcattttttaaatcttatccttatcctggatgtaatttgtacatttttctagtttcttagacgcttagtttctagctgcttaggtgacttagggacattttctttctaatacattcacattgtgtgctataaaggtccctctaagcatgctttggctgcatctcatcgaatttgataaagctgtcccttccatatcaatcggctttcccctgggagtctccctttgccttcctcgttagttggcagtatgttgcctgagattctccagttacccttctgttaccgacttctagttccacaccgctgtggtctgaaatcagacatcctgtaaatgctgcacgattatttggaataagatgtagacgtacagctttcacagtcctacaaagagacctccgctgaactggagctcaggcctggagcaagactccagcccaactccagcctgactccagcccggtgtctgcttcttggagttccccatgtttccttggtgattttatttcatggagcttttgccaccatgataactccagcctcagacccactgtaggcacggcctagccctggttctaaagcccgctgaccatctggaagcgctggaccattcctgactttaccggcctagcacccaacatacttatagccccagatctggagcacagtaatagaggcctctatggcaaccgctgctcatgaacagctacccctcgtactgtagctcctggatccaattgcaaccatgtacgcatcatcggatggtctgttgcaggctaggatgtaaagtcacaacagttctaaaacagtttgatttttatggcattttatggtccagcatgtggtgtgtacaaagggacatttctgtgtgctgcagacagtgtgtgtctttctgttggatgaaagtcagtggactcaggtctatccatgttattgatatagctgcagcatttaaccatgaccttggggattttctgtcttcaagtcttttcctgtctggtagaggagtattgacgtctctgaatctaatagtgaggccatccagttttgttttgttttgttttgtttttttctttttctttttttaatcaggtacattttgacattctcttgctaggtgcatacgcaccagggattttatctccttggtgagccagctcgtttatcactatacacttcccctcttttaatacaatggctatgcttgttctaaaactatctgtatccggttaatatactgtgatacaaagaagcagattctctctaaaaccctcaaggaagtggcaggagatatggccaagagctcccttggacactggaaactgcaaatattaaactttatatgtgccgtgtttcttcctttcttatacatgtgtcagagttgcaattataaatgtaggtacagtaagaggctgataacaataacgagcaatagaccaggacacttgtaacagttgagctgtcgtgtgctagcatcacgtcctttgcagtttggggtcttatgagtaaaacagtcactgtcatcatacccatgtgacagtttggattttaaacattgtccactggcccttgtgtcagaggcttgggccacagtttggtttggaaagtagtggaatccttgaagtgacaggtctccttaaactgtcccctccatccccaccatccaagatggaacccagggccctatgcattagtaggtaggcaagtagtctaccattgagctataccctcagagtctgttaaagattattagcccagtttgaaagttccaacatccttgctatgtcagagtctagatccattgctccatctcctcaaactcttttatatgttttatattttttcttgataaccagatatgatcttctaggctaaaggactggcagtgaaagctctgtgatgtcttataggtagcttgtgtctacggagtataaacccctccggcagaatggggtgattagagtggttttgttaggagctgataaaacccaggagtaaagctcaaggaagatatttcttctctggcctgtttcagggccgttgggttttctctggccctgttggaagctggctgagtgtctcctgtgattaccaggggggctccctatatcatgtgacccacagcagagcagtgggtagaccacatatatggcatgcatccatttgggcctagaatcatttgagtccatgaaaataatttggttcttgcagaggcagtttcctgttggcctaaaggaagtgtaaatgtgcctgctgcttgttctttgtgtgtgcagggaaagcggcagagagaaacacccagagtcaccttctggacactctctgcaaggtggctgctggatgacagtagttctctctaatgggataggcggtggttttatctattttcatttttcttcattttccaaccttttccaagtgagcccattccttctgtaatttggtaaaggtcatgttttgggcgtgagcattggctgtctatgtctcccttacagtctgcaaaatgaatgttcaccggcgatgtgagaccaatgtggctcccaactgtggggtagacgccagaggaattgccaaagtgctggctgaccttggtgttactccagacaaaatcaccaacagtggccaaaggaggaaaaaggtaaggaagccaccgtggattatccggagctctctccaggcctgcttctgagggcatccctaggtgagggtgggggattcctgggtttaggatcggcaccttactcaaaatagcaggtgtttgtagaaagaggccagataacacgaaaggctcattacacctcaaaaatcggaggaagcagatggcaaagcgagccttaggagctatgtgtgggttaggggtcttagtgctagagtcttttccttcgtgtccataaaacccgagttcagttttcaggaacacaacagaataaaaagctcacctgagcaaacaagctttgagatgaggatcttgaagtcccttctagaaaacaaaacaaaacaaaacaaaacaaaacaaaacaaaacaaaaacgacactccagaaccatggttctcagccttcctagtgctgggaccctttaatacagttcctcatgttgtggtgactcccaaccataaaattgttcatcgctacttcataaccgtcactgtgccaccactatgaattgtaatgtaaatatccatgtcttctgatggtctcagggtcattcaactcccaccagttccccgggatcgctgctgctttaggcacggaagcagactaagctgctaccagagctgtcctgaagtacttagtgtctgaatgtgggccccggtgttaaggagagctgggtgcacagatgagctggctcctttatctagcactgagttgatcaggaaatctacttaagaatgcatggcctttctttagagaccaaagcctatttacccatatggcattctaagtgtcatttggaagagttgtatttttctaatttgttctttgacgagtcagagcctacggatgtaaacagagctggctctgcttcagccttagtacctgctctagaaaattttagaggcctctggaaaacaggttgtgaggaggatcagagccacattgtcagaatagacagtgctgctgtgggtggccagggggtggccccacctgccaggtgtcaaacaaatagcaaaagtgctattctaggggagcaagtgtgtctctaggtgcctcctggcctttgctctacccttggcctgaagtcccttcagaggagcctacatttccactcttcttggttttgaacatgcctgtgtcctttccttcatgcctccagaaaaacgtggttcccactgatggggagacaacgttcatctttttaactctctcttatgtcttcccaacaaacaaagctgttttgtaagccccgaagaaactatcctctcccacacaatgtcttaaacattgtgtggcttctctaggacctgtgaatcctgctggggaaaaaaagcaaaaaaaaaacttttttttttttggtgccccaaggcactgcagttgcaaagccactgtgacactagccactctagggctcctaaagaggcaggcttagctaggcctctggtgccttgcactagtgatgagcgccagagaaagtcctcgtcggaggaatggcttctctctgttggaagtgggacaggctttgtcacaagaggactcttctgtcctgtatccacgccggctgtgcttccggtgacaaggcgctgtccactgacttacatttggaaacttaagtttgtggactcatgatgagaaaggaccggctggaaaatgtaagaacgggtagagaaagctcccaggagttatcacccagcgatctccactgagtgacagctctgagaggaagcttcagttgtatgatctgacagagaggggagagacatagccttggtcagaagctagacggtctttgcaggagtctcagaccttttgctagaaaagacccttgggaagactaagagcagagggagccggaattcttgtgaactctagatccatactggcacttaagctggacctgccagcggtatcccaggggacaaatgtgactgagaatcttccactaaaatgttctaatgggtttaaatgacatctaaaaatattaatgagtgtctgttatgccagctacaagaagcagtgaaagtactggaaagtctgtctaaggagagaaccccacacaatataacctgcaggtgctgccattgatataaaggtgaataagaccatgaataaataccagagtagagctggtcgggacctcattgacttggagagagaacttgcactgtatagatattgtggggttgggagtgaggagtggggagaggtgtgtgtgaggtgtcacgggaagactggagcagagcttggctttagaggccatctgtcttgggcaaggataaatatttgaggaggcagtggagatctttcgttctccatctgatgggacactgctgcacttctgagcttctgtacggtggtgtctcaatgcttttgataactaatgcaggcattctccctgacgattctcccgccctctgctctctttagctcgctgctggtgctgagtccccacagccggcttctggaaactccccatctgaagacgaccgatccaagtcagcgcccacctccccttgtgaccagggtgagactctgagatttgcctcttaccagtgacccctgtcacttgctgttcagtgcagccagcagtcctaccagcaggtccccacacactacttccttgttgatatggcagtagttgctcttgcaggcttacgaggctttcttgagggcgccaagcaggagtgctcgcctctgttccctccagcctagggttagcgggaggcccacatgtgtgggatgcagcctttgctcactgcgccatccttccggctggacctagacatgtccgtatacttgccttccagccctccccattaatggtggcaccccaagatctgagatttggctgatttagggacgatgtctcttctcctattcatttatggaatctgagatgctagaactaaacagggacttctgtctgaaccctccccttctggtgacaaacgggtcccaaccatccccggagagagctgcatgctcccacaaggcggaatgacctcaccgtagggtggcgcccttccctgtggccctttctgaggtgttattgctaatattttacccacatcagctctataccaggtaataggctaaggaatgggagctcagcattgagaaatgcttgtcctgaggcccagaaccaagttggtgtccaggattggcctgtgcctctcctgaacaatgagctcctcattggaggtcatcgctatgacacagcgcttcttactcaggagtgagcaggactgtttcagtggcccttctccagtcttgagactatagattagtcactctcagctcctcttccagcctctttcacttgctgtgtctttacttcattcccaaagagattccatccctccctaagtaatcagcttagagatcctatcctgggccagtcagacattttcagctttccccctttttaatacagaatgtcctgaaacctcaaagagatggggtccaatgataacagacctagatagagtgacatacccctgatttttaggcctggctcttgcctggtgtgctgtctgctgtgcctcttgggcctttattcagacagatgtgccatccaggcaggtcccatgcttcccagcctcacaggagaactaaaggatatgtaacatatcacaaaactgagatgagcgagaaactctttctcctcttctgtaagaattcagaaagccattttctttgagctttggggtcttcagacacctgagttctaccttccaagatgctcttaacaactgaggccttcccggcgggacaaaagtcatatcttggagtgagtgagctacagaacttctgagtctgtcatgcagggctgtctgcgggcttggctgttgtccttccaccccgttatgagttcactccagatcccctgcgtgggcccttaggactcgagtccttctggaaaggaagcagagaccttcctctccagaggtgctgttcactgatctgtcttcattccgaggcatagatactctgtcaccgtctgtaacccctgttactcatgagagtcttttacagtaggatcatgtcaggacacccatactacacagatgagtgctcctgttagcgaatgaatgtctaaccataaaagaccttcttcatacagaaagggtcagagggccacccagcactgtcatccaggtaatttaggtcacatactccagaaggccacaagactgtctcgtagttgagaaattgtactgcggaattcctgacccagcagagataagtttgtggcatgccattgtgggaaactaatctttgttaatgataagcctgtggctcattctattgggtagcttcgtgtggggcaagtgctcagcataaagccaacctcaaggctaagtaaaggcgtttagaaaaaacaaaggcttcctagatgttgttttcaagttcttttggttctagttcacagcccccgtgagtgagtgagtgagtgagtgagtgagtgagtgagtgagtgagtgatttctgtcaccaggaacgcctgtgagggtgacttctgagtgttctcatcttcaaaggaaagttgaagggaagggtgccttgttgcccctgagtctgcagagatccagggaaggcatgtagtctcaccacaccgaaattatggacaaggttgctaggccttcagaggcctttggtggcaatgagtcccaacagatcgggaactgtgtcttcctcgtctttgcagattgacgccttgttgtaccttaggtactgaaagaaacatgttagacagatggaggaacctacaggatgcccctgggtctgccgccgccacgaagaaatgaaggatgatcatgggtcctgaaggttgagtcttaatgtaaatggctcatgaggtgtgtcctaatccagttcctttttacctttggccctagaactaaaagaacttgaaaacaacatccggaaggccttgtcatttgacaaccgaggagaggagcaccgagcgtcgtcggccaccgatggccagctggcaagccccggagagaacggggaagtccggccaggccaggccaagcgcttggggctggatgagttcaacttcatcaaggtgttgggcaaaggcagctttggcaaggtctgtgggcatcaccgtaggattcagtagttctcacttatcaaatggggaaaagaggcaaagagggagggagggagggagggagggnnnnnnnnnnnnnnnnnnnntttcatgtgttagcatgtcccttcttcccaactgtcaactccatgtgcacatttcttcctttgtgcagagagccatgtgaaatcccgctttctcagtaggaaaaccttaagcatgagctctgagcgtctgtccttggtggactccaggttcagagcaaaccttgctgtgtaggactctggaagctgaatgtccttaactgattttcctggtgcttgctaaccattctgctcttcttctccatgtgagaggagagctggataattgtgtagtggatccgggcctttgccctggagggcatttcccccagatctctgctgcactctatgccttgtggggctgtgcccgccagtgatggtcctggcaaaatgcaaagagcccagaaaaatgaggggcatttcagatatctgtctatctgtctccttgtctgtcttaataccgtgcctggtgtagcagttaggttctctcatttgtgctgggctctgggaagcagccaggagtgaaaggcctaattcaccattccaaggccattctgagggaaggctccgtgaagccctcaggcacagggcctgcctctgcaggcactcacctgccctatctgtcccgagatcacctagcagggaggttactgaaatttcctcagatggcaactgctgaatcgatcacattctttaaaaactagcttaataagaaacagaccccaggcctctggtttacgtgtggctctggcttaggctatgagcagggctaggtctaaatctgagcaggattctagggaactgagcatgctcagaactcccaggtctgcatgtaaggtagacaggataggggtcctgaagactctgagcgcttagctggcttcttaggcaaaatcacaccatcgcaagcagcttggagcccgttttacataggctgtattttgtaggtgacagaatccgcaccctctcaagttccttgggttatgttcgtttactttgacggcaacattggaatagcattcttcaaagttcccaggaaggagaatgacctgctactatttggagataaatgaaaacgccaactgataggcaaatgccaagaaaacagactccccataagccctcaggggaaggaattgtgtctttacctgcagcactgtggataaaactgtaaaggcaaacacagggcacgattaagtacacacagataaagaggttatgttcagtaagaaaagatagcagcagcttgtcatgaagcaggcaagggagggccggtgcggagagcaagaggtttgtctttatgtctcttatgtgtaccgacttagaagtaacaaccccaaataactagacagaggagaaaactctcccacaaagagaatcgactggaaaataaatctcccaggaaggtagactgcaagttgaaagcagagtcagggtaatgtctcccgtttgtcaaggaagaggaagcaagccaacagaaggggaaggcgaaagcggccccatgctcagagacactattctctgaagtagccctcttaaaaaccaggaaatgtgggctgcagagatggctcagcagttaggggcactgtctgctcttctagaggtcctgagcaaccacgtggtggctcacaaccatctgtaatgggatccgatgccctctcctggtgtgtctgaagacatgtacttatataagtaaataaacaagtctttttttaaaaatcgggaagtgtgtaaaatgttcaaccctttagttctaaaactatctatttcaaggatataatgccaaacaaaattttaaattgtgtccaaaagcactcagcgcaacttatatagaacttaattgggtataacttgtttctaatatgaaggagatagcagaatcaattatagtgtatttactttgaactgagtaccagcaatcatgatagagatgaagactttataggaaaatacatataacatattacttcttctgaaagtctgtatgtgtgtgtggtatggtggggcacacctaatattttagcatttggatgaaacagaagtgtcatgagttcaagaccaacatgggctacatagtgggaactgtcaaaagaaatgaagaaagagggaaaaggcgagaagagaaagatacaagggagagataggaagcacgctacatttgttctctgataattacagtatcactagtggagatgaagatatgaataattagcccctgtgcattaaacttctcttacctgagcactgtgccagagatttaaaaaaaaaaaaccccttaggtagtttccctaaacgtttaaaatgttagcttcctaaacatcttcattaaaaatgaaagaaagaaacaattgacacttagatatttgacatcatttggttctgtgggtgtgaagactgaccagatgtgttaaaactggttgcaggtcatgttggcggaactcaaaggcaaagatgaagtctacgctgtgaaggtcttgaagaaggacgttatcctacaagacgatgatgtggactgcacaatgacagagaagaggattttggctctggctcggaaacacccttatctaacccaactctattgctgcttccagaccaaggtatgcttaagaaggggctggccagctgacctcttgggtagtatcgtggcatctaacacacagaatctaagctatcagaaaccacttttgaccgtctgtgtacctctctccaagacttagtgtggtggagtggattttacccttgcagagataggcgttcaattgaacaccatatgtgtgtctgtgcagggatgcaagatcgatagtgcactttcagattgtggcaactcaaagccaaatggtcaaccccagtgttgactcattggaaaaaccaacagacgaggtgtaaacccggttccagctcttttcaatcaacagtaagattgcttctaggctgcttcagctcaaaagaagaaaaaaaaaaaaaaagcaaaagctaccttcatccttctaccttgtgtgatgtcataggagatgttgaatctaaacaaatgcttggaattccacagtgaaatccaaccatataaaagttacctggctgccagcaggtggcagtaaaggatgagtgtgtgtatggacattgtagcacacacccacacccatctgatttggtattattcttacagaaacagcacatgttcttcataaaaattcttattttattttcctttttggaaatgcgtatgggagaaagtcttctaggatgcattgtgaatctgtagtatttgtgtgctttagaaggcaatccagactgggtcctagacagtgaagggtgacatgtatgtaggtgctcgtgtgcgtgtgtgtgtgtgtgtgtgtgtgtgtgtgtgtgtgtgtgtgtgtgtgtatgtgtgtgtgtatgtgtgtgcgcgtgtgcacacgcatacatgtgttctatatgctaggtcctggtgaacaagaccccgttcctgccatcagaaacttgacagcctctttgctccagcccccacccttacccctgaggcagtttctgagaaccctgcttgtctgaggagctttaggaatgggagactctgtggcctgagctcccatccagtagtctcaggtcacattagctcactggagtcccggaagagtcctgcagcgtaccaagaaagattaccttagtttaatccacagttgcccaattattttggtcccgactctcccccatcaacccacgcatgacatcagtaagcaacactgatctaggaaagttttcctctccttctgatggcatcagaaatgagaaccacctgaaagggcctggccactctgcggcttatttttcaggaacaccagggttgctttctctatgaaactgtcctcagagaccctgcttcataaaaatctgtttcttttctgagaagcctcagattggtggctaagtcatttctctttcaaacttgtgttgtgtaacaccaaacagattagtgtgagttcatgtttgtgtacaaatgcagagtccagtgtggcagaacaagtgcagagatgggtttggcgttgttctcccactacagcttggctactgtggttttggttttgagatggggccccattctgaagttcagttcattactagcctggaactcgggacagtcctgcctccacctattaagtcctggcattataggcacgagccaccatatctaactcatttagaacttaattcaagatcaaagagaaaagtatcaggtgtgatatgtctttattgtctgtggttcttttcacatgggcttacattcagtagttttaagttttgtcttaaaagcaataacaacaaaaccacttagtctacttttttctttgtatcattgaaaaaattgtttcagagaaccaacagttgtgtgtgtgtgtgcgcgcgcgtgtgtggtgggtattgggaattgaacttagaatctcatgcctgccttgaagtaggtgctgggtgtggggttatcagcgggacacagatttgcctgaggaaggatgactgggtgactggggtcaggacttggggctcatactaacatctgcagtaaattagcactaagaaatccttagtgtttccgtggcattcacaccaagaagagctgggagctgctgctctcaggtctagcggggcagcggtgcttttgaagggtgagatggagtggaagcagaaaggacagcctcaatccgtgctcagttttcaaccttgcttggatgttgtttttcctgaaaaagtaccattcctcagccaccatactgttgtggttttgactgagattttcatatatgattcaaacccacaaatatctgtttcaatcctattaagatttttgcctcatccttcattagaacgggcaaagcaacagtgggtgtgaagttggtttgggctgagccccagtgtggtggtttgaatgagcaggacccctccgggctcagctacttgaatgttggcctccagttggtggcagtgtttgaggagactcaagagatgcagctttgttgggggaactgtgtcactgggagtgggctttggacttcagatgcttcccaccattcctaatgtgctctctttgctttttgcatgctgctcaagagctgagccctcagcttgttgcttccaccgccatgtctttgctacaccatcatggactccacccctctggaaccataagtacaaagaaactctttgttcttaggttgccttggtcatgctgtctagttacagcaattagaaaagtcactaacagactcaggttttagtatacagggaggaatagctcttctggaagctgccttgagagcgtcctggtcgattatgcagaactttaaactgggtgccatgtacaggttggctgggagagcttgggagagggtaaagtaaggtcctgtgccttttctggcatccagcaaggatggccatgcagagccattggtaacaaccataatggcccagttaagtttgccagcagcagcctgctgaaggaccaagctaaattcaaataaggacttaaggtttctctcttctaagctgttctgtccttggtgatgtgctgtagtcttcttccgcagactctggaagataagaaacaagtgaaatgatcccagaacccagcgctaatgagaatgatcagataggccagtcaatcaaaccacaaatacatacatacccatcagattctgaccttgtgctagacttgagaccctgctgtgttttttagcttctagagaacctgaatcgggcgagggaagctacagagctggcctttgagatagggttagcattgggaggaaggcgggcacctagagatggctccgaagttctttctagatttcatttggcattctcccacactagacttcacagctcctgtttcctgtttctctgtggacagatgacacgagaaagaggagaagggggggtgcatactgagaaaataagcaaaacaaattcttgctgagagaaagggacatggcagcgctgggaccctctttagggggctgtggtgccccgctcggctctcaaaggcatggccctcctgctccaggctagagccccgtgcaggagctgctttttcggactctgcctgtttcattggctgctggcgctcagagagctcccaggaggtagatttattttgattttgtggttaacagaaaattaaaaatcccaagccctttgagattttgtgtgtttgtactttatcactgccattacaaatccatcctttccaactggatcccacaaaacctgacctggccggtttcacccgtggcattgcctctttaaaacttgcagttgtgcacactgtacccgtcccccaccctctggcatttcctgccaggcctgggaagccaaatccaggaggactttgctgtgaaggaaactggggaagcggggctgagcttctacaggatctccgctggccagtctccctccagccctggggaacgggcagcatggaaaatccttaaaaagcaactggagatgtttttcgaatgtgacttaatcatctctgtgggcatggggagagcttcccagagcaagtgttgacaacataggagagaatttgtagtttcaaggaactctaatgtttgttttgacttttagcagaacagtaaaccctaaagaaaaaaatgggaaagcaagatgatcagcagagagatggcaaatctaatgaataatcaggcaagtctgagagagcagagaaagcaactgaggggtaggccatggtcctgctagaccacatgatgctggaggtccaagggcctgggaggagttggagggcttttggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgctagggtaggtagtgtttttctaggattaggtgaagtgagtctacatggaatgctttgggctttgtgtgacacagtggcttatgtagtgatggcgactggaggaagcacatctcccttggtgctgaagagcatcctgagtgagggtgctgggaagcaatgccatttctcttgctttagccagtttacacactcaggggtcctgtggcctgcaagcgaccaagggctcatggagactctgataggagggtcagtatttaaagtcattgagtggtaatctttgcctcctggggaggacggaggggcatgtctgtgtgtgtgtgtgtgggggggggtgttggaaatgcaagtagaagggccacatgatttcatatcaatcaggcctgatgaagagatcaatcactcaggtcttgaggcaaggacccactctagaatgaaatgcatgcttatagagttcactttgctcctgtgtccaggatagataggcagggaagatagggaggagcagggaggagtgctgccccttagtctagatactgtcacatcacgtcagctagcttctttgcatgtaaggaagccatttgcctgaactggagtcgccgtcataggcttctgctcagctggccctcttcacatgctacgacaaggcaggcgtgattattctcttctttattttcacatgtgattatgataacatgaacataagatgtatcaccttgggcacaggcctataaatctaacacttggaagctgaggcaggaggagagaaagtttgaggtgacccttacgaagattgcctcaaagaaatatcaagcaaacaaaacaaaacaccccaaccaaccaaacagccgatgctctgaccttggggatggggtgataggcacatttatgcacttgtgtgtgtacctgcttgtgtgtatacacttgtgtgtgtacctgcatctgagcgtgtgaagcctgaggtgaatccggagtatgttgcatcatgttccatttttaaaacaagtccttggtcactgatcccagagcttgtcatttgggcttggctagctgtctccggactttgtctgtcttgccgaatccagaattggctagggtggggcctcacattctcctattcagtcacagtgtgttgacctcctactacgtgccaggtcatgaggcaccacattctctgtcacaggatgtagtggcagccaaaggaggtcatggtctcactttatgggagcacacttattgtgtcacagtgtggaaagtgctggcttcatgctagttcccaaacacggggctttgttttttgagataggatcttactatgtagtcctgactggactaggactcactacactgaccagactgggttcaaactcacagaaagccacttatctcagtctcctgagtgctggggttgaagacgtgccccaccatgccaaaaccaagaatgtttattctttgtggaaaatttgaaaaattcaaaaaagacaaaaaaaaaaaaagaataactcaaatggctatataacaagaacaactatgtggtgtttcctgattgttttaaaataacatgcacttgatacatatattcctaaaatggcgaccgtcatatgggattcccgctctccttcctcttataacctccagctggatggtttccaggcttcgagaccacgtaaggccctggtacagaaatcttgcactgaaggtagaagatggccacaaatgcttggtttctagcggggctgatctgaaagattagactctctccacagtgcctgttcatctctgtctgagggctggccctggcctcccaaaaacacaacctaaccctgtgatacattctatgatacaaacttgaccgtaacttataaataagccattgatgctgacataacgcagaccaagagttaaagcctttagtgtgtgtgtgtgtgtgtgtgtgtgtgtgtgtgcgttctgctaagctatttgtttgttctaatgcagctaattttcgtattcatacatagggtttatagatgtgcctcggttgaggtagtgtgtgtgggtgtgtgctcatgtgtgcaggccccatgtgtgggtgtgtgctcatgtgtgcaggccccatgtgtgggtgtgtgctcatgtgtgtagcccccatgtgtgggtatgtgctcatgcaggccccatgtgtgggtgtgtgctcatgcgggcctcatatgtgggtgtgtgctcatgtgtgcaggccccatgcatgtcccaggaggacggccttcatatgccactttccccatgtgacagagcagccccactctgtccagcttcacaccaacattcccagcgaggcagatctgggactggatcacagcgcccactcttgcctcctggggtagaagaacattgtagggagaggtagggaaggaatgggctctgcctagttctgctggtggaggggggagacagagagttttaaagagcaagagatgtcatagaatagatcctgattggcagaagtttcagggacaacagatccatcctgggacgtgtgagaaagaacttggtgtgagagattctgactaagtgctagaactatgagcgatgccagacaagagtccagactcactctggaagagaccttctcaaagatgttctagagaacgatgacttagaaatgacagcctgtgcagttctgtatggcatgaactgaaggaaagaaagacaagcaggaacatctgaggaggccatttgcgtgacccaagagcccaggggccatgagaggtcttgaagggaaaactggcaccaggcatccatttccctctgcatccaaaaggccagccatcttctgaagaaggcgtaggtttctgctgactggtatagaactgttgaccagggaacttgggactaatgggagagggagacgctggctgctgccagctatggtaagcgatgggcacacgtgcatctcaactgctcatttcctaatccgaatgaaaaggtttgtgtagaaatccaaaactagaggccagagttatctaacctgttgaccaaacaaagccagtttcctcatggctgacgtcagccctctcgatctctccatggcaccttcatcgattggatttcaggctttactccctttttttagagtctctatttttagatgggtgttgaattttgatagtggtgtgatgttttcctcagagggagtcacatgggttactccagggaaaagtttctgccttgtctattgaaatttctgccccccacccaaagcaatgtcctttcctcatatagcctggactttttgttcctgtgggctctgatacttcagataaccccactgctgtagctttgaaggtcttgccagctggtgggtacagcccactagaccatttgagttcacagtaccctattgatttgtagggaccgtggtatatcagagggagaaatgacctttctagttctggcttcagtctacaaggcttgcctggagacacttctgtgggcactgatttgattgttcataatcagagatggcaaaggacacaagggaactcagaatacgtgatttgcaagatcccgcgcaaatctgacattcagggtctattggatatgaaattcataaggaatccacaggaagaccattctaatcttaacttgcttcaaaagtgtggatggaatgaagacactaagaacatccacggatagatctttctgcttcctgtttcttttccaaagctcaattcagtaaaatttcctacctcagcctaggcctgtctacaataccttttttttggggggggggggggtagaggggaggtgttgagacaggatttctctgtatagacctggctatcctgaaactgctctgtagatcaggctgcccttgaactcaaagagatcctcctgcctctgtcttgtctccaaggaaggtcacattttgggaccatttcatcaatacagaaatagataatatcgttgtttggctctggactgtttccccagaaactcctgtattaaagagtttgtcctccatagagtaagttcagagatgggaagatgaccagctcttgagggctccagactcattttgatagacctttggtagacaacagaaacccccagaggtgggacttcaaagaagggagagagtccttgtgaggcgtatcttaccccagccctcccccgtactccgtacttcctgcttccactcaccattggcgcttggcatgatgttgcaaaccacaggtccagaagccatggagccgtatgagcgtgggcttaagccatgaacccaaacaaacgtggccttttagttgatgttcttgggcattttgtcctagatggctactagtgctagttcagaacgttggagagaggcatcttctaggcgggctagtgttcctcttcctcttcagggccagccctggctcagtaatgctagagtatagccaacatctcatagagtactccaaaatgccagggtcaacctcaagcagtttaaatactgctaacccagtctttacactgcccccaaggagtaggaatatcgtcctgcgaggccacacagcaaaaagtgacagagcctgaattcaaactcacttagttggcttccagaaacttcatgttgtctgactgctccgaggaggatggagtctaaagatgaacaaacagagagactagaatcccaagaggataatatgtaactgaaatgtcagctggcttgtttatagggaggtagccagaatctgatacattgtaacccagggatctctgggacgactgtttagggatggtatcttgggcaatccgtgttgaacgtggaaagcaagaggataagtagagccctcttcctggaatgaagatgaatgtcattggcagagccaataggaagttgcagcccccacccccactggaacattctgttttcaccatgatgttccaaggggaacaccagcatgggtcccaggcaacaagaattttctccgtccttagtgtgggtggatgtaaaaagaaatgcctctgctggcccaggaccgcattcacgtgagattcatcagcaacgtgtaagccgcgtaatgaggaatgtctgtgtgcaagatgctaaggagctaagcttcttgcctgggtctgcctgctagcactggacctgctcgcctcgctccaggcttggattctatcccaataggctggctgttctcccatgtcctctaggactgtggaaggcacagtgtagcaagagcctgaggatcagagaagccagagaaggccatctttgatctcccttgagctgccaccacttgaacagcacaggctaattctgttttggttttttgggcaacagcttgaatccaacttgttttttttttttttcaagttctagcttatgggcattttctaggttaacccgtgttattactaaaaacatactatcaccaccaaataaagtgctaggatattgttgaaacacttctgtagtcataattatccagttttattcttttgagaaagtttattagtgatcttggaagccgcattaatcagggaaaaaaatagcttagataactagataaagcgtgtgctccagggaccaggtaagcacaggaagttgggacccggtaaatgtagacagaaacagttagcttcccaaaccattgcaagtggcaggtgtttgcacttgtgaagttgttcttgtttggggggagggggagggtgtttgtttgtttgtttgttttctttttgttttgtttgggaagtttttgttatttttaaatagacacctgttctatagcccaggctaacctccaacttgctagttagccctaagtgaagttgaattcatgaccctcccgccttagctgcccaactttggggattacacactccacttggcagaaaactggaaaataaaatctgaccttaaaaaaaaaaaacctgataaatttaggactgaactgttcacctttccaaagaaagtcaattcccattataaaaaattgtatgaaggatagaggcgttcaatggagtaactgaaacctgatgtgttaaaatacacctgtaccatgaaccagccactaaggaagaagtgttctgtgcgtgtgtgtgtgtgtgtgtgtgtgtgtgtgtgtgtgagagagagagagagagagagagagagagagagagagagagagtgagagagacagagagagagagagattgattcaagaagctgatgtttttacagtttctatcatgtgtgccatttcccaaagctcactatagccactgacagatccttccagtggctgtaggaggcgggtgtcctgaggcacggtaatgctaaccagggacagagctctgattggagctgggtggcctctgctcccttcccacctgttatccgtgcactgtgtcagatgttacactcttggctttaggacataatttcgtgtcttccttaccagtcacccctgcacccctcctttcacggataaggacactgaggtcggggtgggtatttcatcataactccatagccaagggagccaccaaagtgccttgggcttcctcctcttcccgtggcctccttcatcccccagtgccaggatgcccaggtaaaggtgaatggatcccgagacagcaggcaggggcagagctgaaactgcccagaggcaagcctgttcctgtgtactcactgcgaaaacatcatggaaagagtcgcttattctttgtgtgtgggaaagcttttcttacaatgctgcctaactcctgagccttaaagtaaacagctacatcatcccgtacagaggcaggaaaaggaaacttcagcactgaaaaaaaaagtaagtggaggaaatgctgtttaagggggattttctggagcccctatgactgaaggctttgcagctaatgaaccccccacacacactgaccaagccatgtgtctgaataaatgtctcccaaactgcacctatcctaaatgtccttcctgtgacacaaagaggggaagacacccccaaagcaagactagaagatcctgtaaccctgctaagctacttctacttagggagttgtaacaatgttttcatgtgcaaaactggtggaggtgacctagtgtccagtgccactgcctgctgagagccttacatcatggagagaccgtgatctcggcggtggcttcctcatctgagaagatgcacaggatgacagacctctcagcacatggctaggccatcgctggagatgcttctggcggcctggaaatccagctctctctctctctctctctctctctctctctctctctctctctctctctctctctcagcagtctgtcagctggccagcttgtcgactgcctgtgccctttaaacgacagcaggagtctctagagggttttctggcttgctagccgggcttaagcatttcctgtcatcccagaatccctctgggcagtggcgttgggcggtagggtgggggtgtagaacatacaattttcagaatgacttgggtgttgcaactgcttacccaccgtgggaattccccaggtctgccccttctccctctgctggtatttccgaaaaactcttgcactctccaatgtgatgccctagacggggaacagctatcctgggggtctgaaattaacctccccaggcatggccagggaccgtttcagggcaaattatccttatgtccaaccaatagggatgacttccccatctaaaccgcgtggctcttccctcttctggcttcattctgcttctccttgctttgtcgcacatggggtattttttccccttgctaccctggggtccctgttggttttgtcatctacaggatcagcacagctttctttctgaaaattgtcttcattttgcatcccctcttctgattggtggaaacttatctgaggttctgccttgcacggtcctgaatacgctgaatggcccagagtgtgtgctaacttcaggcaccctccacgtgatgaggtagcacacaccatgcaaataaaaatgtacctttaagtgggctttcctctgtaactattttggatagtaacagaaacatcagactgggggaaggtagccatttagatttttagttgaagtcagtcattcatagacattttcaaaaccgatcaaaatagcttacctacatttgctgtcaagttccgcacattgggacaactctcgtagcctagaaagtaagatgtcagtatctcttggatcttaacctgcttgctgaagtttcagtccttgcttcctggacattccagcccacaaagccatgcctattgcagttggtatgagtgaaccatccctgcctatgtagttttcctgatgtcaggcactcttccatcttggctctcacgcagactcctttatccaccctgactctctgctgtctgtatatccttcatctcattagcatgtgccacacacctagcctttttagatctgtgtgtatgaactggcctttaaccctacctagcatttgggaaaccaagggaagcagagctctgtgagctcaaggacaacctcatctacacagtgagttcaaggacagctagggctacacagtaagactgatctaaatccacaacactaatagaataggtttgtgtgtataatcatcttcccccaactcagttctgagcatccctatacacatagttgtctgtgtgcatagggattctagttacccaccataactatagggaccaggcttacccactgtaaccccccagtgcacacaccttacaccagtgatgtgagtgagggccacaccaatcagaaatcctttccagaattaaaattagctgaaggatggctcctttctctctctctctctctctctctctctctcttttgtttttgtttttgtttttgtttttgtttttttttcttccaagacagggtttctctgtatagccctggctgtcctggaactcactttgtagaccaggttggcctcgaactcagaaatccttcctgcctctgcctcccgagtgctgggattaaaggcgtgcgccaccatgcccggcgatggctcctttctcaacacctcaagagtcctggtatcatccatccaaatgaattgggatggacatgggagagaatcccaccatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttaatcctcttcacaatctcattaagaatgaccctaattagtcatggataaagtttctcttccaaggcgtgtgcttttagagattataaaatttcatatttcccatccaaacatccacatgtgcagcctgccagtgtttgggagctgtgagaaaggagctctgtgccaaaggttccaccatgcactggagacaagggaggatcgtttgaagtagctgtcaccagtgctacattagaggttgagacttcctttctagggctggggctaccttagaagagacagagccatctcagccttgatcagtgtggacagtgtaggagcagagacctggtggcccaccagagagcaatgacaagagttgcagggaggatttacaaagattggctgtttgtggaagagtagggggtgagaagggttgggatgggaaatgtgggggatggggagggttgggatgggaagggtgggggtgagaaagagcgaaccacacattccatttgaacttaggctcatcattttcataagcagcaatgacaacacatcagaacatggttccttggagaacaaagtcagggtcagaccgccatcttctccatcttcctcactaggtgtggtggaaagatgaccaagatgggagcttcctacagcacagccccacactctgttctgacagccctcgagcatagcttttgcttcctatagaaatcatgctggcccctacggatgggttctcaggaggaacttttccaagaagatgggatcaatgggaatgtcgacgttgcactcctggagataatgactcagaggcactggagaactttcagtgttaagcaggccttgagaaatattgtatgataactagtcaccgtcttattggagggagttagctgtgtgtgtatgtggagaatagaggtcaacctcagatgtcattttttcaggagccatctactttgttttctgagacagtctcttactatgacccaggactcacggattgggttgtccagtcatcagtccctagggtctttgcttcccagcactgagattacaaaggccacgaaacctagtgttttgcatggattccagggattgaactcaggacctgaagctttcttggcaagtacttgtctgactgcgccatttctcctaccccaagagagtcggctttatgatgggccagcaagtgaccgctgggcctagggaagccttcctcggttgggatgggaagtgtgggggttgggatttctatcagggcagtaggcagagcaggatatgagaagacctggtgcagaactgttggagatccaagagatctgaaggtcagagccacctgcacatggaaggtggcatttcagctgacctggaactgaattcctacttaggactcagaagggaaagaataactgagaggccaccagtgtaagtacagtcttgagtttggtaatctctcataaaggctatgtttcaatctagagaggtctatagcttcagagggcactgtccagggccccctaaaatctcatattaatgtgcctagaatggccaccaagcctcggcagatggtctgacccaatcgccagaaggtaacggcttggttaccttccttccaggttatcatccctggctaaaactgaggtggactgtgagggccctttggaaattttgctttgaaaaaacttagtgtcttgagtatcctaagatacaaaccactctatgagagtccagactcagtacagactctctaatgctgccagtaagtgcattgtgggatgttgaagctgtgtgatccttaggtgggagagcctgcctactctgtagggttggaatgaagatcagatgaatcagcttgaatccagcacttacccagcagcaccaggctcatgaaaaacacctgtaagtgatggcctctgtggggccttgccctttgctctcttgtagagagggcagcgtgtgctggggcttgcttgtcatatattgtgtcctcccttggtcagactatcctctcatcctgactctcaattttgagactgtttatagatttctgctcagttatccacgaaacacaagcaatgctggcattgctactattttatttttcatagtctacctttgggtctcagcagaagcctagcaccctggacagaacccaaatgaggattctaggctgggctctagacatcacacatattaaatatatccacagagatacaaatgtgagcattcatgttttcacaccgcatgcatacacatgcgtaagtatgtaggtatgcatccatcctgacactatatggcttgccacgaggagctataacaaatattcattccacatacatctccctgtgtgtctactacaagcaaacactgttttgttagggatccaatagtgaaccaaatagttggaaaactgcccagttagagcatgcatgcaacctcagaaaggcagtgaacaggttgttaaaatcatggtgtccggtgtgattacaaatgagaccaacaacccacaaagtatgggctagcggatgcactaggaaaggtatgttctctctctctctctctctctctctctctctcctctctctctgtgtctgtctgtctgtctgtttctgtgtgtctctctgtctgtctgtctttgtgtgtgtgtgtgtgtgtgtgtgtgtgtgtgaacctagggaaagcacagaactctcagagctggcagtaacatgagcagagccatgaaggaagtgaaggggtgacccgctcagacagctaagggggagaagagttccaagcagaggacataaccaggacaaaggtcctgtggcagaaccgtgcctggctgtaaagtccagtggagaggccattgtggttagaagaataatgagctccgtcacctcagctggttactttggaaaataacacagcggaattaaaactgaggtggactatgagggcaggtacgtgccacgcgaaggcacccgatggcctgtttaagacacacggatggaatttcctttgggccagtgcggtcaaggaaaaccacctacaggaggccatgtggatgctttagggtttccctggcagaaggaatggcaacaaacttggaggagagtttgtgctgctgtcgagaagaaaagacagaggccagggcagtgttcggacagtctcaatggcagacggagaaggttctgcaaagccaagggaagtctggctgcctcaccccagggaagcctggcctcgatggcagagctgcccccattcagtgtctccaggcctgccaagacccaagtcttggtctctacagctgctgtccaggcattgggttcaaagcttccgctagcagactaagcctttcccctgccccttgatgggcatcaccctttcagtgggcacaagcaaggttcccaccaagccacggaccctctcccagaaagaaacctcctccgaggtctgcaggagacctctcagcccttctgtacttgctgggacccctcagctgagagtgagagagggaaggaaaagggggggcaccctttcttaatggaaaatactcctggctttccgagccaggaaggcagccagggcttgaagataaggagtccaggctcctgtgccagcagccctgagtctctctctctccttacatcactcataaacctgtgtgagaaaagctgggaggtggttttacccagggacagggcagcaaaggattagcagctaatgtactttggtttacagaggcattgttacataaactactcaggaagggtcggatatcccctgggctagtgctcctgatcctgggttgtaactctagagctagggttgttttactcacttgccgtttattttcaaaagaggtagaaaaacaccccagtcgttattgaaccagcaatcactctttagaaagagatagccacaactcctgaatcttctgggagcatgattttgtgtggcggatgtttcttcttgggccaccattcagtctaatagaaactgctctaggtgagacctatattcttggagctcaaagaaggcctctgagagccacagaagtatcttaacaatggtggcccttgcagcaaaaagggatgtggccactggctgcacagccatatttatgcgtgcctccctcactcccatccccaccaaaaatagggcccgtgtcagttggtaaagcaaccaactcccaaacatggggtctgagatcaatccccagagccaacatgaaaatgctgggcatagtcccagagacgagaagctgaggctcattggccagccagtcctaccacactggggagcttcaggccagtgagaaagactgtctccaggtaaatgacaatctgagggtaatactcaaaattatcctctggtttccacgtaggcacacatgcgcgagcacgcacacacaggcacactcacacatgctcacatataccacacacatgtgtgcacacacacacattggtatactcacacatgagcacatataccatacactcgtccgtgtacacatacactacacacacacaaacacacacacttttttgaaagttgaaggagggtctagagctatggttcagcagttaaaatctcccgaggctcatgcagaggacctaagttcagttcctagtccccacattaccactaactgtctgaaactggtaaaggggaacatggcaccctcttctggcacctgtggtgactggatgcacttggtatataggtatacatgcaggcaaaacatccatacacataaagtgaaaataaataaatgctaaagactgaagtggaggcagggttgggtgaacgaccttttaaagagtcacttcagagtcagatgcgggagggcactcaggccccgggtaaagaagagccactgatgcctgcctcccctcagctgggcatggagagggagaacagctgagaatggcaaaggcaaggagggcccctctctatttatctttcctatgagtctgcatactgttgctataagcttgagggcaaacaaaaccaaagggtcacatagcatttgaatttctttttaaaggaaatggaagcaattgccaaaatgttgacgctcccggacaagagagccaatgtctatcttggcacagtagggtggggaattttctgagggtgatatttgaataaagacatctaaactagggggaaaccgtttctccagatcttatcactgtacaatgaagacttgtatagaaactgtttgtccccgccgcgtgtttactcgccaatgggaaggatatctccagggccaaaagttcaggctgctgtgcactcccaagtggcgtgcgaacttcaagtgaactggcttccaaagaggctccaaaaatgaactggaaggtcttgtctctgaatagtccctgtactcgctaaggtcctccatgaagagatttgaaatacctagagagatgaaaggaagggtagtgacgcttccaccagcacacacacatgcacagcaacacacacacatgcacagcagcacacacacatgcacaccagcacatacaaatacacaccagcatacacacatgcataccatcatacacacatgcataccagcacacacaaatacacaccagtgcacacacatatgcataccagcacacacagatgcacagcagcacatacacatgcacaccagcacacacacatgcacaccagcacacacacatgcatactagcacacataaatatacaccagtgcacacacatgcacaccagcacatacaaatgcacactagcacacacacatgctcactagcacacatgaatacacagcagtgcacacacttgcataccagtatacacaaatacacgccagtgcacacacatatgcgtaccagcacacacacatgcacagcagcacacacatgcacaccagcacacacacaagcacagcagcacacacacatgcacaacagcacacacacacgcacaccagcacacacaatgcttaccagcacatacatatgcacagcagcacacacacacacacacacacacacacacacacacacacacacacacagatacttcctctgacatcctagttatatgtcatcaagcttacaggtttaaaccattatttataataaggcagatttcccctaccaataggggaatgtcagaaaaaagtgacttagttgtttttgttgtttgtattaaaagttaaacccaggggcctcatgcaaaactcaacagaaaccactaccaactgtagtgtgtagtgagtggctatttgcccagccctttgtccactctgtatgttacagcagagtctgggtttccaggttggcctttgaattaggtgcatagctcctgtgagccttgtccttgtgattcacctacctccaccaggaaagcagctgagaggctctgcttgagcttccgggcttaatttagaattttaaatggtggcttgcattgattttcagatgtgttgccataacagaaagctgcagctctcctcgagttgggcttcagatcctgctgagcatcgtgtcaagtacctacacagtctctagactttagtacatcaggaagtgttcactgaatgcaatttatctactttcttgggcatccaaactcccactgagctgcagtctgctatggagggaagagtgcagctctctaaagagctattgtgggttccatctgctaactgcatcatgttggccaagctatttaaacttctctagacttctgtttctttgtctcccaaatggagagagtggtggcaaattcgggagaatcagtgagtgccatagtgtgaagctgtttggagtgtcactttgtgcgagggacgtagaatctcgtcatagtcttgcttctgttatcatcagggcactgatgttccagatccccacacgggcacttcagcacaagtttgctaaatcaacgtggggctgcccttgagtgtttataggcccaaccatcaaccagacagacaaataaacaaaaccccaaacctacccatccctggggcctagtgagagccctggatcgacttacctattcctttggagtctcctctggctgtgtcctttcaagggttttcctgttatttattctagaaatagagtggacactatttagacctggaggagagcctcagctgcatgcagagcttggcttccagttccttccatagctgccttcttcctagacacacaggggataattgattagcacatagtctgttcttgctggacttactgatgaatctccttagcatctgagccttagcccacgctcagatgggccgtatctgtgattcatacctatgggtgtattttggaagggaaaaatgtttgggtcaagtgactatcttagaaaatcctgacatgcccgtctagtgtacagatgtgttttctgtgactggaaggtccttgaaggtgagatctgtgctttgggtccttgtgttgctaaggtcatattctttgtccatagcacaatagatgtctggggatccatcagtctactgaactgaactaggcctggaggggtatataaggttttagctgatcgaataggagagccagaagtatttctgagggaaggtggacatgaaaggagttggaggcaggaactgggaatggtaaatagcaatcaagtacagtttaattacacacaagagtagttgagtgacagacagacagcagacatcttggaatattttagtactgtgtagtctagcctgacttcagttagactgcctggctagtttgaagatctaattcctccattctatatctgctatcaggcagagcagaatcccagaacactgggtagcaagagcccctcctaggactcctgggacatttagcagagagcccactctgaagccctctttaactataacttcatggcactcttaagggggtgttgcctcagtcttaagtttagaatttcagaatgaatttaaaagatttgggtaaaagtcagggaaagagatctgtttaatgccagaaatgtgtaaaatctcatgcgtccagtggaaaggattcgctccaacctccttgcccccacattccccaagcagatcttttgcactcacaagactgcccatttcccaaaagcttgcaaattgactaattttgattacagttcagaccctactccattcctcgtcacaggcaaaaccaccatgtgtaccaggaacgagacgtttgggagttcctcgcggtgtttatttccagtagtcgaaaccaagtcattccatttagatgacatattctgagttgttgaaaatcacttctgtctgtaaccgaaaagtcgatatgaaggattcgtttcctcagtagttcatgtcccacaggtcatcaagcacacagcaggaacagggtctcggctcttctatggataccagttgtcagaccaggggacttagactcgccaaagcagttatccatggtgtcagggctctggttctactcttttatcatgaagagtgttaaagcaatattatgacaaattgttttcatgtagcgatggcttgatctttccaaccatgatgctttgtttccttaattcaggctttcggagccacttgtgccccctaggggctaccttgggatttaaagaaaagcatttgtgtttccatcctaaccttccgtccatgctggcttcggaaaggatcatgggaaactttgtagcacaggatggaagctttagcattctgctggagccatgggaacctctgcccacagtcctgcagaagcttctcagtggttgactggtccacataaccatgaaggcattgactttggctttgactcccacatgaactgctaagtcacaaagaatagctttttgaaaatctgttctaagcaaatgtagcattgaagtgtttttcccggatactcttccatatgcatcttgatacaatgtagattagtttactctgcatttgcccatggaactaccaatgctttgatgttgaaaaaagccagcccatgctttgctgtctctgtaggaacaatctgctctccctgcacacagggcataaccgagaggtttgctccctcgagggttcacttgtacttatccaagcctgtgcctttcgaacctcgggttctaacaaaatctgatgtggcagtctcctttcgtagaacttctctttttattttatttactttcgcagttttagcatagcggattggaaccagggccctgatcagcatggagccaccactgagctgtgtcagtaaaaagctctctgtagctgggcatggtggcacatgcctttaatcccagcacttgggaggcagaggcaggtggatttctgagtttgaggccagcctggtctacagagtgagttccaggacagccaggactacacagagaaaccctgactctaaaacaaaaaccaaaaaccaaaaaccaaaaacaagctctctgcttactttctaatcttgacacagaacaagtaagatgagctgacctggaaattcccatcctccctttcagtttccccagtggctggggtgaaggtccacaacaccgggcctggctgctgctgctgctgctgctgctgcttcttcttcttcttcttcttcttcttcttcttcttcttcttcttcttcttcttcttcttcttcttcttcttcttcttcttcttcttcttcttcttcttcctcctcctcctcctcctcctcttcttcttcctattattattattattattattattattattgttgttattagcagtagtagtactaaaaatacatgattatatactggcatcagttcaaggccagcctaggttacacaatgagttctaagctaccctgggctctgaaaagtcaaaactgaaaaatcaaaatcaaacatatgactatggttaagctctaaagttgaccactgagaaagagtctgtgctgttactacaggcattagtaggttagtgagaaccaaaagtcgagcacatttgcagttttattcgagaccaaacgcctgctggacttgctctgatcctctgagggagtcttatatgttgccaagcctggccttgaactgatcagttcaagcgctcatccacctctggctccccacacactgggtgtgggctctagcacacgccaccatgcaagctgttgctgcttttctgcagtgcagagattcccagatctccctcctagtcaaggtagaagcctccatgactgacccatgttgtctctgaatgttctcccctcttgccccatctccccagtgtcctggtccccaaaagatttggctgtcatcttttcttcttaccaagttcttctgcttcctgtgtaatcagttggaattgttcacatagaaacaccagtgtgaagggaagacacgaacagcagtnnnnnnnnnnnnnnnnnnnncttcttcttcttcttcttcttcttcttcttcttcttcttcctcttattattattattattattagcagtagtagtagtactgctactgcactaaaaatacatgattatatatatcctgtcatcagttcaaggccagcctaggttacacaatgagttctaagctaccctgggctctgaaaagtcaaaaatgaaaaatcaaaatcaaacatatgactatggttaagctctaaagttgaccactgagaaagagtctgtgctgttactacaggcgttagtcggttagtgagaaccaaaagtcgagcacatttgcagttttattcgagaccaaaggcctgctggacttgctctgatcctctgagggagtcttatatgttgccaagcctggccttgaactgatcagttcaagcgctcatccacctctggctccccacacactgggtgtgggctctagcacacgccaccatgcaagctgttgctgcttttctgcagtgcagagattcccagatctccctcctagtcaaggtagaagcctccatgactgacccatgttgtctctgaatgttctcccctcttgccccatctccccagtgtcctggtccccaaaagatttggctgtcatcttttcttcttaccaagttcttctgcttcctgtgtaatcagttggaattgttcacatagaaacaccagtgtgaagggaagacacgaacagcagtaaggaggaggttagagtagaggattcgaaatgggtccagggattgactcacctgggcctcagaggtgtagagacagcctgtgtcctctcctttgtctctggtcaggtccctgtttaaagtttgtctgtgcagctgttagaattagcttcatttcgatggaaggcatgggcctgagccatatgtcggagtagcaagagatggagaggacagaggaaagtgttgatagggatacccgaggatccatacgctgacccagccggggcctagggtaagatatccttgaggaagcccgcaatcaggctgaggcaagctgctggcctgaaggaggagaggaagctctgttgtagaaatatggtctcaccattcccggcagggcttagtgtcctaggtgtgagcctttcatgaagaaggcccaggccccatcgactgtaaagacttttaagacatggaacttaccaagtggactatgctggctggaccactgagcctgtctcccccgtgctgggattacacgcatgctaccttgatcatctttcttacctgggccctggagatggaacgcaggttctaatgcttgtactacaagcacctactaagcacctactaagccatctctcctgctgcctgctatactttcaactagaagaacagcatggtggtagaaaccatagggcttctccccagcatatgtcttttcaagcctcggcgaattgccgcccaggccttccatcgaaatgaagctgattctaagagcagtgcagacaaactttaaacaggggcctggccagagagatatcccttgtcttctaactttatttaaaactcgcaaggcaatggtcacatccaaactcagcacgtgcacagggaaggaagactccgcgggactgcgggcggattagctctgccaaggtgccggcgtgcacacaggattattacggatgctgtgccagagtcatgttcactcagcattggctctgcactctcactgacccagagccctctgtcatcagaattacgtccttaatctgttctaggatcattgccacaatcttatcactctaattatagcccccaaaaaggtgaaatctgttatataactcagagcctgtttggactccttatagacatgcttatatggcaagaaaaacaactttcaggccaaccaaagagggaaagagtcatacatgctgtaatgattccaagggcttgtttttttaatattagaaatgccctgttgatgttctttaaaaaatatattgcattacttaaaaaaaaaaaaaacaaaagctcaaaaggcagttatatagtgtgcattaggggtaaatcagtcaaaaggcaactgttgcctataaagcattatggaaaataatgaaaatatccactaagattcttcattattggttaaaaacaaagcgtgcaggattgtgtgtctatgtggtagggatgtggtagagtttggggtaactcagatgacatcaggaaaaggacagtgtgagagggaggctgttgtttcagattgttcctctcagtcaccaggatggaactccagatgcaaggaatcagaaatgaatttctccatgtccacaaatcatcagaacccaggactggagagacagcttggcagctaagatcacattctgtttttgtagaggatgcaggttggggtcccagcatctgtatgatgccttccaaccacctgcaattccagttcctggaggccttatgccattcctaacctctaggctcctgaatgcatatggtgtatatgcactcaggcacatatgtgcacataagataaatattgtctttaaatcttcaagagtaccttagtgcaaagactaagaatgtagacacactttgggtccatgtgagcacacagtgttgagtgaagagtggagaaattctgaacttaactttgtcttcttatctaatggggaagatgtagctacatgatatgactaatgggcctcgaagtctcaattatatatcatgatttacagtgaaagttgccgtcagtatagagtagtagtctaggaggcttggatgaagtcttgaagacaggtgtaagcgggagtagtagtggggttcagggtggaggaagggacttggggcgctctcctgaccccaagcacttccacaggcaggttgagatcagagaatcagaagttctggaatccactgtgagacaagactgtctcatccttgagcatagagatgtattggatcctcctaattcctgccttgtgaccaagtccgatctggtcagcagcagcagaattctatgtctcgggtggctgatggttctacagcagtgccctctggactgtgtggcaagggtcagctagtctctgcagagtgctccagggaccgttccctgcagagtggtcagacagtggctctgttggtttcctgctcagcctttactatatcttgaacctgctgagggttctcaaaaaagatgagcagtggccttaggtgaccttctctggggcttttagggactcggcttttaaaatgatcgtgtggtgtgtttctattctatctctactagagacattcatctaagaactgttgctgtatttagtggtagtatggtcccatgttttcaccatgttcagagtttccacattctggattttgagaggaggaggttgctcatttagcatgtgtcactttgtttataacctgctcactaagcactgagctgctttctaagcacttgttgggaagagcatagactcctccactgtgtttggctctggaaacactgggtacttgaacctcttattaagggttgacaagcgtagctgatagctgccggcgcatctgcccaagctggaaggggagaaagggaagatgctcgtcctggaagacattatctggaaatccttccctgaggctgccaggtttgtggtactgtgtggtcaacaagagggctataggtcgcctcatcctgtgtaacttgatgaatgagaggtcatgccaaaattcagagtggtttgtcacatgctggatgttaaatatttgaaaagctgtgtatttcacaacactgaatttgaccagggtagaatctgggaagtgtttactgttctaatccaagtggctccttatctccctcccttgttttctgacttaagtaatttgtgtttaagggagaatgccaagcacaaaggaaggggttagttttctttccagtggagggcatggcttggcctaaactaaatcccatagaagtattcccatcggtggctcgccattgacctacacagaggaagattttgccgagtaccaagaaggcttaggaaacttgaaattggttttcccgatgcagttctctctcgtctttacaagaaccagccaggtagctcatgaaatgtaaggtgtggtttgaacattagaacggcaacatatatgcaaattatcaagaatcttaaagttcacatcttatctctacacgatatatttgtgtacctgtttgtgtatgttcctgcttgtgtgtatatatggaggtcagagtccaatgctggctatctttctcaatagttctctcgctgagcctggagctcattaattcagcgagataagccggccagtgagcaatgggctgctcttctctgtctccccagtgctaagattatgggcatgtaccacctcgctaggcatctctatgagtcctggggtctaaatacatggtggaaagcaagccccccaccaacggaaccagccactggtctctaagtccccatcttttaacacatctgcttccaccacctgccctcagcaggcgtgccgtggttgagctgctgttgtccttgatcctgttcttgtcccttgtcccttctctaaggggagtcagatgtgattagccctgcatggggggttctgtccagcaccgagccaggggatctgatatctgacacgacctctgtctttgggaaatgcattgagcatttagaagaaggacccagtcagtgtaccaaagagacttttctacctgaggaagtgcgtgcaaaaccaagctcagtctatctttctctctgtgtgtgtctgtctcatatctcccccatttctcttctccccccccccctctccaagatctctctaggtagcccaagctggtcctcatcatatgatcttcctgcctcagccttcccaggactaggactacagatgtctacccccatggctggcttgctctttctttctccatcctagagctaatgactcctttgccaccttacggtcctgtggcacaaaccatcgggtctggtgctgggttagaccttggttgaagtgtctgtgagactggtgctcttctcacacagcagtgttccatgaagggcctattggagctaagatggctgttctctggagtcagagttaaagggcagaggaggagacaaggcttctttttctcatctggacggtttgaggcaaggttgtccagactcactcttctaggctctcccatcctgcatcttcttctcctgattggtattctcagtggtcttagcccttctgttgagaccccactaaacactacctagcactagtgacacagaaggctcccacccctctgagtgaatattactgggctctccactcccacagcgcacacagccccatgtctctctggccttcaaatctttgagtcctttattgatttaaagttgtttgagataaggccagtatttgtcagctcagtgtcaagcccccacatacatgtgagcctagctacctagctgtgagcctgggccagagtccagcttttaggcaaccaactgacttgtgcctgggttgttcctacaaggtccgtcctcaagtcagctgagagggacttttgatactttctatggaaagggcttcctgttgtggagccagaactagagcccctagtcccagggcacagagctttcttatgcattcccactataaaacaagctgagttctccctgtagtggaatgttgaccttggtagactggtgtgagagtcctcctagtctgacacttgttagcctgtcgtgaaatcctacattaagatttgagactttgttttgttttgattctgagaaaggatttctcagctcaacctggccttgaacctgcgatcctcctgtcttatcttcccatgttctaggattagagaaggtgtgtttcaccacccccagcaaagtctataatagatttcatgtgatttctgtttttcccatagaacagtatgactagtgggaccaagatccaggcaggtcatcctatctggataaccactacagtgctatctaggtaggttctctgagatgtgcctgaagcaccttcatggccaggccaaagagtggaggaaaaacccagtgcccactgcctggggtggggtgggggttgctcttgtccttgcgcactctggccttggcctccactgtcctcctacttctccctcatagctctgtccatggtgtaacggaggccatggccctccccacatctgtaaagtcatttcccttaaatcatgtttgcctttcacaagagaagaaccgatgtaagaaagcttggcaaggcattgccaccaagactcaagctccggtaatttcttctgggctctttgtgattgtagagtttgtgaaatttaagtcaacacccttctctaatccccaagccgtgagaagccctcagagggtttgtttgccgagccgtctctgcatgcctgtgctgtggcacaccttggctctggtgttctgctcattagtaggtgtccagtttcggcaatcatcttggggttgagtgagtttaaaccgtgtgggttgcagtggagggaaaacattatttctagtcttctggtttcttttcttaccttcccttcccttccctctctctttgccacacccctaggagctaggtgaattatgtaatgttaggtgtgaccctggggttgggggtgggggggggggagaaaagggcctgtttctttctcattctccagcgcagccctagtagttccgaaggtgaccagggacgctgctacctgtggcctggcaagaactattgaattaactttttccttccttccttacctccttcattccttcccttattccttccttccttccttccttccttccttccttccttccttccttccttccttccttttctctttccttccttccttcctctctttctttctttgtcatgttcctccttacacattccaatacatctccaaattcccttctttgtatccaaacttcactctgcataaaagccaannnnnnnnnnnnnnnnnnnncacctgtagtccatgaaccatctccagccacagcccgttctctctcacctccaccttgtgcccagcagaggagggtcgggaagagggaggtcgatctatgtgtcatttaagggtgtggaatttcattttctccatgggtacccagctccattaggcaagctgttaatactgaaaaggttctagattcttccataagagctaagtcgataataataaatatcccctgcagttttaattcccccacccccacccccgcaactttctcccatgcatttaatcctcaaggttgaccttcccaagaagatcagtaatgcatgtggcactcggtaaggggtgtcctcctctcagctccagggaaacccctggggtagcctgaggcagggggattctgagctggcttctggtattgaaggagctgcccttgtacctcagtgtacacaccactttctctgtgtatcaggactgggacagtagggaccaaggagcccagggcatctgagcacagtgacagcaaagaccatgagtgtgaaccagtacccaccacacttcaccaagttgaaaggcaagactggtcctttgggaggaagctggcacatggcttttcagtttcttaagagctgtctactggcttctgcggaggactttctcacccaacacggctggttcctcttcttcctttctacctctgctttactaacatcacgtgagagacaaatagcagtgtgtctcagaggggaagaggtgacaccggtcaggtgttgctttgcatgaagtccccccttctgcctgttcagccacctgtttaaactgttttcaaaaagttaatgtgttcagactgcatgatcctttatgctgaaaacactcaggtaaaattaaaatacccaggagtctcctaaacctgagaaacgaagggcaaggccacaggaaacaagggaaatatacagaaattgatcccctttggatatactagcaatgagcaatatagaagtggaattttttttttaaattatgtgcctaataacaccagaaataagtttaacaaaagatgggtaacaggtatgcaaaaatattcaaaacattcctgagggaaattaagaaagaaccaaacatagaaatagtctatgctttgggaattgaaggttcagtattactaacccagcagttctcccagtgcatttcttggtagaaacttacatgctgctcttaaaattctcatggaaatagaaaggactcagaagaggcaaacccgtgtggaaagagaacaaagtatcatgtttgctgatttcaagggtaggatactaaagatccacagtaacagacagtgtggcagtggggacaggactggttatatgggttagcaggtcagaggtgaactatgtttgcgttcatcagtttcctcgtggtgccacaaccatccaccatcaataagactaccatgctacaacccaaaatgtactctcggtgggcagtgtgcctagggagaagagccttacatatgtcttcccacccagtcaacgagctgagaatattaaaggctgtgagcaatgtaagtgtaacgttgtctttttgccaagagactccgtggtcgagagaattagacatgagaagggggggggagcataaacgtgaagagaattccttttgtccgtggaggaagccacttggactgcatgctcggacaagtctgctccctcgacctctggtttcatgatgggcttccctctgccttgctcttacttgatcccatacgttcccatgtggtgtgctttcaccgtcatttcattccagattttgtttttacttcctccctgatttcttcaggggcccaatccttattcagtagtgtattgtccgatccccacgagtgtgtgtatgttccaggacttctgctgctgttggttggtggtcacctttccttgggatcaggtgggatgcaagcagcgacctcatccttcctgcgtttgtagggctcgctttgcgtcctcacagtctgttttagagaaagctgcacgtgctgctggggataccctttctgaagcatctagaggaatgttctgtgggcatctgttacgtccttgtgaccgatggtgccattccaatgtttctaactcttgtgggatgacccgtcagtttgtgagaccggtacattgaagtctcccagtgctgttgtcccggctccatctgcccttgttctatgaaattggtcacgtctatgttgcagtggtgtgtatttagaattgtaacggcctcttgatggcttgctcccctcgttggtatcagctactctgcggctttcctcactagcttggctttgataaccactctagacattagaacagcaaaacctgctcattttctcgctcggttcctttgcttaaaatatctcctccgagtcttcaccctgacgtaggttgtgactgtctcttgtgatgcagtgagctcccgggagacaacaaatggatgattgctgggttggtttttctgtttttgttttgttgttgttgttgttgttgttgtttgttttttaatccaatctagtagtttgtgtctttttgttgggggatgagaccgttaataatcagagctattattgacgctgtttatcaattcctgccgttctgttgactttgcagtgtttggctttcccctccttcctctcttgctattattctagtgtggtttattatttcctttggcctcatgggtggatttgttttctcctcagtctgaaggattcttcaagtatcttctatacagctggtttagtcgtcccaaattccttgagcctatttttatcatggaaagtttttatttttccttcaattataaccgagagctttgctggtcagagtagcctggcttggcagctactgtccttctgacctggaaattcatatgtcccagccttcctggcttttaaagctccagttgaataatgaattatggccctgcttttatatatgatttgctgctttcaatgtgcttcctgcagcctgtagcgttagcaccataactatgctatgtggagggaaggttcttttctggtcttgtacgtctgtcatctctttgtctcactctgagaacttggctgttataattcttataagaatattatctatttttctctgttctagtagatgtatacagagagataatcagcgcctactctccgtaggtctgatggtggtacacatgtctgtaactctaactgtgtcttcgtgccattttagctgtctccttctttgatagcctcagtccttctaccttgtcttccagctcgggtgctctgcctgttccctgggaatcccaggagcctgccagccctttcccaccacctcactctcttttggtcctgcagatggccaggcggaggtgagaggtgacgagaggctccacggtgaggagctcgcattacttggagtttcgactctctccttgacagctttgttgttttcttcaaggcagtttctctccatgtcgccctggctgctctggaactcactctacagagcaggttgtccttgaactaactgaaatctgcctgcctgggctttctgagtcctggggttaaaggcctgtgccgccatgtcaggccatgcatggacagagcttccagccagcctgtggttctcagcctgcttccacaaagggctctgtcccagctcgctgagcctgttacagtccttgcaggctaaatgtttactgagatactgccgctgcttcctctcgctgagtgtcagtggtgaggttgctagtcagccatcttacccagaagtccctaggcatcagctcatatttaacaaggaaactgacagctgaagatgtgacctgttcagtcgaggctgcacagcaggctgcacctctcaagtcttcccctagttgttttcttctgtcgcacattgtttcagccagcggctgccacctgagtgtgggtactctcgagtgtgcaaagctactgtaggtacagaacagtcacggggccatgaaacaaacttccagtccttaggaaaacccattgccaatttaaaatccctgtgatttcagatgaacacagaatcctaagtgtgagtatgtccctttgaaatcagccagctccgtttcaagcagagctaaaactcctggctaagggcttgtctagctccatggttattctgtcttagaaggctcactcgtgccttgcatgcatgaggcctatgggcagtcccttcctggtcccagtcactctcgggagctggcatttatttttgcacgttgctaaatagaaagttccttttgggcttccatcaggactggcttccctgtgacttgctctctcactccgggtatgctcatcagaatggtgttcagtatgtctaattatgtgccagtcactcgaggttcatagtacaggagtcaggagctcagcagtttcccagacttacctctgctgtgctctgtcagtgtgcctcatattgcaggtcttagtttgttcatctataaaatggaaataaactatctaccgaagccacccagcacaccagtaggacgcccaggctgctgcttgttggcacggaacatggatctttccctgggccatctttgctattaatatccctggtccttggcctttaacctttgttatcttttcctaccacacccctttcctgtcagatttttacgtggggtgtacatcttccttatagagactttccattccattcttgacttcccatatgtcattggcagggtttgcgtggtccttaccccaatcccttttctttccttttcacagaaggtattgtgcaaagacaaaattggcggcaatttctgagttttaagtgtttctagttttagctcgctctctctctctctctctctctctctctctctctctctctctctctctccttgaatctattcattgaaaggcttctcctagccaggtacaatagtgcacacctaatctcagaacatgagatcctgaggcaggaggatttctatgagttctatgccattctaaaccacagagtgagtctctgtcttgaaaacagagaggagatggtgtgaagaagaggactgagaagagaggaagggagagtgagaagcagggaggaaggttctagaaggaggggtcctagggcaggcactgggcacaggggctttggagctcggacattggaattagattacctagttcagggtcttagcaggccccacctccgagtctccatttgtccaccccttaagaagagataaaatttattatttgtgtgtgcctgcacgtgagcctgtgcatttgtgtgcacatttttgtgtaagtgcccacagaatccagaagacagcatcagacccccctagagccaacatcacaggatgccaggaacagaacttctgtcttttgaagaacaacaagtgttctttagttaaaactcttagctgcagccgcctccccctcctgggtaccatctctttcatgcgttgcttctgagaaccaagccacagaagtcacagtgacagttattcttccccaaacccattccactggggctatgtgaaatgggaaaccctgttacagtgatctggggcagacagactgttctcccaccaagtccctacccccaccccggaattcccagcttcttttattgtagtttaaaattattgttatagagcagtgcaagaacggtaagacctggcacaagaaaacaaagactctgttcgccgagtggccctgtgaactggcatttcgttctgcttgagtttatgtttcttactcaaactcaaattgtcgagagtctagcttgctcttctccaacataagaatcagctaccgacctctcccgccaagggcctgtgggggccgcctgtgggaagagcagaacataaacaccacccttgggattacccactggccgtttttttgtgatgactgtgatgcagatgagggagaagagccccagacagcaacgtcaggagaggcaacatgtagattctgacccaacctaggactattttctcggtttgaagtgggaaaagatctgatgaactgctgcttggctcactgatctagaggaagccttagggaatcaatcacagagctgtagacaaagctggcggggggcggggtagcttctgcttcttctctcctgggaggacacaagtgtctaggatgtagtggccatggccgattacacaatgcacccggtggcctcacaacccatccagctctcgaccctggcactcgctgggcaagggtggaaggagttgccaatccaggtcattgtttgctcaaaccagagttcggccaaagctgccaggcagtggggattttaattcccagaaatccaacttggagacaagaggcattagggggcagggggagggggagggatggttacagatgaaaacatctagtaaagatgttcagaaagactgctcgctatagcaatggaatccgtctgtccttctagatgtccctaactccgtgggttaggtcacaccgaataaccctgcaaccacttaaaacgataagctcaaataaaagtgtgctctccatgtatctgcacttggtttccttttggccagaagaatcttctgcctcagcaggggcctcttatgtcactcagggatgagcctctccgtgtaccttgtttaagcagcaacatggcttagccaatacagcacagagcgtcccactgcctggttgaaaagaatacatctttaaggtccccgggattggaggaggccagccctcactcatggggcctttgcagagataagccaatccgagaggcagtttgcccttgactgtttgtccctacgcctgtcccttgtggcattctcaagcacttgtgtctggcctgggccaccggcctgcctctcgtacctgcctgcttaaggcagcatctgaattatttttgaagcaaacaagcaagagttgttgaatgttcagaatgccggtgacggtgcgtctggttaatatgcgaggtctccttatcgctttccgctcagggttggacatttgcaaccttaccatctaaagggagcaaacattcggagtgaataaactgaatggtagtcgctctgtgttcccttcatttatttgtttgcttttgttttgaggcagagtttcactatataacccttagtggtctggaacttgctttgtagaccagactggcttcaaactgacaagagatttccctgctctgcctcctgagtgctgggattaaatgcatgtgccaccaccccaaccaccagcatattctatattttattaatgaatatgagaacatttcttgggctcagaattactcactattggaagttgagagaagggccatttggtccaacatatattttctctgaaggacatattggtttattacagaaatgtatttccagtccccctagaactgaagctaacaaaatggataaccagtgtaggccctcctgctccagtcatgatgtgtgaagtcacacaggctggcctcttcatgagctttgtgtgaatagctatactggaatatcattgctgctcacaaatacgtcatgacacccactgtagatgaggcttgaagtgggtctcagagtcaccatggcccaggttgaccacacagtcactgtgactgaaagacttttggagggagacaggaaagccattatgatcagtggtgccctctcatgctaggcacacaatgacaactttgcctcccaggtccctgaaggccactgtggcagaggattcagagccagaagatcttgggctcaccagggtccctctaccctctcactggtgtctacctggtgttcatccccgggacccaaggattcacggatgaacctgtcagtcttacagtcagacagaaggtctgcttgtttgtttctgtaatggtttgctcttcattctgttttgtgtgtgtgtnnnnnnnnnnnnnnnnnnnnttgtttgtttggtttttttgtttttttgtttttgaaaaattagtttgttttattgtctctgattcctcccctggccaatgttgtggttagccccagtgtcccagagaggccctttcagtcagtttatggaaactgagtccttccttaaaatggttcctgtagacgggctggagtggagctcagtactggaggcctgtgcttagtgtggacaggggcctgggcttagctctgaggacggggggggggggggtagctcaatgggacagcaacctgtccagcatgcctgaacaccgggggtctgataccccagaatgacaaagaaaaaaatgcatgctagagaaaatttcagtgcctccttggcacctaatcggggctgccacctggtcacctcagcacagggctggcagtcctgagtgtcctgttggcaccttgcccccattcactcttcagttaaatactccttgctaggagtacagtgctgttgagggctggggacgtgagtcgagccagctagacgaaggctcctgctgaagacaagatggaaggcagggctgagagccagggagtgtgctgtggtctccctgtgggtcttcctggcacatggatgggcttgctccatccagtcagtctcttcctgcaagccacgggccgtgtgtcatgagcgtcccgctagattgctaaagctgtgcttgggaattagaaacaggacacaaactgaggactaagcagtaaacgggaaagccggaaaggatgctgcctggggttctctgagacccacagcaatgctctccttactggcagattgcatttcccctcccactcctgaccataggtcctttcatttcctgtatccttttcactaaattgaaggattaatgtacatgttatgcacttaaacaaaatgcatagatattcaagcagtttctccatcttactagatagattcttagcattcacattaagaatggctaaaggggccgggcagtggtggctcacgcctttaatcccagcacttgggaggtacaggcaggcagatttctgagttcaaggccaggctggtctacaaagtgagttccaggacagccaaggctacatagataaaccctgtctcgaaaaagcaaaacaaacaaacaaacaaaacaaaaaacaaaacaaaacaaaaaaatgcccaatggagaaaagcgaacaattttctccctacagaccttaccaagtatcttgcagttaaccatttcagccactaggtggcgagagtagttagcaaggcaagtgggtctttgtgactcatccaggcaggaagaggagactggagacctaaaatagtttaactgagcgaggtgaccaaacgggtgccgttctagaaggatacactctgaagcttctggtttccagtattggcaaatatttcctttcatatacaaaattctaaagttagacaggaagaaaaataagagtaggactagctctcaaaaagcagagccgtagaagcttgccctgtctggtcctacttttgtctgtttgaaacgaagacgctgaaataatttctgagctcataagcagactacagtgtctgcagctgcgctctaaaccccacccggtggggacagagctgtttggagctctatgaaacaggccgagtttgtttgtttttattttaaatagaagtaaaccgcgctcccaggatagagagcccagctaccgtgctactctgaccatcttgaaaactgacaagaaagaatttgtcaagtgtttggtccgattgaggtctcactgttttcttctgggtgattcctgttcggtaggaacgggagcagcgctttcctatcaaactcacgataggaacccggggagagggcgggagatacatttgtaatgacttcacagaatttcccttcctctgtgaatacctgtcccaggcgtgggtcctcagattctccactggctaatgacattttagtgtctatggaaatcattaacttccctgagagactcagcctcattcctttgataactgaagctgcctatatcgcagcgatgcattcctccgtactccgtactctttggtagtcaccagttaatcagatttccttctgctgatactttctttaataagaggtatttggtgatgacggaggggcagttctagcaaacaaagggtttaaacccagccccaggggctctggttacggcagcccacacccgatgcagagcctgactgaatgctatcgcttttctagattagatagaagaattagggaaacatttttttaggatacctatggtctggttttggtgacagttcatacagtgggaactagaaaatgttgcgctggcctaatactgataacagaaagtattttagaaggcagcactctatttacagttttagtagactatcttttatttatttactgttcatatcataaatgtaaacaacgtgtcaccccacaagcaccctgacgcgccctctccccccacttcatgtacctttttaaaagatttgtttatttatgttgtgtgtatgagtgttttgcctgcatgtatgactgtgctctacatgtatgtatggtccctgcagaggtcagaatagggtgtgggattccctggaaatggagtggttacagatgcttgtgagtcaccttgtgggttctgggatatgatcccaagccccctgcagtagctacaagggctgctaagcaccagccgtccctttagtgcctcttctggctctgttgctcttgtgatccaccaagccaggttctttctgtgggatccttagtgtgacacaatgctctccttcatcctcgcacgtgtctctgtcatggcccaggctgtggacattgccattacccatgagtatgggggataagggctgggcggagccattgctgttgctactgagaccttcagcggtacacgtcatttgcaaccagaatatgaaggagggggacggtgacctactttccaaacttgcaagatcatgcttgaatctatgtgacccttagacattcttgacctttccaaattttttatctaaattctgcccgatttcagagctgggacttgatgttttatgatagcgattcttcaaattgttcctattcaataggttttttttttaaatggcaatcagtagtggtgatatagtcctgaacgatacagaattaagcaataaccagtgagctctgtctgtggggccaccggagaggctcgggtggtgtggccaagcctggattctatccacactgccacacactcccccccccccctaatttttaaaggtgtctattaagaaagaaaaatgggagagatggctgtttgaaccctgcaccttaaaagaatgctgtctatctagtatgctttggtcatatggaagtggttatctctgaaagtccactgagaaccttagtccaaaacaatagtttagtctgtcttgttttctcacattcttttgaaattccttatttcccaacaaggggggaagtaggtgtcacttaggcgaccactttctgagactccccgaacagcacgcagtcacctctcctgtcctcttaggctcctgggttggagggtgagcatcgcacagctagtgaaagctttgcctaattctgtccatcagaaggcgggaaggccatctgcgtgcggggaccacgcacttcagggcatgcgtgctgaaactgtaactacacttccgagaaacggcttttcagatgtcagcagaatccctttgctttgcccactccagaattagatacttctgttgggtgtttatcttcaaggtcaagatcttgtcttgtggagtgtttttgagacaagagtctcactcactatgtagcctggctggccaggaactcatctcggtctctagctcggagatgctggaattaaaggtctgtgccaccccactttctctcccccttttattaatgagcacacaaagacaagataatgcctctggcctcctggagtttccggtttctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggttaaagacagggcagcagggagtttcctctcatagatgtagatgtggatgcggatgtagatgtagatgcggatgaagatgtagatgtagatgcagatgcaggtgtagatattgatgttgggaactaaactgaggccctctagaagagcaacaagtgctcttaatccctgagccatctctccagcccttgaagcatcagaaacattggtgaaggcaagcaagaaagataagagaaattaaactatttccaacaggaaagttaccataaaatagctgtattgtatttccagtccataagtaatcatagacattgtaagttccattcctgatcccaggagcatactgaatggctctttagctggccataccgtcttctgaaaagcttgcttgctcttgcctaatgcagttggagctggtagccctgagtgtgccttttaggactgcccttccttttaagagtatgccttccttcttgtctgcccatctgcaaaagtccagtgttcctccaggttctgctattgtgtagcgttctaaagggcgaggagatggagatccagccttcaagtggacctcggtccttctctgggagagaataaggtggcaggccctgacatagaagggggtacataagaggggagagacttccaggctgctgaatgatgagataaaacctgtaacattggggaagcggaaacctttgtgacttccttctctttgtctcgctggatctgtttccccaacacacccatggggatgcctgcttagctgcagtcacctccaggccctaggggctgggagccacatatgtgagattcaccttcttcccctccctcccttgctcctcaaatagataaggaaggatagaactggtcaaagccttttggcatttggattttgcagttaccagggaaagaggccaggaggccatcagcttcagctcagaactccagacttacgctcatccggccacctcatattacccgttacattgtgttcaaatgaattgtgaaaataagttatcgccgctgtgcggggtgcagtttacggacccatctgtctctgcctctcataaatttcccttccagatgaccacagcacggcagaagtttctgtctgtgctggtaagcggcaggcaactgttgtcactggctgacctctggttagaagtccgtgggaaccgcatcgcaggcttcattgatggggtggaatagttagttctgcggcgaggtctgtctcagggttagagggaagtgcttgcggatatttgtttcagtccgtgcttttggtattttgaccaagttggcactgttttatctcatccaaacagagatacatgacaaaggacaactgctgttggctgactccggttctgtggatgcattcaaagaagcggtgttgcttctatacatggtcaggagttagaactgctataaactgcttccaggtagatgagattaaaaataataaaaagatgagtaatttttaattaccttgcttgcaaaatagttggatgttactgaagtactcaagaatgcagactcttaaagtatcttaaaaatgtatcattcaagcaatagatttctttcaaaagataaattcccagttggtccttaatacccccatgctggcagggcatggagcagtgttataagacgtggatgtagcgtgagtgaagtcccggtttcatccaacatcacacacgagcgaaagggagggttatatcatcaaactgtactggaatcggtgccgagtgactgctgtgcactgtgtagtgagcctctgttcctctgagcagtttggctctcatggtttggtgtggtgagagatgagtggtgcttaaagcatcagtttaaagctgagagaaacagcctgaggtggcatctgagagacctcgctgccagctctggagagactgagccccaggcagtgagttgtctttgttggccttgggctttgctgtctcacaatcttctttgtcctttctttatgttctgtgtatggggtttgggcctggcctacacaggaaagcatagatatgacctggtgctctgagagaaaactgtggaacaggtaggatgagccttggaggcattcagctggcacctagcataggctcacacaattcctgctgaagactggtatttacaagccgtattcaaagcctccagtgagtctaaagcagctcttggaggtccaaggtaaaggattggcttatctctaagaaaccggttaacttgatccttacttagccatcctcctgccttggtagactgacagtgcaattcaaggtaaagcgaaccgtaaaggtagcatgcacgggaagtaagccagcgaccaacgttaaatgctcccaggtcagtgttgcacaagtacacacccttcttacataattctatgcttgagtggagggtttccagactggcttaacgatcccacccttctctgaggaagaacgcggcagacaatggaaaacccttgaatggtttgcctcccactttgcactgttgatgggtaggtagcgtgtggctctgatagaacacactgaccgaaagtaacttgaggagaaagggggttgtttcagtttataggtcacagccatcactcagggaagccatggcaagaactccaagtgagagatcacagagggagggactggagcccttggaagggcacctcctttttatttgttggtttgtttgttggtttgttttttgagacagggtttctctgtgtagccctggctgtcctggaactcaactcactctctagaccaggctgggcttgaactccaaaatccgcctgcctctgcctcccaagtgctgggattatggcatgtgccaccactgcccgtttttcttattgtcttgcttcccttcagttgcctttcatatttagtccaaacccacctacctagagatggcaccatccacagcgggcaaaacccatctacatcaattagccatcaagaaaatggcctgtagaaatgcccacaggtcagtctgatgagccaattcctctcttgagatcccctcagcccccatgtattatgttgacgataaaactaaccaggacatgtaggagcagccattgagatttacaaaacagaaaggtcacacaagagtgtaacttagtccacatggagactgaagagaaggcattggcttgggtgaatcccttgaggaatcagtcatctggactgtaagcatgcccgttctgctagtaaaggcttcagaaagacagaccaggggctcttgggagtcaagatcttaatatgttgctgcattgagtgtctacaaaatggtgtccactcacattggtagctcagtgtcagctatgtggagtaaagatacggtaaacacatctatttggtaattgtttatagattgaatgtttcatgcaaggactttaagaactgtgaaaacccatttggaatatgggcaaaaccaaaccaaaccaaaccaccaccaccagactaaataacaatctctgacatcagaatgtaaggtatgacataaggttggcaggtaccaagtgggcttaataatcagacgggaggttaaggtctctgcattagttcagaatagggctgccttcatttgaaactaatagcaccaagaagagaatggaaagcttgtgtagagaagggcttggcgcgctccccgggagacttgagaagccccaattgtaaccagtagtggtgatttgggagtcagctcccatcgggaggttggggagatcagactggattgtttaagtgaaggttttaggtcaacatacaaagtaatgaatgccattgtggcctcttcacgtactctgtcctcatgcattcccctccctcactccctcctccacgccctcttccctcagattgcaatctagtttaccagaggactcggggctggggatgcacgctaactttcaccatttaaagtgggagctctacttgagaacattgcactggccgggagctgggtagagaggccgggttttgggggttcagcgtagacttatggactggggatttggatttattttccaggaatctgcttttggaaagttcccaatttgagttttctatgtactggagtctggaaagcaccgtggttgattcactgggctctgttggctctcagcagaaatggagaggccagcaggggagtctcgcagggagggtggctttgacctgaccgccccctccagatttttacacacctgctacctaccacatgcagcacgaaagcttccactctgcccatcaccgacagctcagggagccctgtcactcttgccagagggagtctctgaaagatgaccagaggccctgagcggatctggacaggccatgcgtttatggtgtacttctacaaggaggatttgggggtgttgttgttgttgttttgttgttttgttctgtttcatgtctcgtatgcatttagcaggaagatattgaaatcaaacaaaaatagacacctataattgtgtttataagttaaaacataaaatatatttgtatgcttcatgacctcttaagatcaactttccctgtcttaaagcattcattttttgtagcatttgtcataaaatttagacttctccagacacccgtgatacagctataaaaaggatgtgagtagaataaaataacttaatgtcgagcccgagacacacactcctgatgcctgcagccgcacatgttaattttggatatttaagtgtaacctttattgacagttctgtggaaccgcgtagagggtgactctgagtatgagggcagagctgagaggcactgaacatagacccggcctgcagccctggctgatcggcttacttggcactgtggccttaagcatatcaaccaactcctttgtttcttggggttaaatgttaaaaatgtagattttaacgcctgtagttggtaggtgttcatctttgctcattaaccatcttcccatttgcctagagttagaaaaacccaaggtaggaaaaaaaatcctcaaagacttccttccaaacaggtgtgcctcttctttgttggcaaatacaggacatgcaggaatgtgtgtgtcttggtggtttgctacaaatggactggggagaccctaatcatttgaaccacattgccctcttaagttccaccttccaccctggagtctttctaataattagtaaaatcgaacttttagtatagactcttaccacaccggagcctgtcattcttccaagtagacattttgaaaaccttccttaaatataagccaacagccttgaacgtggtctatccccaagccccgtgcaactacagagtgacccactgggagtgagaattcagaattattttcctgttctgtttttaatgaccaggcatctaccataaaaataacttaatagcttcagtacttacagctgagtctctgtttcacaggtaggggaaatgggtactgaggtttgccaagttcatatcagtcaggatgtagctaaataggccttgaccccagtagtcagtagctggaagaggattttgaccacagcactgtataggtagagatgagcatggagaaaagctgtcaggaaaaaaaaaatggcgaagtctggtgaggagaaggctgccaacaggtatggactacagtcagatcataggttgcttatttatgtttccattctccacccaaccaccaccaccaccaactcacagcactaacagatctgctagagaatggagttctgccctggtaggccagcctcctatatgaattgtcaacctggagtctcaccaaggtttcagcccaccctgcaactctcacctgctacgtctacatctcccctctccagatagccaggaacaaaagggctgtggacaaattaaacacaggctgttttagttctgtttctgtaagcacccatgcctgctgaatgcagacacctgatgctgactatgtatatttcaaacacacacatatgggagtccagcaacaccttccactagtgcaggcacggttccggctctctgcggatggtcgttctgtgctatcacaccagacatttacagctgtgtcttactgcactgctcactgctgtgagcaaacctgggtggaaataccgtgctcagcaaactccattgctcaaaagccccggttcatgctctgcctgccatttaatgaacacatgagtgaagagtcaaggaaatgtccttctgcacgcacacagacaacagccttgccccttgaatgctaaaacaatgtcacaaagcattcagagcccacaggactgagttgtgtgcgcacattcgtgtattcagcccgacttgccaatcccccccgcattagtgcattttaatttcagctctgttcaagcagacacaacatgaaagggggaccgagcagagccgagatatcaggtttactttctcacttttatgaagcggcttctttggtttgaggcagccatgcaaatgaatccaacaactctgtctacagcacggaaaggcagtctggaggatgcgggacacagttaacgtcaaaccagttatcaagccttgggagggacttcaggctttcgatttgatttctatggccttacacacacagcacacaatgatagcagttacactgcaagtactttattgaaggcaccactggaatggactgggtgagccccgtagagtgttagctaagcactatgaggatgttaccggagcttcagggtcaacgccggcctgtggtggtggtgtttgaccaccagtccccaggacaccgattaaagagagacactataataagacaacagaaccaggagatgtatttgatgtggccacaatgggaagtgaaacaggtaaagggtccatgtgttcaggggtactgacacggaatttaggtttagaaagagggccacgggatgcactggcagtcctggtggagggtgtggtcctggctattggctgcctgtcttagctatggtttgttttgtaaggtgggctcataagtggacagaactgtttggaatctactgtagaatttcctgtagacttgcatcatttcccagcacaggattcttgaggcaattttactgatttggtgtctagtgttttattgtctaatgacataggtgcctctctatgaaatatcctctctcctactggtatggttatagggaaacaaccagatgcaggtaacacatctctggtaattctagaagacatcccttcctgtagaaactgtccctttggagggcagcgcctgtctgtcactacatttgagttagaagaacactgcacaccataccacactgtccacgggtgtaccttctagctgaacacactaagatatgaagttatcagaggagaaaacggaaaattaaatgcagtatgatcatcaagtcttgatgttagaaggggcctggcacctgcttagtcaactggttaccagccattactagtcacgaggagctacctggaagcactgaacataaaggcatcttccagtgtcctctgcggggttgaaccctgctagagaggtctgatctggtgacctgcactcttgaaaatgctcccaaggttctccaacactcaggcaggtcatctagtccagcctctctccatgagagaaaataggccttaggtatggttatccagccttcgtgttggaaggaactcagtgcagaacaaagaggagggactcactgttgacagagtgttggcacgatacggagccctccgtctgttataacaaaagagaccttgattgctctctgttctgcccgttggtctcagcatggctcagtaacacagacagaatctccttgcagcatgaactctttccagtgatttaagacggttccccttcagtgttcccttttgtctaatggtctgtgcctttattcagttcagatggtcaacccctaaaatagaatccactgaagcttgccattgccgtgctgttccttgtaagccatagcttctctttgccctcccctttgccttcctctgtatgaactcaagtctgtcagtgtcaaacgtggtactcagaatggatgctccctaacaattgctctgaccagcagaatccaacagggacaacagggattgtctgtgacgtgcttctctttagacatctccaagagttctgtaaggccaaactagagatgacagaatgttccgtggcaggtcagaaatgaaagggtttgcgtggttagtctgaccagatgtgagcttagtgcttggtgggtgtttcctgtcagaatgaagagagatagcaggcttatggcattataagtcaataaacattctatagaatattcagataagagatcacaatgtgtgtgtgtgtgtgtgagtatgtgtgcaaatgtgcgcatgtgtgctttcacatgtgtacgtgtggtggtggtgtctctaagatgagcagacaattgctgtgtttatggtccccataggttcagtcagctctgattgtcacactaatctagggaggcaggaggaggctgccttcctcctctttccattgtgatcaacacaactactaccatctaagcaggttatagctccttcccacaactgaagggaaagatgagtatgccttctttatttggggttggcttcccagccttgcctgtctgttataacagctgtgagctattgaatgctcagctctaaacagaacatcacatggaagactcagggaacatcacagaagatggggcagaaacatttctgtcataagagggagaggaagttggcagcattgcagaattttgtctcctgggcaatatctagccattgcatgcttgaaccctgagaagttctggttacctgcacaattttggttccatcaacatcttgtcatggagcagggaatagtgcacagtgcccttccccaccatgaggcagctcatggttggtgaggaagagctcccccccccccagtggtatagccattggtaaattgaccatatccctgtaaataatccctgactggagctgtggcaaacaaccctaaaagcagcacgaaaggcagctagctgagaagaacaaagaggatcaatgggagttggggaagtggatatgatcaagatatagtatgtgcattatgtatatgtcataaccaagcccactgcatatcattagctaatctaaccgatgtagacttcacagaggggaaaatgggcacaagaacttgcacgttcctagggaaggactgtggggtgttgagagctggttgtgaggtggactacccaagtgactagtcagtaagcagttctatatcggagatgatagcaagtggggtttttttttgggggggggtcgttaactttctctgagctgatagggctcctctaatcctctgggttggctaacaggatttcattgtagacagaagttagcaagcagtgggacataggtttaagataaagctgcaacaataggcaataaagtggtacaggactgattgcaccccaagctgcagctctgttgacagtggtattcagcataaaagcctcttggaactcgggactccagtgtgacttctctgagcgttgcatcttctgttgacagagatgataagatagctctgagtttctgggattgtagataggatcagcctcctgaccagctctagctctatgtggggaccattgcgatttgcgagaatcactgaccaggaggctggggatactcattcagtactacggtatcatgctacatagcctcgaggctctacaggcatgacttcataagaaggggtgctttgaacaccagctctggccatgtatgtgctgttggaacacaggaaggcatatgtgagcagatgaagtggatgttgcattcttgggagatagcctaagctcatggtcagtgtgctggtgagaggcgcacttgctgatagaacttggctgagctgaggaaatgaagttagagcaacccttctcttcttctgttcgggaagactttttaaaagcatcccataattgcttcacgttggcttcaaatggctgatgactgactccaatgagttccagcgcagccactccccttttctccttttctgcttaattatttcttggtgacatccaagagcaagtttgtctgtgtcgccatctcgtgcagcatacgtagtccagattctaaggttccagtcttcctgcagagcatgggacgtctgcaagatgtgtaggcctcctcattgaggacgtgactcggggagcatgtggaagattcactgctttcctggagtccaagcgagtagctggagacagagaatgtcggccagatgccatgcctcacagggccaattaatggagaaggctccagtggggtggaaccaggaagaagccaggatgctgggaggaggcagttcaactggggcatgatgctaatcgaacaatggaggaaaagcaagcacttccgtgaaccagccccacagtgtcccttcatggatggacaacctctctccatcatctgccatccgaagaggaagctggggccaagcacacacccttcctgtctgaccgaaggcggtcttgctcctggaggctatctctctgttgccccgcactgctgaggtgtttgggccaggttcatatgggtcatgataacctcagagaagggctgtttctgtgggtgccaatggtctctgtgaacagaatgtatcctcctctggatggcactgccaccttctcctcttccatcttccacacccaggctaaagtataggtggccaggagacagtaatttgaggttggtcttggggctaaatgtcatgctgaatgaaggagaaacgcccttgagttttattacgtaaggcagttttaccttactgtagaatcctttgaatttgaatgggtgccaccctgtttatgttaaataatcagagtcttaagcaattgtaaacaatgctatatacaaaaacatggctgaaatttgagaacgttatgataagtctaataaagcaaatatagaagaaaaatactaagtgatacatttatgcgacaaatccgggctactcaggctgctaaaagtggagaaaaggatggcagttgccagggagcaggggagacagaatcaggagttggtttcagcagtgtaagaggataacatccgagagctttgctgtatagtagagtcctcacaaatgctgtgttacacacttcagatttgccagagggagtggttcttaaacacaaacacacactaaaggtaatataacatttaagagagtggaagtggggaaaagacagagtaatgccttttaaagattatttatttgtttgtttgtttgtttgtttattttagaaatagggcttcgggtggctcagacttgcttaaactcataatgtggccaaggccggtttgaacccaatcctcctgcctccacctcccagtgctgggattacaggtgtgtgtcaccatattggcctgaagggagagcaatggtaagctgccttctctagtgtactactcctgagaaaatgttccttaacgtcggctctaattatgtcacttcgcaactccaaagctttttagaattctgtttcccacttgagttttggagccctctcagccctgcctgtctccaccgctgtgtcctggatttacgcaccattctggaggaggcaggtgtttgggtgcttggggttggtttggttttcatagcccagcggggttgtggggttgtcccaaccccttttgctccctagtgctcatttctacgtacctcaccctcagggctgcaaggcttttctcctcctcgtgcctcacattatccaagacaggagtgctctctcctccagatcagatctgaaccggatcctggagcagtggccagttctaccagcgcacttgtatcctggagaacagggagaccagctggtcatttgattgtctcccatagtgagctatatatacatggtaaggcctatgtgacaaatgtccaggaagattcaggccagacccccagttttcacagcctgcccagatcctggacagttcaatgaagaatcaccaagtatctagaactgttctctgtgttgttggttccctttatttatgtgcattggcgtttgttcctgtatatctatgtgagagtgtcagaacttggagttacgcacagtagtgtgagctaccgtatgagtgctgggatttgaacctgggtcctctggaagagcattcagtgcccttaatagctaaggcatctctccagttcctctgtggtttcttatgttgctttattagctcatacattgcaaagtcataacgaatgtaacgttctgggtcccccagacacctacctacgggctgggtactcatgaaagatcttctgcgttggtggcttagagaagtgctgcacagccttcctaatgctgtgccctttaaggctgttcctcgtgttgtggtgagccccaaccataacattactttcgttggcacttgataactctaattttgctaatgttgtgaatggtagtgtaaatatacgtgttttctggtgggcttaggtgaaagggtcgttcaaccccaaagggtttgtgacccacgggtcgagaactgctgacttagaagacgtggacatggaggaggaggggtggaggtgtcactgagctgtagaacacttgcctggcaggcataagtccatgggatgcatccccatggcactgggcgggatgtcccgtgagatgaagaccagtgactcccctaggaccctggagaagtcgtttgtgccgtcacgggtgcagccaaggcagatggccccaagtccagacctctgcctttgtgtgagatggaaaagcgatagaatctctctgtacacataaacatctaacaaatggtggggggcgtgtgtccaaacaaatccaactggcaggacacatggtgccgccgggaggaagcctctgtcttatctgtcgtaccttgaagggtaaatggagctgcaggctgggggttgccttcaaaggccagagggtgggtatgctgtaaaaaaaaaaaatggaggctggtgggagccatgatgcggttcttccacacagttggtcactctctccctagtgctaccctaaatggccatgacacataatccctttgcgattcttattattctacttgctatcacaagaccgtaacaattttagacagtcaagggagattaagggaggagttggtagaataggcttttcaaacctttgattacctcagaagacatatttgcttactttaccaggaagttggtttttggttttgttttctccgggtgccaagaggggattaatgagtagccgctggctttgccagctttcttttgatttcagtttatataattaagcagttcccagaatgacttgaggttcgctgccccacccccctccccaaccatgcatcaaaacacccttctcaaatgtgtcagaggtcagcagcaatccacactgaatggagggtggggaaggagcaagcctatcttgctttagaacatctctaatgtgtaaaagggtcagtggttgtgattgaggggtgcataggactgtggggggggagcagactcggaggaaggttgaaggtggaccaggacgagagtcaggagtactatgggagcacctgctttctctggactttctagcgatggaggcatgcagtgggtattcaagaatgcacgcactcaacatggatgtgctaagaacctactacgtgccagagctggccctagatggtgaagaaagaagggcacaaaacttggtcctcttgtgatgctcagaggaacagagccatcttcactgagaccctgccttgctcagccttaagctcagagtggttggctctgtttgcaagcgtgtggccttccaagggacggtctcctcgctttaggtgaggaagtctctcgacaggacgacagcaggactgactgactgttgaaggctttgtcactgcgtggatggctgatgtagacaggcaccactgactgaaatggtctttcccgatcccacagacgggaggctttctgtagcaggatgacccaccttcatctctttatgaagtaagaccttgtggagacaaacgttaggcctggcttcagttccacatgtaataacctcgcccctgccccagacacctcaggctttccacctatgcagtactactgataaaggttctcatgtcgcccaggctggcatccaactcacagtgtaggctagggtgacattgaacttctgatctttttgtctgcccctcctgatcgctccttgtgtaatactaagggtagagtccagagcgtcctacacatcaagcaagcattgcccactgagcaacatccccagagctatagcccttacttttaaagagttttttttttttttaaattctttttggagcctctaattcccttaaaaataaaataaaataaaataaaataaaataaaataaaataaaataaaataaaataaaaattagtccagaactacaaacagcccctgctttcctggaacatacagactgccttagttagggtttctatcattgtgttaaacaccatgaccagaagcgacctgagaggaaaaaggtttacttcagcttataatgccatctctgagggaagccagagcaggaactgaaggcaggaacctggaggcaggaactgaagcagaggccatggacggtgctgctcactggcttgctcctcatgtctggctcagcctgctttctcacagcacccaggactgctatctcagggatgatatacttcccagagtgagctggatcagagcctccctcccctatcatcaatgaaaaaaaaaaaaaagtaccacaggtttgcccacagactgatctgatgtgtgggagtggggggtgtattttctcaactgatgatgcccttctaaaatgtaagcgcttgtgcaagctgacagcaatctagccaacacataggtgctggggaaatcatagtcccaacctccctctccccagctgaatactacatcagggcatgcaacacaagacagattggaccttgttaggaaagccaagaccagcttcctcgaagaaaagacagccccactgacatttttgcaataaggagacgtgtagaagtcattgtggaagaaggaagggaggcagtctaagcagccagagcatgaactgagattctggggcagaaggaataagggacagccggaagggagatgactcagatcatgaggcctacggtatgctgaggtattttctgcctgtcctaagaggaacatgtgcctttaaaagagtgaaggaggtcttggcagatgacccagtgaggaaaaacccttgctatgcaaacatgagctcctgagtttgaatccttagcacctatgtaaaaatctggacatatctgcacttgcctgtaactctacgattggcaacagagaggggaagatcctgagaacgccttgggcaacttgtctaggtaaaagggtgagctcccagctcatcgagagaccgtctctagacggtaagatggagaatggtacgaggagactcttaatatccagcactggcctccacccatgtggacatagttacacacacacacacacacacacacacacctcagtaagaaggtgagaagaggagagtgggtggatgctatcagatttccatcccagcagaacccctctagctacagaataaccagaatcaggacaggaagctgaaatccgtgtcaaggcattcccaacaaagcagaaatctagacaagagagaaaaactgaatcacagaggtgggcgtggcaaaggtagaaaccaagagaagtgggcaggtatgagaaatgaaaaggtatgacagccaaaaccaacagggctgggtgagagggaggaaggagagggaggactagagatgactgctggggttctgacttgaaaactagttggaggtaaagacccccagacaggaaactccacccagcgggggccagcttgctgaggaagatgatggggtccattttgacactttgggtttgagtgcctgaaggcatctggagggagatcagaagcagacctgtgggtctggggcatagagaagaagtcttgaaggagggctaagtgtgtgtcatccatgcacagaaccatgggagctgtgggcatgcagaaataagcttacaccacaagggaggctcagcacttcatgggtgtagagaggagacatcgacaaagaggcagaagcacagattagagaaaacagacagggaaggggagagacccaggaggagagaaccagtttgaaaaccaagggaaagaaggtgatcagagagatagatgggagaaaggctggaaaagagagactgcagtaaaaacagctgttactactgccagcgacaacagtcctggctaatccttatggagtgccaattatgaactgggcattttttaaaaaaatgaacaacatgagggtttttgttgttttttaaaaatacgtttatttatatgagtacactgtagctatcttcagacacaccagaagagggcatcagattgcattacagatggttgtgaatcaccatgtggctgctgggaattgaactcagaacagtcagtgctcttaacttctgagccatctctgcagcccccaaacaggcattttagcatgcccattcaacataatctaggaattaggatgtagatggtttaggaagctcttgagtttgtactgcaaaaaaaaaaaagttgagtataatctataatgtaggccctgtatcctcatttttataggtcagacagttgagcacacagagaagtatttctttgtctgaggtcaggcagccagagagtgatacagttgtgatgggccctcccctttgcctctcttcagacgctgtcctcgatgccacgggactaactttaggaaagaaaacagcaacaggagtaggagatttttccctttagaaatgtagattctctaaattcaaagaaatcctccatttgggccacagctcaagatcagggttggtgactatgcaacaggtattgtggtccttatttctgatggaattttccagctggtagggtagtatgaactagcagcatgtgtttgggctatccttgggaaaggctgggccaatggcttctaaggcagaggttctcagagtgtgatcactggaccaacatcatcacccaggactttgttagagaggcagatattcaggttccaaagcagaaacagtgtggaccacaaggacccctgttcccatgggtctccaaatgattctgatgccaaaaaagtttggccttggaggaatcctttttttttcctttaaattaagttttactctacaaaataatagccttcaagaagacattttcatacacatatcattgtattttactaatattgaatcattgtttccctttgtctcatctcttgttagtctctttccttccccaaatggtccttatttcacttcacttgtgtacgcatacacacacacacacacacacacacacacacacacacacacacacagagttaaatctaaattctacatattagcaaaaacatttaacatttgtcttttccccaaaagggctgttttagttgtttttctgttgttacaattaaatttcccaaccaacagcaacttagggaaggaagaggctcatttggttttataacttcacattatagtctatcagagcaatgaattcacagaggcaggaggatgaagcagatcacagtgtctaccctcagaaagagagagagatgagtgtgtgtgtgtgtgtgtgtgtgtgtgtgtgtgtgtgtgtgtgtgtgtgtgtgtgtgcacgtgtacatatgtgcgtgtgtgtgtgtgtgtgtgtgcgcacacgcgtatatacgtgcgtgggggtgtgtgtggttgggtgcgtgtgtgcatggatagtctgagcactattggtcttgaggattcataaatgggaaggaatgcttattagcaatcagcaaggcagcaggaacttctgaggacaaattgatgccctggggggaatcaggggacaagggaggcttaaagtgagagacaaacgggagagatgttctaccttgggccccctgtgcatactactaacgctagcggttagtatgccaaggagacgatgccaaggagataatagtgaagtagatatgctttgtgaatgaagaactatttatggtttgttttactctctcttaggaggacgtaatgtcctctaggaagcttctttaggatatattttgatgttgagactgtatgtgggagctgattactttagctcagttggtagactgacccccaacatagcatacagcaggcatggcagcacccaactctaattccagcgcttggggatgggaggcaagaggatccaagttcaagatcattcttggcttcccagaaaattctaggccagcctgggctacaggagacatgcaattgagaacggtgaaaggggggaggggaatggggtggacacaatgccttctgtctctctggcctccctctgcattgctctcttactgtccccacggtccagctcttcctagactcctcctcagctccctagtccacagagcatccttgccttcatcttgctcagtgccctttgcatttcctccactctgcccatttcaaaactccacccttgactgtagaccaccagacaccagcctgtccctctccccttctctaattccctgaacaatatcccacatgcaatctgcttaggacgcaatgaaaagtgcaaagtggattcaggcttctttctcctcaagtcaccgaagatgcagataagggctctcctcagtggttctcagcctgagcatctcaaatctctctcacccaaaacattttcattatgattcataacaatagcaaaattacaggcatgtggtagcaacaaaaataatgttatggctgagggtcgccacaacatgaagatctgtgttagagagtcacagcattaggaaggttgagaattactgcccaagagggtacattgttcagaaccccaagggaatcagccctgacaaccatgactctttgttgcaggtttgtttgtttttgttataagatgccttatgggtcatttcacattaaaacattccaagattcccagagctatcctaacaaattgctacaagtttagtagcctcaaatagtgggacataatactgtcatagtgggaaaggccagacatctgagactagtgttagttacctaggccaaatcaagttgtcagtaccctaggccattgccctcagagacttttctttcttccaggatctagggcaggggttctcaatttgtgggtctagaccccctttgcgggtgaaaagaccatttcacagggatttcatatccggtatcctgcctatcagatatttacattatgattcataacagaagcaaaattacagctaggaagtagcaatgaaaataacttatgggggttactacagcatgataactgtgataaagggtcacagcattaggaaggttgaggaccactagcctgggagctttctgcatccttggtttgtggctgtgctgctcttatctgcttctgtgattattatctctttctccctgttccgatatccccctgcctcacttctcacctctcacgatgactggcttggtcatatctgcaaaatccttttgtatccagaaagcataagtccaacatatcatgggcaggacccggttttctttgagagaatcattattcattattcagtctaccccacatgtcatgacaccttgtgttttcagacttgtctagggacacatctcactgcatggttaaaatcaaaacctagctctcttttctgtccatctccaacttgtgttatagaaggaagatagaagtaaggtgtgtgtgtgtggaggggtgtggggcttagtagcccaggatggccttgaactcatgaggcaaaggatgacctcaaacttctgatccccctacctctacccaccccacaaagttgggacttcgggcttgcatgatacactcagtttatgtggtgctagaatctaacccagggcttcttggatgcttaggcaagccctgttgcaactgagctacatccccatccccaaaggcagagtttatatggcacttgataccctgcctcaggtgctcccaccttttgtttccctctggaccactccatcagctgtcacctgccatgaggctacctccctcccacccctggagtcccagtgacctgtctggatcaccagaggatagctggccccaagtaggacctgtactgatgtgggttaagtagcattttcttttctccttccaggaccgcctcttcttcgtcatggaatatgtaaatggtggagacctcatgttccagattcagcggtcccgaaaatttgatgagcctcgttctcggttctatgccgcagaggtcacatcggccctcatgtttctccaccagcatggagtgatctacaggtagtcttttctttttttcccttggctagacacagaagcaacgagttctccagacacttgtgcccagctggtttcccagcaactggccttagcttagctgtttgtttcaatttgcatacagaaagaagacttggtggtagggtggggagcatgaaggggtgtttatcactatgaatgttaatatttgaaaggccccaggagatttgacctgctgtttgtgtccgttttgatttaaagctcaagtatgacattttaaaggcttggctctgtgcgatcttaaggtcaccttcgttgctccgtctcctccaccctcttccgtggacatcagggcattctcttgactttttcctcctgtgccacgagcttcctccacttcctgatcgcttgacctttcctgagtttgtttggcttagttgtctccagtaagtagactctgggaaggacgagtcctgtagagggctagaggtttacacacaggggtgggggtggggagtggtaaatagacatgatccaacaggaagtgacttttttttttcagattgtccagccttttatttattgctagtagcccagtctctttccaactcacacacacaacacacacacacacacacacacacacacacacacacacacacacatgttttccagtaaaagaacaaaactcttctctctctctctctctctctctctctctctctctctctctctctctcctctctctctttccggtgaggtcaggaattccgggaggaagacgtaaatatttataattagcaacaaggatactaaagttcctgaaggtttttccaatgactgtccatttctttacttggtctttgcttccccgttttctaaaacttgggtggaagaggagctagcttggcttaggtcaaagttaggtgcacacctcaacgtgtctgacccgccccgggagtagcatcttgactctatattctttgaaaggttctggtgaagcccaccccaggcttccctcccttctgtaatccttcagcttcacaaagccttgggtggggaggggctggaaaggggggagtcagtgcttgtgactgactgtggacctgcggagcatactctaacccagcggttggttctcaaccctgatgccgcgacccttcaatgcagttcctcatgtggcggtgactcccaaccataaaatcatttccattgctgcttcataaatgagggcactctagccagcacaaacatgacaagcacgacaagctggcagggcttgcccttttcagttccctctgccttgctttaaaaaaaaaaaaaaaaaaaaccattaaattacattcctgaagctagccaccaaggcctattcccttatttggccacttcctcctcctgaggctgagtatcaaggtccagctatcaaagcattgaagtccaacaatccaaagccacctttggctcacctaattaacatgcccaatcaaaatcaaacacttcaccctaacaggtttccgcttgtacctttggaaaccgctatttgcctgggtctctctggggcaagtaaacctcccttgtgttgagaagttggtttgggtgtatcttgtgccaatcctagtcccttcaataactaattttgctgtgctgaatcctaatttaaatatttgctatgcaggatatctgatatgtgacccctacggaaagagttggtcaactcccaagggggtcgccacccacagcttgagaaccactactctcacctgcccggtggggatccgtttctgtgctgtgtgttgttgtctggccttggcacaacccctacaccttatttcccagactcttatccatgctatgtgctcagtgtctcaccatgctgtggtgaaggcaagcgaagtcgactactgaagtccaggttcttcccctaagatcatgtgctgatggacagaatatttgttctggaaactttagagttcgtgaggcttgcttagttagggccagccagagagaaaggcttccttctcagactctctaacctcagagaaggactacagcctcctctctagggctactggacccactcaaggtgaaaagcccttttgatgaaagcaaaggcaagtgtatctatacgatctgtgtgttcatgggggaagggaatggtacagacttgtaattccacttactcaggggtctgtcacaggagtttaggagtttaagagcagccttttagaaaccccatgcctttgtcacagatcgtgtcgtctcaatagtgcattgtattattgtctttgttgtgttgttttgtgttgtgttgtttggtgggcaggggagggagcgtacagaatgtggctccttgcgactgcaggccagtggtgcttcctctcccgccttcctcagagcggggttctgaaccatcgaggtaggtagctgtctccacaacatctgctttattagctcttgccttccggccctgccccccaaagccttaggtctagacacctgcctgggatggcaagggactggggaaaggacagatgcctgtacagagaagctggtgtcgagcgggctgcatcagcgaccccactgagagcatccagaacctgctagctggccttggtaggaagcatctccaggtgagcagtctcaggctgcagacatcctggaggagaaagttacagtggctaggtttgcgtacactggttagttatttgtgaacagcgactgtggacctgaggaaggctttgcccagttccttgctatggctgtgtccttgtcaacaatacacactcgggacttcttctatcccttagattcactcagggcatccttggctccccacaccttccttggctcattccaggggcctctggccatttctcttgtctggatgcatccatcagccagggtgggtctctgcagctctgtctctgtcactggtgaattcgttgtaatttgagactttcactgctgcttctaccactggtcatgtatacaaaatttagatcacctgtcctcaccctgtgggttgtgacccccatagaggtcgcagagcagatctttatagttagcaaattatagttatgaaatagcaatgaaataattttatgatggggggggtcaccaccacacaagaaactagattaaagggttgaagcattaggaaagttgaaaaccactgatttacacccctgccccttccccccagagcaatttacaagctagttagaattatagaagttaggtgtgtggaatgtcatctctacttcaaggctgtgtctcattagatgtcagtgacaagaactctcattccttgggatgtgccactctgttccgtggagacaagcatcaacattttactaacagaatcagagacttacttgcaataagtagcccaaagccattcttgatgaacaacaggggaagagtgtaatgactgaccaccacctcggaacgccatggctcttgttacccagcccgggaggcgagctcccatagtgtgtccttcctaggcagtacacctttgtgtctgtcccagccaccacttgctccactgtcttctcgaggtattgttctcaccctgtcttcccttctcacctcacagtatctcctcaatctccatctctcctggactgatttcttccttctctgccccaacctataaaagccagattgtccctagagtcgtcacccatctttattccatttatttatgctaactgctctccctacaattttaacctttccatggttcacataattcctgtatgcagtcattccaaaatctctacatccagcccccagttctctctagaacaagagcacacaggtgcccatttactgttccctctctctccctctacccctcttctttctccctcccattccctctctctcattctccctctctctctcttctcagtctctccatccctccactcccctttctcttccctgctgatatgtaatagttcgccttctccatccctcaatctgcctttctccccctccattacacagtactctgtcaaagcttgggctgatgcacatgaccccattcttagcatcctttggcccttggaaaattaaacctaaaccccgctgtgtgctccgactctctgtcgcgttggctgtaggactgctgtgcgaagctctgtggcttgggaagtgaagagtgatagatccaggttgagtggagactgaatcgcttactccacttgggaagtggaagtaaggggtgctttttttctaacccaaaacgtctctctgtgtctcttgctcttttggagctgctgcaagaaaaatacttgatcctgggtaatttataagagagaaagctctgtggctcacaccagtggagacgggaaggccagtattgagaggctggtgtctgatgatggcttccatgctctgccataatgccacagtgagcaccatatggcctaagggcaaaaagaatggtggccaaagtaaagggaggacgtggcaagacatagtaaatcctcccctgtgcaatggcattggggcaacggtgaagatggagcctatgtggtcgaagcgccggaagaacctaagagcccatctctaactccatcacactggcagttccaacatgcatttcagaaggacagacactcaaatcacagtgtcacgtttctcacaggtaccacacgtgctcacaggaccttggtggccgttggactttcaaccttatcattccccttaaccatctacccctccccgtaggtaatccagattgcgtgaattccatccctaatgagttctccacacggacgctcccatcaagagcggatgctagctcccttatggtgccaggttagcataggtataagtgggatagcattgggcgagacaagaaagccacgagttggcgttcactgaagcagcatgctagtcactcctctgtcgtatgtgagcagtctgtcgtagtcaaaacagaatgagaatgctaggtaatactccaagggttccagatggatgggctttaggaagctgtgtgtttctgaacgtgttcccagctaacctggtattttcttcactgctgtatttttgtggagtggagagacatcatgccaatggaactcttataaaaggaaagtatttaactgggggctggcttgccatttcagaagcttagtccatcataatcatggcaccagagcatagtggcacacatggcattagagccacagctcagagctttacatcctgctaaccgcaggcgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccccccaccaactgcctgaaaatatatgaacctatgggctcattcaaaccaatacatttgggaggtacagttctagaggaattcccttctgccttcgggatactgacctgtacccagctctgcacagccttccctgcctgcctgcctgcctgctatggcattgtgctgctcctaaacaacatagaatctctaagtcaccggtttgactgagctcttggttaacatgaccccctttttctaagatgcatcttctctcagtgagaactgctcacacaagtgcttatggggggtagcataggccggcgctcctctcttcaatgctattcgatgcatgctcggtgttctagaatgttctgttctagaactgtccagtctgggacttgctgcttcgtaaggctgtacttcccaagagtctctgtttgaagcatttctgacatgccagtggctcacacttaaaacccacgttgagaggcacaggcacacttccctcaagtccctcctagacttgggctctctacccaagggggcacagggaaatgtctatgtccatggatggctgctttgtggcacttttcagtgctatagaagaatgcattcaaacaccattttcacttctcctgactgtagcttttaagtctctcctctcggaacggggactatagctccgaggttgaaatacttggtctgcaagtgtgaggaccaaactctaactcccagaagcccacatgaatgacacattggtatagtgacctgcctccaagtctagtctcaagaagacagaggcagaacccccagaggaagctggctaatgacaccagccatattggtgcattccgagtttggttgagagagtctgcctcagtggataggtggaagaacaattgagaatgattcctgacctcacacttaggcacatgtacccacacatgtgccaacagaatgcaaaaatatgcatgcacatacacacacacacacacacacacacacgcaccaaagatgaaagaaaaagctcctacttcaagcccctcgcccatccattgagaagtggttttgagggatgagccttctgtcaggtgacctggggacctttctcctcctctgcatcatgctcagtgtatccagcagccactggctgtccagagatgacagacatgagatattgagagagaagagagagctgtggtctacctggaaagatagggggaaatggtctgaagccaggagaccctgtgtagtccagggagtgcacagagctaaatttctgagtaatggtcttcctgctctagcctctgcttcctccaccgcagaatgctgtcactcttggacctatcccggcaggcaacaaggattctgtgactagaggaccaaatgtaaatctgatcttaaacttgcaattacttttcactgagacaacaaaacagcattgaaagacttccagctagcccgagcttctagaatcacagtgcaagtgcggagtccttcttacccactggcttcccatttcataaaggagaacctcgcagatgatgaatgtgggactcacaggacaaataaatatgtaagaagtaaagaaaggcccagagctgttttccccatcgtgagcctcacggctacccagaggtcaataggtacaactcttttcagtggatcccttgggcagcatggagatgtgaaccctcttgatgattcatttctctctaaggagtcctgagaacacagtgccagctccttcatggggttattgaaggtggctggaaggctgacagattggagtcgaggacatgaaaccaaggaaattcagtagccactttttaaaaacatagtgtcatgcaggattaacatttgatattctgagcactagaagttgatctttgccatctagggatggacattgtaagcacttctgtcccttaacttctccaagactttctgtccttgatgatagtttgacctaactcccagaccagttcttccaagtgttctcgaaactgttcttcctggaaacgtgcttgctaaattgtggtataagaatgaggctagccttctgtagtagtcaggcttctctaaaggatcagaactgatagaatggatagacatggcttactggaatgtcttacaagctgtggtcctgctagtccaacagtggctgtctcccaatagaaagtcctggggtccagtagctattctatccctgaggttggatgtttctgcttctctgcagtatacagtgaaatcatagattaggctctaatgcaggtgaaggcatggacttctcagtgaaagtaggggtgccagacaaaaagcaagcgcttccttcttcagtatattatgtaggctgccatctgaaggtgtggccctgatttacagtgggtcttcccacctcacatgatccagtcgtgaaaaatccctcaaggatgtgcctagctacttggattttagctaatgccagtaatagtcaacttgacttccaaaatggccgtcataccttaccctagtccctagaatgttcaccatttgcacagttgataatctccttactcaaaagcctctacttaaaactgtgttggtaattaggtctggcatttgttgaccctcatctcatctcaatgcattaccagtttgtttaaaacttaagacaaagcaacggaggatttgtggtgggcatccacttccccaggcatgccaggctcacagaaccaactcccaggaaatattctgacatggtgttacactattttcagctgtcagctttgcctgctctctatagaaagtgatatttcaatgtaaaattcctcaagatccaacagttgagatttttaatgggaatatcagccactatgacaggaattatgagtgactgttaaatcatatgatcccactccttcgttttgtagatatgaaacctggaaaccaaacttgagcaataacttaccaggtttatacagtgggataacatcaagcttaaatgctattttaatcagatataaatacagagaaggcttcggacagctttataaggtgtttaggcaaataaagagtttctttctgtcatggtggtagtgcaagcctataatccctgcactcaggaggcagtggcagacagatttctgagttcaaggctggccttgtctacagagtgtgtttcaggacagccagggctgtctcacaaaaccaaaccaaaaccaaacgaacaaaaaagaatttcattctgccctccttcccttccaaagtagcttccctaagcttttagggtggcccctgtatttctaggtgggattattacaaagtcccttttctgtattttgggtactatttagtgaccccacactgggtgataaaactccagtcctccacattgaccgtcaaacagtcccaccaccccatcacatatgccagtcccgaccttcctcctctcagtatagattaccatgatctcaattaagtgactatactctgcacaccttgttgggactattgaaagccttttgatactgagtcatgtggtacactatcattgttttcctttgctgtacatcattttggtttgcttcccctggagttaaaattatgtctctctgttttatgtgcttattattgattcggctacaaactctccacaaatgcccttatcatcccttaagacttccatttgcagtctgtgttctacctgtctcatattcttgggtgacttcttcctgtggctttctaaactactccagcgtgaagaaatgcccatcatgccagctgtgagctgccaacccaactgttctccatcatctgatgcatcttttgtggcttctctctcccgtatcctatgtcttcctccttccttttaaagaatattttatgaaactgttatacacatatacaatatagattcccacaactcagtgaagcaccaggctgaggaattttcaatactccgttgttttagcttcctttctgctgctgttttaaaagcactctgactaaaagtagctcaggggaggaaacagttttttatgctttacacttccaactcatagtctgtcaccgagggaagccaaagcaggaactcaaggcacaagccgtagagaaatgtccctccataatggcttactccctggcttgctcatagactcacacctagtttttttcctttctttctttctttctttctttctttctttctttctttctttctttctttctttctttctttctttctctttctttctttctttctttctttctttttttctttctttctttctctctttctttctttctttctttcttccttccttccttccttcctttctttctttctctctttctttcttttttctttttttttctttttcttttttttttttttttggtttttggtttttggagacagggtttctctgtgtagccctggctgtcctggaactcacgctgtagaccaggctggcctcgaactcagaaatctgcctgcctctgcctcccgagtgctgggcttaaaggcgtacgccaccacgcccggcactagcttttcttgaataggcaagaaccacctacctagggatgctgccacccgcagtgggatgggcccaactacatcacttagtaatcaatatactctccctcaaacatgtccagaggccagcctgatctaggtgaggcttctcctctcaaggactatatacagtttgtcagactgacaattgaaggtgattgtaggggcagtgaggtgcagagaccttcacttgataccagaaatcatcctgtctttaccatcaaatgatgaagaccaaaaactgtttccactcagaattgaagatactgctctggtagtgcctaattcagggttgcctctaaagttgtcttgtttcttaatcctcagttgtacctacttcttttttttttccagagatatgttcaagtttttctgtccccagtatttcagaattatgtagggatatgatataagtctattttcattggttgtgcaagacactgatagatcttttcagttgggaaaaatcaaaccctgttgttctggaaggcacagtgacattgtaaaggattccttcccttgcattatctttctctaggattaacttttgggttggggctattcaagttgggttcacggttggccagtctggatgactgcttggttgggaaaaggctatggataatctttagaccttccctcctagagtgattctattgtccagagaagactcttgtccccgcagggaaatgtgactatacaattcatacttcattatggctgctcaaatggctttggaactgagagatacctctagcgctatcagagccaaatgacaggagggggctggaggaccatcctcaagtatctgtctactgctctcatcttcactcatggtacccaccctccaggcctggcagcatctgcttcctttccccagaaaataagtctctggtgcagatgaggggatggtgcaagagcttcctggccacctgggtttataactgcatctcaacaaatgcttgtagtctctacatctccatctctaaaaacaacttactataatttcctaaactctggaggaggggtgaaattttataggataaatttaatttttctcaatttcactcatggctggttcaggactcagctctgttggacagatagatccattcccacatatccatgtgtttcgcacttccagaattatatggctgttgcctcttctcttgttttttgtgtacagttttggaaaagagagaaaactagtaatagttattctacctaccgtctttatccagaggtctttaactacaacgacaacaataaccacaccatcaccatggacacgctgaggttgctatggttactcatcacaatatttatgatgtttcctaagatagtggtcttaccagagcccatcacctccagtggcactgtcaggtcgccctgtccctgccactgcccgtctcagtttcacatgggaagcagagttttattttggaggcgacactgagtttggggtcaaagaactgggcctgcaggctgggtcagcctcttctttgttgtgtctctctagccagaataatcagactgtttgaaatggcttcttttttttttttccaccatgccatgggaattagaacataaacctcttaggactgttttgaaaattacatgataaaaacatccgcagaagtgctatgtgcggtccccggcacctggaagggtctgtggatcctgcctggatggatggaaaacattgagtttgggagtcagagaatttataggacaagccctccgcccatccaaattcaatactgaaactttaatcaccaacacgtcagaatatgactctatttgaaaatggaatcttttaaaagaggtaaccacagttaggtctgggtgggcgccaatgcaagacaactgttatccttagaagaaatgaaaggtaggaccaagaaagcacagtaaaggaccttgagaagatggtcctcttcaggccagggggaacgtcctcagaacaaaccaatctgctggcatcttgaccttgatcatttaattgtcacaactgagagaagtcaatttctgtcatttaagtgattcaattggtggcagctctcacaaaccaatgccaaggacctgggtccaagcatctaaatgaccacacgtgttatccttgtctcagatgtcagatggtgctaacggcgggtgttttgcatatggtggcaagacctgtggggttggcttgggtgggttaataggctagtttacagaagtgtgcctctagaggtggggttggggctcagccaatgaaccatctgtggtaaaggcaatgatataagcccctgtttgggtcaatggatgatagatgtgtggattctgttgtgcaagttaagggtccaaccaagcagagcctctaactcagcaccagacagtattccagagaaaggagctttattaaattataattttataatacattcctgttagcccagtggttctcaaccttcctaatgctgtgaccctttaatacagttcctcaccttgtagtgactcacaaccataaacttattttttttgctacttcataactgtaattttgctactgttaatttactataatgtaaatatcggatatgcaggatgtcttatatgtgacccctgtgaaagggtcactcgactcccaaaggcattaggacccacaaattgagaactacttcgttagaagcacaaggcaggaaaaatagttattacttagtatctatagtgacagacctccaggatcactgcagatactaaaatccagagatatccaagcatcttatgcaaaataaataacttacctatctactctgtaaactgtcatctctcgattccttacactacccaaaacagtgccaggactttgtaaacagttgtcctgttgtaccgcttagggaatggcaagaataaaagtatatgtctggaacagatgcaatttttaaaacatattttgcctttgaggttgagtattccacagatgcaggactcgtggatatgtatggaagctggctatgctgatccctggtcagtgagttgcaacagcccgaaacatctgctaaccaggaaagcttcagaggccgcattggcagctcggttttcctgttgggtgatctttgccacaactacacatcatgcctgagcccctcagtcaagacactcatctgtccccctaccgtgctgacaactgaataatgtgtcccatgctaaatattatcccataatcttgaggtgtagctgtttttaggggtccagacttattttaggatgaggcttttctttttttttcttttttcttccttccttcctttctttctttctttctttctttctttctttctttctttctttcttttctttttcttttttttttttgccccgaactgatttccatccgtgttttctgctggttgtagcatgggacagagtcactgtgacatgaggaggaggagcgggtcagggggtggggagtacagaccagtggctgggaccaacgctgtgtttacattcctctgagaaagccccgatactgctggccagatcaaaagtaggatcatgaattttgttgacatcggagattcagaacaaacaggaagtttagagccagagagaaattcctgatgaagtttgagctaggaatatgcgttcagagacaaaatagtcagagactctgtgatcacctacatttattcgagatctggtacataacacagaacagagagggccctgagtcagagttcaaaacaaaacaaataaacaaacaaacagctcacactgcacacgctgaatctttaaccatgggttctcggtctgtggaatcagggtgataactcccccacagagatactgtgaggaccacatgagttcatacatgggaaatgttatggtcctgccgagtacagagcacacactcacatgagtggctaagtgtccagttagtagaattctctgtagaagtggagaagtggcctgccagttggcagactgattaaaaaaaaaaaggcatctcatccggttaagaaccttccaaacaaaggcatcatctgtgagatgctgaggtgtcaggcctttcctgtgaagaggaattgaatatctggatatttctttatgaggacgcagtgctctacagaagcaggtatcttggaaggagtatcactgcagtggattcaagcagagactggattctccaagcctgagtcataggactttgtttctttaacgccctgggctaatggctgagctcctaaaaatgggaattgtttcatcaaacaatcggcagctttgccatgataggtaagtttttgtgtgaaagtctgaggctggctcagtggccctccccattggctgtgtttgttttgaggtgacttgggtcacaggaggggtggagaagggaagagtatagccatcaagcagagaccttaggggccacacttagttggctctccttctttttatgatcgtgtgctaacaggctaatcgactaaggctgtgccctctgttcacccgttggctccgagtctcttatactgtctccgcccatgttctttataaagcaagaaactggaacatttggttgccgagacgcacagaaggactgtgctgtctcaagataacatctggaggttctcgggcctcttacacagtaacacccacaaccttgggcgcttgttggcttcgtctccggcaagttttgtcactggcacttgcacacagaccttgccgtctcacaagatggtccccatatatcttcctagctgcttcctctagtgaccttctctctgagtcatctcttgagcttaacgagtgtggtctttggactgacctctgacacgtccaggtgtgacgtacgcttactccatcctgaacagtaatagtccccacacagcctgtttcctcagagcttctgtttaagaacatcagaacttttcctagactgtggtggcttttgtttgtctagctcgctccttctcatcctctaatgttaactcatttgccccgaccttctctagaaaatgtggccactccttcctcctttcacattgcatctgccgctagagcagtactccctacgaacggtgtctatttcttggttgaacgatcccataggtattctctgaattgtcataaattgatggcttcccctagtggaccacagtctcttaatgcatatatttagtttacaaaaacaaaacaaagcaaaaaggcctaccccgagaaagatgtgaggttggcgggaggagttccctggacacaggtggccacgaggatagaatgtctgtgacttcctcatggaccagcctgggctttgcttgcagtgcactgccccgacttggatctccttctgtcccttactgtgtgtacttgatgaattgctgctgggcagagagcaccagggcagattccaggaccagagctctactaaagctcaacctcagctaggcgaccttggggaaattattaatactatagaagtaataaaattatcctttgcacggcctcagtttcccgaacccatacatacggtgaccacacaggatgaactagccttgcaattctcagactgtctggtctgagactgtcttgaacataacccaaacttgcaaggttgatggcaaacttcacttcattatccttgtgaagtcctggcaagtagtggttcctcttgggagggtttagagtccacagcccatgattcctatggctccttagaataggaaacttcgttggcaggtgacgctagtgttgggtcccctcctgcccacacacaccctccaatttgttcaccatgttcccttattaacacaatgaatagtttgcccaggctctgttgtagccaacttaagtatttactcctatggtaagtgagcactctaccttgaggggaatacagctggcttgtgtgtagggacatctagccaagggcagagatgcattctgggaaaaggactgagatcttcacagacacctccctccctcttggaaacagggctggcagttgcccctttaccgggaatatgctcatctgccatctcttgaaggagaaggctgtggagaagccaccaagaaaatgcctgtgttgtccggacagcaggttaacaatgtttgtcaagacactttgatgtgccaggtgtgcttcaggatgctctcataggacaggaggcatccagtctctgccctctttgacacttgggtaggaacagcagacaatgaagcaagccataacaataaaagctgataagagttatgatagggcaaatacatggcacgaccagagaaacccagggagggccctgggctggcctagagcaggtcagggaaggctttgaggaagaagtggcctctcccagagaggcctgataggtaggcaggaggtggccagagtaaaagaatgggggaggtaggaggtaggaaggaggacagggttgataatggggaggggagggccccaagcagacccttgggcctgaagagccaatatatgctggacctcaaagcacaaggggcagcttggggaggcatgaggtcagccctgggaagcaaggggctctaagtggagggactttggaatgacgatcagagcatcctcttggggtaaactgtacatagaaattaaatgatagcttgctgtttcctggaatttgagagatagaagaacctttgaaaggtagatattcccttatcatttttctcgaggaataaattgaaactcaggtttatccaaggcctctctgccccttagagacaaaggcagaagtgtgagccgggactccgggggtttgatcctgtgtgctgatagaactagctcccaacaaaaccaaccagatttgcagcattttctcatttctgtgatgtaaatgttctccctggggccagtttctaactaccagcattttaacaaccaactcactaaattcctgaaaagtttgtgatatgctctggtgaactgtttcatgccagccacaggacccaatggagaagcagtcatgtgaactcatctcttctctgcttagggtcaaccaccacagagcaattatatcctaacagcctgcaaacgttgctgatgaagttccctgacgcatccgagggccatcatccgtaatttactgtatgctacttgagtacattttctctctggccaatggacagaaatttctcccagaagacagacatcactttccgatactgtcaccttgaagctctggactttattttcaaggccgttgaatgttctgtacgtttagaacagcttttattttaagagtaacttgtggggttgtcttagttagggttttactgctatgaacagaccatggccaaggcaacgcttataacatttcattggggctggcttacaggttcagaggttcagtctattatcatgaaggcgggaacatggcagcattcaggcaggcatggtgcaggaggaggtaagagttctacatcttcatctgaaggctgctaccagaatactggcttttaggcagctaggatgagggtcttataaccacccttacccacagtgacacacctactccagcagggccacaccttctaatcctgccactccaccatcacagcagattttgtttagttgttttcttttgctttggctggagaagttcagtcagtagagtgcctggtccccagaacccaaggagagagagagggagagagggagagagggagagggggnnnnnnnnnnnnnnnnnnnnnnnnnnnnnnnnnnnnnnnnnnnnnnnnnnnnnnnnnnnnnnnnnnnnnnnnnnnnnnnagagaagacaaattgctgggagcatgtacttgtaatgctatcgctgaagaggcagagacaagcaggatccctaggtccttagctggccagtccagcctcttgttttgtgtcaggtcagtgagacatcttgtctcataaaagggcaatgaggatgaggaaggcctccgcctgaggaagagcaaccaggcttgcataggcatagatgtcacatgcactgaagttcacagccttccacatagcaccatggactgaaggccaagtactcaaaacataagcctattggggccattccatatttaaaccgcaacgtgaatacgagaaactgatagcccaaatggacgtggaaaacaactgtactggctagttttgtgtcaacttgacacagctggagttatcacagagaaaggagcttcagttgaggaaatgcctccatgagatccaactgtaaggcattttctcaattagtgatcaagggggaaaggccccttgtgggtgggaccatctctgggctggtaatcttggtttataagagagcaggctgagcaagccaggggaagcaagccagtaaagaacatccctccatggcctctgcatcagctcctgattcctgacctgcttgagttccagtcctgacttcctttggtggtcatgatgtgcaggaatagaaaccctgactaagacaacaactttttctattagcatattaaattaatgctaccataacagaatatcccaaactaggtggcttaagccatgggaattaatattttctaagatcaagacactgacaaggttgttttcttgtgagggctaaaaggaaaagacctgctgctcctccctatcaccagtgctcctccctatccccagtgttcctccctatccccagtgctcctccctatccccagtgctcctccctatccccaatgcttcttcctatccccagtgctcctccccatccccagtgctcctccccatccccagtgctcctccccatccccagtgctcctccctatccccagtgctcctccctatccccagtgctccttcctatccccagtgctcctccctacccccagtgcttcttagattaaggtccactttgatggctgtattttaattaaaagatttctttaaaggctttgtcttcaaatgaagtcccgctccgatgtactaaggggtagggcttccatgaatggattttaaggacataatttagcttataacacctacagagtttatggatacttttttcttacattgttttacagtctattaatttcaggtcattcgttaaccctctgcctcgctcgagtcctttggtaaattatctgtatgcatttacaatacagatcatcttgtcagagtttgcattctatcctgggattccccagtcttctctatggttttaaatttgtctgcattgaggctccgtgttggtactgtgaaattctgtgttcctttgccttggaatataaatttaaatatcagaatatatctgctgatatctttaattagactaatgtatggtatttctgttcaaattgtattgagtctatagattggatcagcaagaactgacctcataatctggttccttagaaccgtggatttgaagtctctgtctactagaaactccttgttttctttcatgtgggggtctctgttttcatacagagctgtgcatgaattttgttaagttgggccaagatgtatttcatttgtgctatcagaatagtatctcttacatgaaatcaggaaatcaggtgacttttatatgttaaccctatatttgcttgtaaattctaggaaatttgggtcacttattccagactttctgtacagacagctctgccctctgtaaggtctggggagtccttcccactcaaatatttttaattcatttctaatcttatcacaataacaaggaatttcaggacaatgctgaacactactaatgagagaggaaattctcatgattttagggaaagtatcccagcttttccccagtaagcgcatgtccgggaggttacttcgaagttgttttctgtggagctcagggtgttctttgccatttttagtctactaggcgtttgtttgggtttttgttgttgttgttgttgttgttgttgttgttttatcatgactaggtattcaattttgttagatgcctttccattatcaatggatacgtgaaatttctcctctttggatgactagtatgtagaagtagacctctggaggttgaaccagccttgcatacctgaactaaacccccctcaactgtggtatttcttccttcttgtacatacatcattatatttgctagctgttttactttggcactgtcttcgtctggttctaaattaggatcatgctggcatcctagaatgcgtaaggaaggttataaactagtgagtctctgagtgtggtggcgcacgctgaagtgaaggataaggaagaagaatttccatgagttcaagattagccggggctacagagtgagtctcagcacagccagcactatagcaagactccgtctcacataaacaaagcaaaaataaataaataaaaactacgatttttaaaacaaatggaggcctcatcagatttttttctacaaaagacttcgtagtttgtttctttccagaaattagttgatttcatttaattatcaaatttgtgaacacaattaattattcttagtgtttattttagtgttcatatgtataccttagaatttttccctaaaaattaagtgtacattattatctttatgtcttttaaaataattaagtataataaagcacaaaaatcacctgagaaactaaactcaattaatccaagtaaatactaatgcctgctatttatacgccagtctctaaactccgtgagagcatgataagctcgtcgtatccatgagtgtgcagtcctgtcagtcccctcagaacagttttccagaagtcttccaggatgtctcctggtgttttgccttaaagtcaggtatgtaggaccagccctgtggggaccttcacctcgggctctgaggtcagccatccctttcccaggaaattatcattaagatcattaagaagttcctccagctaggcacggttttggcacattcaatcccagcactcgggaggcagagacaggtgggtctctatgttcaaagtcagcctggtcaacagactgagttctaggacagcaaaagctatacagagaagctgtctcaaatataacaaaaagaagaagaaagaagaggaagagaaggaggaagaggaaggggtgaggggggcagagaggttccttcatactcccaccattgatgacagaaaacttctccccatctttttcttccattcttttttggccttccgatgtgaaaagctttattatttttttttttaatttttttctaccttcattttcatgggttctcttttctttttgtcaccaacatttctgcctctgcttccttcagttttatatttaaaaggaagtccacaggtacaaattctggaaactgcttcccccctcagttctggcatcccaagtatctatcctcagcagggcaaaactgccagccagccagcaaagtcaagatccttcgacctgaagatgaggccacacgcattccttatgtaagcctggcaatagctcgtgtaggctttcatgcctctctcagacactgttctctcagcctcagccaggaattttggcaaaggtctacttactgtatttcgctggaggctcacctcctgctgagggcatttctggttgatggacaggaaggaagcccagatcgctgcctcagtggccaacgtgcagctgcagcaatggatggaggtgctagggagacagggtggggcagtgtcccctggtgacagtagataatcagagccaggtcccccagctcagggtccactgggcagcccgtcagtgagcgtaggaaaaatgcaatgaaaacggatggagcggcagaggagacgatgacgggtgatcacttgaccaatgctaggcttccttggaccacatggcaggatcacagatgggacgatgatggatggtctgtgggctctgcagacacttgaccaactccgggcttcctcaggccacagggcagaatcacagaagaatcaaagagaagcaggcatggcagatgtcagcagaagctgtgcttggggcctgaactctgactttgctggttaaaagcgtgcaagacagcttttttagagcgttctgttcagcattctgtaatttgtacttcctcaaaattttccattaatggatttttcttttccttatttatttattcctccgttgccctcctttttcctttttctttctttattctcccatccttttgggttttgttttgttttgtttgaaacagtttctctatgtaaccgccgtggctgtcctggaacttgctctgtagaccaggatgacctcagagatctgcctgcatctgccccacgattactgggatcaaagatgtgaacaactacacccagctcccctcctctttttgcaggcatcattgaggctcagtagatcaccaaatatactcatgattactctcctaagcctagcttcccaaatattgggattacagatctgagacagcgtatcccaactgcttgagagtaattgagagaaaacacactgttaataacacatcaaaagctatttgtttttttgccttcttctgtgatttaatgtgttgggggctggagaggtgcttcaggtggtagactgattgcttagcatgcatggagaggccctgagttcagttccaagcatcgcagaaagccaagtgtgtcggggcgtatctgtctctgaaaagcaagggatcggaagttcaagattgccttcggctccatgagactcttgccccaaaaaaagatcagttgcattcagatgacgtgcaaacttttccctgcatgctcatctctctcaggattcctattttgctcagctcagtccctagacagagagctactacctggcattgcttggaaggtcacaatgcaaagctccatttactttaggaatgtcagtcccctgtgctagcaggccagcaccgtcctcagcatttggaccaccaacactatttgattttgcctcatcttccctgggatcacaggatcctcacactcttcaacaacggagcctccagggcctttcagtagtgcaagacacacacacacacacacacacacacacacacaacacacacacacacacacacacaggtactggagaagtccagtgtctcctgcttaggattgcagagcaatggaccagctgctgggatctctcatctgccatacacaccgccaagctcaaatctgggccaagtgcagatgctgctgctctaaagccagcacagctctccagaaggaatgttaggaacgacttgaaggacctccatgggacaaccagtccagtgctcgatccagaccaaagggaggcacagacactcagttcctgtgaatgcattcccttggtttttagaaaacctaacattgcagtttagaagtttatcccttgcgcctcatgtctagaatctctggcagggacggaagatccaactttatgtttctaatactcataatttatgtcctccctccttcttttttttttctctctctctccctccctttatccatctctctcaccnnnnnnnnnnnnnnnnnnnncatctctctcacccttccctgtcctcctcccccctcccttcactctccccctcaccctctctctctccctctctctctgttagccaactagaggtgtagtaaaataaaattgatatttgtattagttctttgcaagtttcatacaacaaaacttgatcatattcacacctacacaactcttctcagattctctcctcttctgttcccaccaaactttgcttttgttttgtttcataatccttccagaccaatttgtgctgtccctatactctaggatgtgtggtcttccactggaaagcgatcagtttatagggactacactgggtgggattgtgtgcctaccttccttcttcatggtctgggttaggcttgtgaaggtctggcacattctgtcatgaattctgtgagtttatatctgcagctgccctgctgtatccacaagctatttctccacccctagtcctcccctgccttggctcttaaactcttcccggcccctcttcagcaatgatctttgaacctggaccaggggaggaggtgtgcacgttttctttcgggctaagcatcctgcctactttgattctctgagaagcaggtttgatcttacgggtttcctctgttattttccggtttgtaatttcattaattgatgtcctaatttttgattgtttctgtttgctttaactttaaaattgtgttctctccctgtttctgaagacctagtttatagattttaagtattattttataaaagtccaattatataatgtgtacacttctctttacacacaaattttgatgttgtatttttactttttttcagttaaatttttttctaactttgccaatttatttccttaaacatgataatattagggtctatcacatttttttcatttttttattagatattttcttcatttacatttcaaatgctatcccaaaagtcccctataccctccccccaccctgttccccaaccaacccactcctgcttcctggccctggcattcccctgtacttggcatataatctttgcaagaccaagggcctctcatcccattgatggccgactaggccatcctctgctacataaacaactagagacacaagctctgggcggtactggttagttcatattgttgttccacctatagggttgcagacccctttagctctttgggtactttctctagctccttcattgggggccctgtgttctatccaatagatgacagtgagcatccatttctgtatttgccaggcactggcatagcctcacaggagacagctatatcaaggtcctgtcagcaaaatcttgttggcatatgtgatagtgtctcggtttggtggttgtttatgggatggatccccgggtggggcagtctctggatggtccttcctttcgtctcagctctgaactcagttaaaattttttttaaaaagtttcttgtgactttggttcatgtatacttcataaacgtattgtttagaatttttaaagctatttctgtcttattaacatctaattttattccaaaattattttattctttgtcaatctcaatgcttttaaataaaatatagctccttgtggcctagataacgacattttgatgaatgttccatgcaagcttaagagttggtagtctattgctgttaaaaagaatatcaattagatcaagtaaaaatataaagaccttctagccagctgtatctattgattttctgtgttcttgagtgatcactgtaggagagtatttatcttttctctctttcagttcattcagatttgttagactttcatggggttctcattcacagaccttataatccacccattaaaaacccaccggtggttgctgatatcttcagagcgttgtgtaactagcactataattacttcagaacatttctattacagccacggagggaattccgttcctttaaatcatcattcttcatccctcccatgcgcgatcttagaaggcacctttctgctttctttataagttgttctattctcaacaactcataaaaatggaaccatacaatacgtgatcttcagtgacttgcttcttttaactaacacattgtttcaaaacccatcttgaaccgtgcatcagtgattcatcccatattgaggtcatcatttcattgtgtggctaagctatacttatgtttatggatccattacttcatgaccatttggttcaattctaccactagtataaacattaatgtataatttttgaggaaacatgcattgtccagtctcttgaaatgtttaggttttgggaaattgcccactgttttccaaagcagctgtacaatgctagatgtctattaacaacaaacgagggttctaatttcttcaggttgtcacccacagttgtcaccatccatcctcttaatcaagtggacgttattatatacgttccattgtgattttaagttctactagtttttgcctttacctgctttctgttgttagatgcatacctgcttagaatttttaggtgacttaaaagaattgacctctgtattagtcagggttcttcagagaaacagagctaatatatatatatatatatatatatatatatatatatatatatatatatgggatttttagagtgccttacagactgtggtccatcgatttcaaaaactggctgtctcccaatggaaagtccaagaatctaatagtagttctgtccccaaggctggatgtctcagctggtctacagcataaaacagaatcccccaccccccgcaaacccccaaaaagggctctgatgccagtgaagcaatggacttgccagagagaacgagaacatgtcaacagagagcaaaggctgccctcttccctgtcctttatgtaggctgccaccagaaggtggggcccaggtttaaggtggatcatcccaccacagaggatctggacttagggtctgtcagatgattcagtcaagaaaaacccctcacaagtgtgtccagacacctggagctttagttaattaattccagatgacaagttgacaaccaagaagggccattgtcacctctttattaattgcagtaatgttctccttctgccttgttcttttcatcaacatgtgctaatgtgtacagtaatgctacacagtgtgctattttaatctatgcatgggaaatgtgcttccgtcctcaacttactgacatcgctattctaccttcaattgaaaaaaagaaagaaagaaaactttcatgtgtggaagagtccaaacatcccaagcatcctgaactctttttcaattaactcttttatatctggcttgcttcccttgattgtttcccttgcccttggtcacactttcagtctgctttgtctaaaacttagacaggtatgcctgtcttgtttcagaaaaaaaattgcagttttcacagattatatagcatcctttttattagttttcgtgtatttctttttatcttctatgaaccttcatgttaaaattggtttcttgtagacaataacaacaacaacaacaacaacaacacacacacacacacacacacacacacacacacacacaaacacacacctggcggggggggggggaggggaagagataggttgccatttgtaattgtaagatgtatctaatttcaaatttgttaaaacatgaaaaccaagtgtctaggttctagagtctgtgactttatcaaatcccatctgtccctgcccctccccacccctccctgccccaggaggtttggaggattaagtaagacaaagtgtttaaatacttagcaagttatttgggttggcagtaaagcaccacctattagccactgctgtgattactatctaattgctctatggagctcatagctgatttacacattccagccccatctctgtcaaggttgggcggaactaccctaactgtgtatcgatctagttctacattgctttttcgtagtcactgtgagcgcctcttttcatgtctgttctacagtctacctttaaatacgaaactctgaagtcaagcacccttgtgtttaaataacaggctgtcccttactgacctagggagtgtctctttgtctctttgaagttggagtttcctgacctgtaaaatgtttacacagtacctttcttatagaatgtgctcaggacccagtaggtgatagcatgggtattattggtatcagtggtcatcaaatgtcccctctaggcaaacactccctggactcaattctcctctctgtgctcctcataggaacgctctgggtctcacagagaagctatctaaggacttaagccttagcagagaacatgccctgaaacacaaatctctacagttttcagccatacatttgggcatgagaagatggcattatgttctggtatgtgtcatgtagggggctccctctcagcacaggctagggcagttcccagactccacggagaattctttgagtgacaatgacagcgggagcatgacagtaattattcctctcttacccactgtaaacccatgaatccagaagctgtatggctatgctgttcacctccgtcttcgctattatggatgcccaagctgggtgaccatgtctcttcacctctgcagctttcaccccagaaatattctagatactacttattcattttcgtctacttaattattttcctcttacatctgatttctggatctatagctttggcttaatttgagtaaatcattgtccttgtttggcagacacttttaatgtcagaacatttgccagtctgagtccttggacccagacaagcaggggaaagacactgacagaaaaatcctgtagtatttggcacaggttcataggaatagtgggtgcaaagtgaggcttgccctgtgaggaaacttctgagtttcctgtggtcagggggctttgttgaaaattctctgagtcaaggctgtgattttcccagagactggacattgttcggtcagaatgattagaaacatggtgctcctggaacccaaggcttctggggaaatctaaacgtttccttctttccaggactcacattgtcatgccttatgagtcactgagaattctggtatactttcatcagctcagatatgcatgtgaacatgtggatatggatcatatatgctatatgtctgtgtgtgtgtgtatatatatatacacacatagagaaagtatggtggcaatgtgaatttttatatgttcatagatatgtatttatatataaagagaattatagcaatttactagattacttaagccaagaaggcagaatttggggagaaataattgaagcctcaattatatatagtgttgtgtctgtgtgtgtgtgtgtgtgtgtattacatatactatataaagtatatatagtagtgtatatcatataacatagcaatagtgtgtgtgtgtgtgtgtgtgtgtgtgtgtgtgtgtgtgtgtgtgaccccaattcctaagatcatgtgtcacagaagacccctaggaaccctagaccgcagtcccttaaaggttcccagcctgcccttagtggccctccttggggatcatgctgctggaccattgctccacttgatatatgatctcccaccccaccccacccccttagaagaagggagttccagcctcagtcttgggaactggcagcttctacatgggtggagcagtgaagatggggtctctagccacctaaagcctaaccaagttgtctgaactcgacctgtgtactgagacttggtctcctagcctggagtgctgcagtcagctgacactgctttctactccctccaggctcccaagaagtagtcaccattgctgctgaaaagccagccctcgcacagagaaatgtgtattccttaaaacccagtggaaagtgtttacccagccagtgctgcccacaaaggtcgcatggcaggaagaatacactgaggatagcaaagcatccagaagcctgggtttccttgtgggttacccgggagtcacagaagggagggagtcctttatcatcacatgtgcatgtacaatcagtggcatgcaggggactcaactgtgtgcattactgctcactccagagctcccatgtttgctgtgtcagcctgaataataaaacagtgttttagatcagattggagcaagagtcagctataattagaacctctttggaaccagacccaggctccttttctctccatagctagcacccatcatgaagggcactgggagggaggccttcactcagagaaagtgatgcctttgtctcttttatccctggtgtaggattcttcacctttgttttcttttcaataaagaacaaacgaaattcctcaaattcagaactccctcctactcaaccaggggccaaaggctttagacgatggagcttttaatctcccaagagtagggtgtccaaatgcagcttcctgaaaaggtcaacaagctcaggcctggtagctttgggatttcccagtgtgggtagggactctgtgcatacttagtctcagactatctcacctccagcattgagttttcagctaaactgtctgcccttagtcttagactatctcacctccagcattgagtttccagctaaactatctgcccttggagatccaggaccatgagttcttctctcaggtgccctaatgtgcctggcttagagctgtgcagagaagcttagacagtcagggcatagtaccaacctgacaagcctagatgctctgaggaatgtctctcagagtagtgggcaaggtaggcgtaaacagtagcgatcgaaatccactggattatactccgacaggatcaccatgaccagcaagccgtctggtaatcatggcctggctgttttcatcctactttcaaataaaatggatgattgagaaagatgaaaaggagatgggcaaaatgctgaggtggcctggtacttctggtctggtactgctggcgtcttggaacagttctgaaatgagaaagtagagtatcctgagtagatgtccccccatcatgtcctacaaaactcctactgtgtgtcctcagctcagtgatgacaccctcaagtgctgggacttggcctacatcgccatcctgcagactgcctgtgctcacgaggcaggtgtgtgatccacacgctcgcccctcccccagggcttatgagaaggatgtctgtttagggagaagccatccctgaaaggttgactgggaaaacagacatagacacatcctgtgctgaagttggaggaagctggggtagcaagtgaaacctgcagaggcttggttagaagaggaaaaagagagccagctagcaggaagctattgcacttgggatatccaaacagttacatgatgtgtcttttctatcattgaaaaggaatccaggagtcaagaaatgtataaatgggctgacaagatggttcagagcataaaaggtacttgcataaaaggattcaatccctgggacccacatggtaaacagagagaaccaacatccaatagcagtcctctgatttatacatggtaccatggcatgtacatacatgtgtgcatgtacacacgtacatgttcacatgcacatacacattcacacatgtgtccactcatatacatgtgtccactcatgtatacatactcgcacacatgtgctcgatcacgtgtgcacgtgcgtatatacacaggtacacagatatacacatgtgcacacaaatgtgtacttaataaataaatacaatttaaaactgtcaagaaatttgtaagtcaggtttcacaaaagaaaaacattaaataagcatttcgactttaaagctaagaacacaatttggtgtttgagtgaaacgggaaattattttttaaaacaaaagagaaaaagtcttggctatcaagagaattgtaaaatctgtcaaataagctcttccagaaagtgggtgagggctgggagctgggggtgcttccattttgccacaagaaaacacagtgtcttggttttggtttttaaagaaaacatgtcagagtttacagatcctataatactcttctcaggggattttacactcaggacaaaaatatagcttttattttgaatacttttatactcttctctaggtttttagaccagtctttatgcctacaatttctaaaaacggttttatatgttaaaatatatttagtaaaaggggtagctttgaaatggtggactctgaaaaaagtttcacatgaagcctagaaatcacagtcagaactctcagctctcgtggtgccttctgggaaggcccaaccacaaccaggcagtggggcacacagctgtgaggtagacacaaccaggggacctcaacacacagctacatggtcttccctccttgtggcaccccaagttctcacttaaaaactaggctaggggtggagagatgcttccgaggttaagagcacttgctgcattctgaggaccagcatcagtttccaacagtcacaagatagctcacaagcaactgtatataattctagctccgggggatctgatgcccagttctgtcccccaccaacaccacgcacacacgtggtacacagccatacctgcaggccaaaccctcatgcacataaggtaagtcattaaattaaaataaaatgtaaaagcttggatagcagcagtgcccaacttgtggttacggtgactactgaaggaagaatgcttgggagaaacacgcaagccattgttatcctttcaaatgccttgacacggagtcaggctacacgtaggagcttgttggctgtaccggtgctggcaaggatgccagatttgggcttgaatgtccatccacctgtatttggaaaatagcatgacctgaagtaaccgcagaaggactaaaaagcgtttctaattcttgatcttgtaaaactattcccagctggggtccactccctctgaggtcaatgccagctctattggtctgggagactgtgatgctgaacaacacagggcacagggattaatgagaacacgcaggaaaaaaaaatgctagtaagaggcatggagaattgaagaataactgattggagccagggaatctcacaggattaagtgagaggacggctttacgcagtcagcacaggtagacgcgcctctgtggtgccgtcctttaaggagataaagcacttgttcccatgatgaaggcaagcatggctcagaggaatctagagaaatccacccaccgaggagaatgcatatgtgggtgattgtgggtcaaggtggagaaagaaactgaccaaagctgaccaaattggcaaagaaggtttggaagacagactagctcctggcagctgtgggaaaaccacactgaacttcctataaaaatgcagagaccgatcccagagatactcagcaaaggcaatgctgtctgagacccagtcggaggaagtgtgatcctcagaacgcatggtggaggaaggagagcaactcctgcaggttgtcctctgaccatcacaagctccctgtggtggcctgatgcatccatgcaaacatccccccccacacacacacacatatgcaaataaacagtttttaaagatttaattatgtgtatgagaggtatgtacctgtgaatgcagtggtctgtaaagaaccctgagaactagagttctgacctgggtgctgggaaccaagagtattctgaaagataacgattcaagcttaactctggaaccatcgcttcagctccaacccctcccccctctttctctctatgcatgtatgtgtgtgtgtgtgtgtgtgtgtattatatttgagtgtatttgtatgtatatttatgtgtgtatgtttgtgtgtgtatatacatgctcacagaggtcagaagaaggcatcagatccctgagagctagagttacctaagtttatgagacaccctatgctggtgctgatatctaaattctggtcctctctggtcctctgatagagtggtacctgctcttaaccatggagtcatatctctagcccccagataaatattttttttaaagaagaaacctgacaaggtttttgtttttttttttgttttgttttgtttgtttgttttttgttttgcatcatatagagtcaatactggtttctggaaagctttgaaataacaaaagccaggggtaaatgagatagtactccatggttcctacacttgaagctggcttcagagcttcctaataggaggctctgaagaaaaaccaaaaaaggtggccttagctaaagctggacatggaaggatggcacagggaagaacaccttgcccttcttagggaggtagctaggcattaaaacaaggttaggacccagcctggtcactggcccaggagcccaggaacctgggaccctctcctcaagtaggacttgatccaagcccctccccttcgagtaacctgcagatagagcaaacactctaccttagggtgctggcaatgaggaggatcaggatggaggaggaagtacccgggatccgatctcctaggagaccaagtagcaccccgaggttttcctgtctctggctcaaaactccacagtaaacatgataaaattagcagagctaagtaggcatatttgtgggtttggaggcatagttggtcctgtttttctccaatttgacctaactggagttcactggggtatgtaatgnnnnnnnnnnnnnnnnnnnnatcgttatctttcagaatactcttggttcccagcacccaggtcagaactctagttctcagggttctttacagaccactgcattcacaggtacatacctctcatacacataattaaatctttaaaaactgtttatttgcatatgtgtgtgtgtggggggggatgtttgcatggatgcatcaggccaccacagggagcttgtgatggtcagaggacaacctgcaggagttgctctccttcctccaccatgcgttctgaggatcacacttcctccgactgggtctcagacagcattgcctttgctgagtatctctgggatcggtctctgcatttttataggaagttcagtgtggttttcccacagctgccaggagctagtctgtcttccaaaccttctttgccaatttggtcagctttggtcagtttctttctccaccttgacccacaatcacccacatatgcattctcctacggtgggtgcacttatacacactcacacacacacacacacacacacacacacacacccctaagcagtagaaacaagctggattgttagtactttttacggcattcttgattctggctaaatgatgtcactttataaaatgagaaaggagaggaaggcatttaaaatctcatcaatacaatttctgcacgtgtaatacacagccaccggttcaaagtttagtcgattggccctggaagttggagaattctatcaacttgcatcaaaagtcgatctgcccaggacaggttcaggttttctcgtgatgccttcttgtatcatgtgctgggggagaggacactactcacaattgctttcctagcatccatcactgcttagcaaataaagccacgcctgcagagagatgctttcaaacctgactgagaagcacactggatgttctcacagaacagacatgtctggctcaggctggggagtgtagctctgtgctaagtgctcgcctaccgcgcacaaagctgtttggtcctgggcactgcttttcataatcctgcaatcccagccctagggagttgaaggcaggaaaagcagatgttctaggtcatccttagacagataaggagtccaagggcagcctgggcttcttgacaccctacccgagaattgaggggaagaaagagagagaaagaaggaaagaagtgtgctagattctcaccaagggaagctagcagggagagaatgaacacaaccacccagtctgttggtacaacttagttaacacgttttaattttggcttcaggattcacagtttcctgttgctgtcgtgtacatagagtcgtcaatgcctataacactatgtctttaagaacgacatatttgccatgttgagatttcctggttttcacttgggtccacctgtgaggccacaagtcttcattcataaaattctaggagatcctggcaggacagccaacgacttgggaaattcaattcccctgctcaggtagaaagtggaactgacttaagtacctgccatgctttggaggaaatatgctcaactcagtacttctcaatgagaacaggtaattcttatgggtcctctagcaccgaggtgctcaaacactagggacagcgtttggcaatgtctggacttgggctgttggaacctagcagagctgggatatggaggagatgcgcatccatactgagggtactacaaccgagagctaccaacccaagctatcagtactgccaaggcagcaaaccccggctccagccctcgagttctatgatcatgtgattccccaggcttcgggagctgctgtgtttcaaaggcctcctctgccaccacggatcttaggtggaacacagccagatctgcaagtgggcacgtcctgtagggtctgaccaggttctggaaggctttttgaaccgtaagagtcagagaaggcagaaggcagaaacttgtacctgtcacctcctttcctttctcccatcaggaaatcttatgatttcatttccacactgtattgaactcttttccccccaaaggataccaccatctttgaaaaatcaaaagactctttcccccataatatatatgtgtgtgtgtgtgtgtgtgtgtgtgtgtgtgttatataatgtatatattatatataataatatataatatatttatatattaatatatattaagccaagaaaaataattaatctaccctgtaaaaactagcatcttctaagtccttgattaatgtgttaatggaattactggtgtgactctggcacttcgcctgtgtccagaaggcagttacaaacccaactcgggcaatgatgaaaagcaagccatctaagtcacctgtaacacgtccctgtaacccacgcatatctactccccctgaagaagaccatctctcgacacaaaatgtttgctacaagcaaaagtattttaaagtcattttagccatcaaaacttaatttaaccaaagcattttcacgtccccaccctttcagcttcttttatggggtgtccatgccagtaaatggttccgtgttcttggggtttaaaggattaagaatacacaggtagtaggtcggctttcctttctaccttggcacgctcgctcactgtagacactatggtttatggcctgttggagccagactgccttgaactgtttatggcgtaagacgagtctgaggaagtctctccccaggctctgaaacagccccacccggctgacaggagtctctcattccattctctctgacagcagggggccagtacatttcctcccaatctctgaaacccatgggcagattcctgcaaactcctgcatggtctctacagccccacacaggaagcctgaaacattatagatgcccaagggatatttctaagacctgggattgtcttggcttataagggagtgttcgaagatgcattggtcaattgattgataagaaatcctggattaatgatcaggctcgctatttttgcatttacttgattttgtttgcttggaggcagatcttgctatgtagccttgactggcctgtaactctgagagatgtgctctcccctgccaccccagtgctgggattataggcgtgtaccacaaacacctgggattcgtgctcaccgtttgtttttaatctaaagtcctgaggattgtttatttttactttatgtgtatgggtgttttatttgcatgtatttccgtataccacatgcatacagcactggaggacaccctgtaacctgagtttcagacacttgctacctagtgggttctgggaattgaacccgggtcttctggataagcaagtagttggtgctcttagccactgagccatctttctagctccagcgttcgccatctttaagaaaaagatcatctagcaccagacactcggaacctgtcagtacccgcatttgatatgaaaacagagaagcacacacagagagcttcaggggttcctatacctaaataaatatggtgtggcagagcctgatcctgttgttttcttttttaacatataatttatttttactttatgttcactgtattttgcctgcatctatgtcaatgtgaggatctcagaagccctagatctggagttacagacaggtgtcggctgctacgtaggtgctgggaattgaacccaggtcctctggaagagcagccagtgctcttaacctcttagcggctgagccatctctctctctctctgtctctctgtctctctgtctctctctctctgtctctgtctctctctctctctctctctctctctctctttctctattcctccctccctctctccctctcttcactgcacaaacgggtacttaactccattactaactggaaacattcctgtcgattgtcaagccaggtattctccatggaaaattgggttctgttctccctagtaaaattttgaggaaaggttctagagcgcttcagcagactgtctcgctgttggttgttgtactactgcccaatggacgtgtctccatggaaaattgggttctgttctccctagtaaaattttgaggaaaggttctagagctcttcagcagactgtctcgctgttggttgttgtactactgcccaatggacgtgtctccatggaaaattgggttctgttctccctagtaaaattttgaggaaaggttctagagctcttcaccagactgtctcgctgttggttgttgtactactgcccaatggacgtggtcacttaatccctctccggcatagacacttaaagttaaaagcaagttgattcaagttcataggcaaaaagaaaaaaaaaaaagaatagctaagtcgaaggaaaggagaagctttacaaaggaaaacaccgggggcttctgttttctttgtctgtacactgcttaaaggaaacgcagagtgacaggctagggggctgagtctttcatgtctgaagctgttgtctccaactgtgaggcaacagctggcatctccgaggcggttaggacccatgacatgatgagggtgaaggagtgggaggagggtgtcccaagcaggaccccagagtgaggaatggctgagcgggcagaaggatatctcagtctctttaccactgctggatctccagcgattgggatgctatgtaggttctaacttatccactcttcaagagtcttaggtgtttagtggaaaggattgggcctttctaaacctcaagttgcagagagttcatgaaaaacacagctgtttataatatatattacttgttaaaaggcaaacaaacctaagttgggactgagttcaagcaaccctgcccaactgaacttgctcagaggtactgagctgagttctgctttgctcatttgtgtgtggttgaggttgagcccagagccttatacacactatgtagccacaacacacttcagccaccccccagcccttcaagggaacgtcaaactatttgcctgttaataaagagacactagtgttggacgggtgccaatgctgtcattttcatctaggcattgtgtcttgagacatagtgaccgccatcagaagattgtccgtccgtaggcgttctctttttagaaagctctacttttctttcacgtgtatgggtgttttgcttacgtgcatgtctgtgtaccatgtgtgcacagtatctgttcagtccagaagatggcatcagatccactgcactggggttagagatgattgtccaactaccacgtgggtgatgggaaccaagagcagcaagtgcccttaaccagtgagccgcctctgcaggcccgcgagctcttctcaacaacagtgcaatgtagtcaggggcacctacatcagcactgagactctcttccaccaggaaatcttactggatcagttggctggtctctaccctataatgttctgcttattctctaagtagagacctctatccataggtctctatccatagatctccttaggaaggttctcaaccttacaaccttctttctacttcataactgtaactttgctactgttatggatcataatgtaaatctgataagcaggctatctgatgcatgaacctcggaggggggcgtgacccacaggttgagaaccgctgctttagcatctgtgtttctgggcatttggaggttgcactgtgatttgtggacacccatactatgtgagcgcacatgagacccccaacccttccggaggaactctgggcaattgacagttgttgagtggaagacagacatttttctcagtggtgtaagccctggtaagaaagatacagtgcttttgtaaatatgtctttatccatcctcctatacatagccccaaataaacccatttcacacacacacacacacacacacacacacacacacacacacactacacacacacatacacatacacacactcactcacacacacactcatacacacatacacacacactcactcacagactcactcactcacacactcactcacacactcactctcacacacactcacactcacacactcactcacactcacacacactcacaacacacacacacacaacacacacaagtaagtaaataggaaatataagataacgaacatcttgcatttgtgtattaatatctggattgtttctggagaagcagtttgctgtggcacacacagagaatctttaggagctgtcttgttaccatgcacgtcttgttggcttcagcctttaactgcctaagacttgttctctgcaacccttcctcagatcagtcctctcaccgtgcatagttctgtgtcagcatctagggtttaaaataataggaatatgagtgatggagagatggcttaatgagccccagctactcttccagaggacacaggtttgattctcagtgcccacgtggtggctcacagcccaccatagctccagtctcaggagattcactgccctcttctggcctccatgggtatcaggcaagcaagtggtacgtagacatgcaggcaaaatatccatatgtacataataaaataattttttaattgagaaaataggaatttcagtgactggtgattgcatttatcaaaacattcacgaaaagttctttggagagaatgttaggaaaatgatctgaccctgtaacagctcacccactctgtagaacccagccatccacagctggaaaagtggcattgcctccattatgtggttaacaaagaggactgagtttggttcctgacataccgttgtctagaaggttctttcaaagaagtgatattagtggctatagacattctgggtaatattggctagatttaaattaaaagtttgagttgaagagaatcagattgtctgagagggaggaaccatctgagatgttcctgtggaaccagagctcagctgtgacaggcagactgtgagtaagaggtagggagcaacccgtcttggaagatttacatcacaaggagggaaacacattagtcacttcatcaagatgagtgctgccgatttaaggactgttttcagtgtctttgaataatttctttcccccaaatccattgctgccaataaacacgaacaaacagaaccaacttttacagtattagagacactcacatgagtgaagatcttcccccaccccatccccctagaaagcctatgttaagcctatgacacgagtcgctcacaactcacttttggatcaaacaagcatgaaaaatcaagtctgacctacaagtggttgttgccatcatggaatgaagggggttgaaattgagttgtgttttttgtgtataaggggagagcttattttaaatgattagaaagtacttaagacaagttcctccgtacaggtttaagcagctttcttgcttgcagtgccgagcatttacggttacttcagcaggctaatgctcatcatgtgggtctcaggacagcgttgtttggttagctgggcatcaaagactgagcacaagcaatgttaagtttccagaagaaaactgctcaacctgtctttctttagtaagtattccacagtgtctgtcttcttagaagtggacagagttccaccaagaagaactgtctgggtctcttcttggtccctgttcattctaaagacacaaagtccttattaagagcctgctctactgtagaggagtgctctacagtccagagtggtgagcctggtggtggtcccttatctcttcttcaagagcctcagtgcccagtaaggaccttcacccttcacgtttgcttgtgatgagttccaggtgacttggatccctaagagaggtcttgaacctcactgtagggagcccacacatgcttcctacaggaatgggtgagagtcaaaggctgaggacaaggggaaaagctcaaagtgaaagcttgcatttgtatcttcgacgctggaagttcaagtctgtatttctcatataataccatatttaaagccttaccctgaaggttctctcttactctcttaacttcttgtgtcctgcctccaaaggtatagcacaaaagtgctctgtgaaagtatttgacaaaagatggagttgcctcccctcctcccataggcattcataaggggtgataaagaggcctgggagaaggactgagtgttgaaagaccagaggcatggaagtagggaaggagcaccccagagtacaggccaggaggaccatggacagtctgcaccaggaaggaagctcttgttccggacgacatcccctaaagcgtgggtattgctgagctccgaacgcataggctgagtcagagctattttaagtccctagacctttagcctcagagtttaggagcaaataggaagagaggagagctcaaaggtcagacagcctgcagccctgggcctttgcaggtcttctgcagcttcagtttccattctttatttagatttcaggtttatgcagctcagggtcattgatccttgcccttgagcagttaattcatcgttgataatttgtccacacataactgaaatcctggattctcagaatgttgtttaagacagcccatcgtacgacgattcaacccagcacttccttttattttgaagttggagtcaaaacaactgtttagattctatctggtaaataagtgtttggagagcatcgttgtgcactgctcttaagagtgatcgtcatcagcttcgaggacagtggtgctcagccatcctaacgcttttatacagttcttcgagtgtggacccccaaccataaaattatctcattgccgcttcataactgtaattttgctactattatgaatcgtaatataaatgtctgatacttccgatgtgtagctgtccagcagtcatggatgaactgggaacctgaaagggaggctggaaatgaaaaaggacaggcgggcaagataagcatgaagccaagacaaaagtttctgatccaggctcaaagtttaatattcagcactgtgtttatatagggaggagcccactgacccatcctttgtttcagctggattatgttgcaaacacactcagcaggcagtctgcccctgtaggaagtagcaggtgctgcaatgcagacctccaccctaggttggcagaagaccaactgtggcaaacacttaaggtctatttagcctgctcaaggctggggaaagggcacaccaatggtcttaggtgacccctgtgaaagggttgttcgaccacacccccaacacatcccacatcaaagggatcacagctcacaggttgggaaccattgctctaggtatttatgacatgactaccattaataactaactaattaattaattaactaattaattaattaataactaccatggttccctgcctcctctcaatatgaaggccttgtcagtgttgatcttgttggtcttgactgtgttaggctctgcctttacacagagccaggcacacaagaggagagtgagtcacctatgctgtgggaatgacgttaagcagggcctctccagtctcaactccatgacactgccttctgcgatcgctcctactttatatagacttggttagtgagatgctgccgtcacggggagcatgcgaggatgaaaattaaggagattttagattggcctgaggggagggatttggtcaggttcttgacagtaagcataattacaggccacttgcacagaaaagtagttttctgggaaaccacgaggcagctcagtgacacatcagggaagctggaaaatcaacggaaacaggtaaggagatcagacacaaccatgtgcagtggacacggacaagggagccacggtcagggcagctattgttcccttaccttcatgccgctgactcggaaactgcagtgtcttaaagtggtcaagtgtcagcgtgcctcatgctcccactgctcccacacagaggtaaaccctgagccctggccgatgaagtctaaaccaggtcagtatggacagctccatcctacagtgtctaggctccttggcttaaagttccttctttgggttttgtcttttggttttgcagttccttcacttgtgatgtaggtagtctagcaaatgggcaaacgtttaaatctgtccatgtaacacacaataaatatttttgtgagttaggaaggagtaaggaagtggactttttgaacctgacattgtggaccttgggagaagacagagatcacagtagcagcagcagcagcagcagcagcaggagaaagaggaggaggggggaaggagaaggaggaagaggaggagggggaaggagaaggaggaagaggaggaggaagagggggaaggaggaagaggaggaggaagagaatggaggaagagggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagaggaggaggaggaggcaaaggaggaggggggaaggaggaggaggagcaggagggaggagctccttttgatttctttcgccacccagtccaggcacacatggaggatgtgatttacactttattttgtgggagtccatagccttagattagctgtgggatttggggtacagtgtctatcttcttaaagtctagagagtcacctctaaactctgagagatgataggaccatgtcggagattcgagggaaatcatatgagctcaccaggactcagcaaacgtggccacttagcatcatgaccaggggcttgttcctcatgttgaccctagcctggacatctggggtacttccaccccttgacaatctgatatgtgttgtagcagctgtctttctttcccatgctaacatgtacacaccatgagggcagagaccttgtttccaaagggccaagaacaagtgtgtgtcatccaacagttgctctgtgaattcttgactgactgactccttcggtatgagaggaaacagagaaattcatcacccatggcagccttctgagtcctactggctctgtcctacctgggttgcagccaagcttggcttcctattggagaccatctgagcccctgcctgtgcctgccacttaccccagcctccccaggcccagggcagactccacaggttggcagccatttagttcaatgttgtaagactcactgggagttgctgtcatttggatttattattttaattgttttatagtttatacctgtgccctgcagtgattttccactaaatctgaacatttatgtttctagaaaggagcaggcatggttgtgggtgtttatcttaacagccaatctctggcaatacatcttcttcgccgtcatcaacagattagaaaattaatgtctagctaagctccattatggactgttggtgcgagtgatgaaaagacagagtttggctcgtccagttttaaggttttaggagtaactgctttcattgttgtttttatttctatcattaaaaactatcaggttggttaaaaaaatgcaaaattggaaagggtccaagagcaagaagtctaagtcactgagaaggacatgtctgttgagtttatgtaatgtgtatgctgcatataaacgcattacatagtatatagataagaatatataaatctgtacaatcgttacatatttcaaagactatatattacacatataacttgtcatatacatgaatttatagcttttaatctactacacatatatatgcaatctgtctcattaaaaatatactttaccttatgtatgccttgttatacaaagaagaaagccaagccatatcctatacaatgaggtgtcattgtctacacagaccacctatgggagggtgtcacctatggatgtggtacagtcagtgatgcttgtgtaagatgaaattgcctaatggcaacttctccaaacatgccccatcaatgagcagcacatattaataattgagaccaagattaggagctacatactgtccaggcttattcttataccgcctaactaaccacgcgattatataatggtatacattagtatgtataaaagtaacacataacttccagtctctctctcgctcactctcttcgatctgtatctctacatttattaaccatatgtatactacacttatgcctcatacttataattatacatgtataacattgctatatagatgatcactaatatttatctatgtggcaaaaaggctacatggtaacatattcagttaaagatctaactggctgttacttaagattcatgaatcggagctgccttcattccaccagacagaataagtttccactgggcgatcgcagactgttaggaaacgggatggtgtgggaaactggctcacatcgggcagcccttttataagggttaagtcagagaagacttcctagtcgctaaggcctgcttatttgagcatgtaactatatcagtcttcttctccctcttctacccccttcctcgccctcccctcttctctcttccaccctacccctagggaagatcagatgaacagcttagtttggtgacagggaccttttgatctgtagtacaggagataatcagggccatccatcccgtaacccacgaaagagccaagtgtagcctaagagataaaacccaacacagatctataaacttaaaacattgagaccttccttgctttttgttgttgttgttgttaatttgattgtgcagttctcaagcgtgaactttgtgggagacattgtgacaggagaagccaagagttgatcacccttgtaagagcttcctgtgaatttccttttacaaatacatgagccaagggacttggaatggtagagacgctagagatacagcgaccaagagagaggttaagagttacctgtgcctggcacatcctctgagcgtgctaacctcatccttagttcccagtgaagtgtcacttggggccataacattttacaggacttctttattttaggatagaatgttaaaggactctctttgacaaactctgagccaccaaagggtcgccctgagtcactttgttttcttgctgagaaatgtctgtttcacaaacctggctactttgttctacttggttcaacttaccctacactctagctttatttagaaaactacaaactggagagatggcccagtcattgagcacactgactgatcttccagaagacctgggttcagttcccagaatcctaatggtagcttacaaccctctgtaactcaacttccagtggttcgacttaccctacactctagctttatctagaaaactacaaactggagagatggcccagtcattgagcacactgactgatcttccagaagacctgggttcagttcccagaatcctgatggtagcttacaaccctctgtaactcaacttccagaggacccaacaccctcttcttgcctctgtaggcaccaggcatgcatgtggtagccaggcatacatgcaagcaaaacactcaaacataaaaaataaaatcaacccttttttaaaaatcaaaatctgaactcaacactcattgcccgagaatggtgaaaccatacattctgaatgttggaacgtgcagtctccaagtccaccacaccctcacaacacttctaggacataaagagtgcttgggacattgtctgaaacgtgaggttagtgtttcccaaagcagagaactggctttctccacagaacacaatttactaatatctcactcataccagcgccctaacgtgaggctcattctgctgtgactgccgcagaactcttctctgagcatgtgtagtaccttgcaaatggctctaagacagccatccagttaaaaagaaaaaacaaacaaaaaacaaaaagcagaaacaaaaacaaaaatgggagcaatggccaccaggtttgccctgaggaagcaagactccatgactgtcccacctggagctccacttctgtcttctaatccagcttaagtcccaggggtgtcacctgaattcagtgacacagaactgatttgcaagccatgcagaaggaccagtggcttagagaaggatgcctcctgggccagaagccgcaggggcttggttgggctggggaggggcagcctggaggaggaagctgtagaggaaagccaaagtggcctggagagcatgcagccagtggggttcgtccgaacgaacgaaggaggtcacttcctgcaggactatacctgctgtcttgtgcaggtgtcactgggggccactaggggccatttgcaattattgccttcctttcttatttcccccggggaaattctggaaatcccctcctggtctcacactttgaggtccaggactcttttctgtcctatggctgtttgttccctgggccagccttggcgtgcagaatctctcttggtccttaaggatgcgccataaacgcctcccttgtgctgtcacgtgctctgctttgcatcaggaaggtccagagccacggatttaaggactttccttcctgggccacagctcactaaagagactctgtactgaggacctctgtcacggactgaccagctcttctggttgtgcttctgccgcaggacttttaggtggctcagtctccctcccttgctgctctgtcacaagcacttgtggctcagggttgggttggctcccatgtctgtcccagccctcctctcaaaccgttgactttcctcctcagtctcccacaacccattttccctgcagaccttcccccgtgaccagccagttagagagcctgtaagacgtctctgaggtgactttcaattcaggtactgtagaactgtgggtctgctcttgacctcactgccacgtctgcagctctctggcacacagtaagtccagggtaaagtcatcagtgggacggcctggagttttattaagtccctcagattgtgtcctccgtgatgaatatgagaatgcctgctccatccctggtccatgtgtgggcatgatcataacactgctcatacacataacacacatactctctctctctctctctctctctctctctctctctctctctctctctctctctctctctctctctctctctctctcctgatcagctcaaatgcaatgcagaggctacaggcaaatactttccaaagccaaactaaacaaatacaaatgtgaaccttatcttcttaattaataaaatctgttttctgtcccttcagaggtcagtccattttcagctccctggccttgaaggaggcctctgatatcctccaagtagcctgggtgacctcctgtttgcaagaagacgtgccttcccaacattgccgtcaacttgtgcagacttacatttgtgtgtcctcagctctttatggaggtcaggtgacctgcaagggctgaccgctctcctagcacgtgggtctttgtgtggtgggacatggaagatggacactagctagttttgccagtttggctctttttcctgacatgggagcttgaagggtcattcactggctttcctgtctgggaatgctggcccttcactgagtcctgcagatcacttcccccataatctaggcatggccctagaaaggttattcttggtccttttgctggcgtgggcctttctgtgatgacagactgttggctagtctaagaactacacgtttctggggcctatgaaaggtgaaacttgccccagcttccttctaagtgctgtggtagcattctgcttgtcctctgcggtgagactcaccactcccagtgttctaggttgttccaggtctccctctacatcccaggctccaccttgaggccaagactgtgttttctcccttggtagcttcaatgcgcatcccaaaacggactcccataaaactcagtaaacattatggaactcatacgaggcctggtgagtgagggatagcttacagtcatccctcacttggctggctactaaaatggactcagcagaggccctgactgttgcttcattccaatactcagtgagcattaagaaccaggcacttcccagggctccagggtctgagttgtgacatcaaggacatggtccttgttctcgtggggttcatagaagggaagccattatacaagcaagcagcctaataataaactgtgaacatttctgtaaagggggtaaccacggtgctatggcaaacagcttctgtacaaagaagatctcagacggagtctcatttctgggaagcatggatgctgacatgacaaaggtccccaaggcaggaaagagtgtctgagtataaagagctgtcttgagacctatgtagtcagagagggagaatgagcaacaaggaacatggagagagtctagcttcagagcttgaattccatagtgtttggaggctttcaatcacagagaagccccggttgcattgacctcttcctgagtgatggggagactagggtagaggttacaggacaactcagatgagctgcctctggtgatttaacagttcccaatgataatttgtttcagtggttctgtgtgttgtttggaaacatggttgccaggcatgggatatgagaaatcacttctctgcttacttcttgctggatccattcaaccgaccactatagagacgtagctgctcaggggttccttcttcatagagtgattcatatgaaagacacaaagtggggccaatgccaggacaccaaggacagatataggagccaactaaagacatctatgtctccggttttgattttgaggggacgtggtaagttgtgaggccagggagtagattgatgaagatggcaggggatccccacagtacctagtcccctgggttcttaggatacgattgaagaatacaagccaaacacagctttaatatgcactaacaaagatttgctcctaagaggagatggtagcatttagtgcacaacagttaggtttgagggttcaagccttgtggcttccagctgcctgcgtatgctaacattgtagactagaggatgcagctggtctagctgtcccatcttacctcatgtttagtcagagaaacacagggaaacaacttgtttgacatctctgtcctcagatctagtctgtacttgaccccaagtaactgttttaataagtacagggtgacgtgcacttgattggtaacatggaaaagggtgggatattagctatgaatgttgtgatgggccttggagcctcttctcatgctgggggatgcaaatactcacttgctatcaacaggggtcaggaaattacccagcaaaagctaagcatgcactttccttgctgtgaactttttaaaaagttgtactttgggttttgtgcatatatgtgtgagtagctgcatataaatgcaaatctccaagaaggttagaagatggagtcaggccctttggaactgaagttacaggcaggtgggaaccacttgctgtagatactgagaaaccaacttgggtcccctccaaaagaagtataggctctcagccactgaaccatctattcataagccttgctatgcgtttgtaagaagcaactggctagccaggcaatcagatacgttattctcagtgattccaagtcttgattcccaggtacacccctaggttatttgtcttggctgtacaccagcacgctgcttgacaccttaagttcttagctgctgggatagtagctgaaggtctgctttctctagataagtctgtgtactgaaaatacccgtgtctggattatcagtcccatcttctaaatgtgtttccatgagtcagaagcgaccacccagtggtagtggcaaggttctgtccctcaaaagggcaaagtgtggacacactgacttcttgggcaacatagcaacgtggctaagcacatggaagtgttttctgccaccagtgtgttagggatcagttaaacaagaaatctccccagacccctttttttctctctcaactagaaaaatgcagataatagtcctccccggagggtgtggtcctccctgagggtgtggtagtacacacatctagtcccagccagctgcaaagactaaggtgggaggaactcgggagtctgagatcagcctgggcaatagaccaaaataataactacaaaagcaataaccttcaagtcgcaaggtggggataagtttaaaaaaaatagattttataagacttaacagtgagcatgacataaaagcatttggagaaatctctttaaaggcagttatggctgggtggacagtggcaatgccagcctttgtggatctcagagttcaaggccagctcggtgtacagagcgagtttcaggacagccagggatatacaagaaaccctgtcttaaggaaacaaaatataaatagatagataaatagacaggcaggcaggcaggcaggcaggtaggcagacaaacagatagacagacagacagatggcagttactggggctgggaaatagcttacagaagacccagatctgattcccagcccccacgtggtagctaactgccatctgtaactccggtcccacaagatccaaagctgcttctgggctctgtgggcaccaggtacacattcagtgtccatacctacatgtaggcaaaacactccaacacataaaatataaatcttatttttaagagacagtgatagctagagagatggctgagttggtgaagggagtttgatacccccataatccatgtaaagcaatgggtatgtggtgctgcaaacctgtaaccctataaacctgctaaggcaggaggatcccggaggcttgctgactctaaattcagtgagagaccctgtctgtctcaaaaataccaggtagagagtgactgaagacctcccaatgctgacctctaacctttgcagtcagggacactcatgtgtacacacactgtcccctggcactcgtgtgcacacgcctgcccatgccctccacagggcagttctttagattttaaatgattggatttgtctgagaaaaggtagattttttttccctcccattaacacagaatgaatcgttaaatcattccactcgggcttcatacttcagtatgcttttgtttatgatgataacagctacccctcacttgcctccctgcgtggcctcatgtggcctttgagtgactgaacattcctgaaagagaggctgggttcttgccacagaggatgccgggcagatgataccagcctgtcattagtgtttgttacaatagcccagggcgtttaaccagaggccagtttgactctactgagaaagactgcctttctcctgaaacattgttattattattgtgaaacatggaggtgtctgaaagcatgtgcaaggagctcttgtattcctctctgattaaccaatcagcccccaataagcagcctccataccacctgccccaagagcctgttctctgatgatccaaattctggcatccctgaagtcagttttctgatctcttctctcgagtaactgcaagaatttcctgtcatttatatggcgtgaaagccgtagctctgtggaacaggcattccaggagagtggagcgttcaaacgaagctcctggtttaaaaacacggggacattcagctcttctctttcagggtttcaagacaagcacaaacattgccccattttttcttcttatctattaagtctcaggtactagccatgttctaagtaccatgtggtttatagaaggaatatggtctggcttttactcttaggggaagctgccaccagattagaactgtgtcccaaatggaaaatgtgacaacctcggggcattgtgaagaggaactcgggctccactgagtagccgcacttctgagcctggctcattcctcagctttgacctaacacccatcccctccaagagccccgagagatccctgtgtggcaccatgtggtggactctcataaagatgatcatagtctgagatatttgctcttgtcagtcccagctcttaaacccacagcactcgtgcccaggaccaccccaccgcacttttaccctctttctagcagaggcagagacggaaagaccctggagcttgatgggatttttttccccactgggttagatgagaaacaccccccctcaccttggtgacttatgcaaaattgggtgtaatgaatactttctttgaaaaataagaatcgctatgcaatcacagctacttaccttcccttagctgggatgcatatttttcaatttcggttatttaaagacgcctgagaaagagctttctcagaccaccctccagtctcagcaacaaacaccaattaacacataaggtaatgaatccacaaagatcctttgggctgttcgcccacccagctaggaagcagcagtgttaggagtcacacccagaaagtctcagttcatacttaataatcagtaacagaagtcagggcccactcagcatcttgcctcagagtatggcgaactgataacttctgttcataaactaccatacaggtgttggatactcatataaccactggggctagaaggggcaaatcacaaaagtctaacttcaaatcatcctggatgttactagtactctctacagttagtttttgtcacatgaaaagcatttccctgtagctgtcactcacaggcagagaacatagcggcctgccaatgatcctaggtcccacccctagcaccacaaaagagaaggaatcacaaaatgtaaaaccagcgcgtgaagctggagagagcgcccagggagacagagctctcgcagaggacctgagttcagcgactcactactcatgccaagtggctaacaaccaacggtgactccaactctagaggagtcaatgccctgtttggctctgaagacactacactcacagggagaaacctacacagctttgcacacacacacacacacacacacacacacacacacacacacacacacacacacacacacacacatttccctcctaccacttctctgggttttctctagacagggtttctctgtgtaaccctcactgtcctggaactcattctgtagaccaggctagccttgaactcagaggtttgcctggctttgtttaccaagtaccaagtgctagaattaaaagcgtgcctccttaaaggccagctattgcctggctaacagaatcaaacatctttaaaaacaccatacgatttctgtatttttttgagacagggtctcactacgaagccctgattggcatggaattcactatgtagaccgggctagccacaaactcatagatatctgcctgcctctggctcccaagtgccaggatcaaggtgtgtgccaccatacctggctgaggagtccttttgttaaagctacatataatatgaccttctctcctctcatcaagactgatactaagagatccatacgataactttcagtattgtaccagtctctggctccctcacagcaagcttattttgggggcctctccctactctcccacctcactaaagaaacaaacatatttattttagaagtcaggctcctccccctcaccccaaactaactgctagattttattttgtttttctcatcagatgggtttttaagtacagggtttgggaatttcctttcttgacatcctttgttttttctggaagaggtctgcactcctgccccaggggagccttggatatgccatcctgcctctaaagaagtctgtccctgtcagtggctctgaccccaggccctgtggctctctcctcaccacagcctgcttttcccagcccagtggaattttctctgtgtcacacaggaaatccagctcatctttcgcgaagtctccgtaaaggtgatcagtcaccatccgtgaggcctcagacgagttgccccctctgaccctcacgttcccatctgctttcaaggtttgatggtgccagacattacctgcgttagtacagccaggattcctgtctcccgataacgaaacaaatactccagaccgatctatatgtcctgttgtttgcgtgaatgaggggccagctcagatccatgactggatcatgatcagtgttacttccactagaatgatggttgtcagctcgaggccctacaagggacatctggatgtccacagacatctttgactatcctaagtcgagaaaattagtaataacatctaaccctaggaccggggatggagctaaacattcgggagttcccaggacagccagcgtagcagagttcttccccaaaggccaaggctgagaaatcctgagccagcttgggactgaggacctgttcttaccctattgttcacagccagtatccttgagggcctctgaccagccagggaaagcagtgtggctcctgggaagtcctcacgggttgtcagtctagcgtagagggaaggagagcacctcggagggcaaaagctatgtatgtggattctgcctaagggacacttctgggaatgaccctcctagaattaaaggctctgaaggtgcttaggaccaacaggacctgctttaatttatgaatgtgtgtgagacacgtgtgttcagatgcccaaggaagccagaggtgcaagtcgggtcccctggagctagaaggacccagaggcaatgggagctgcccgatatgggtactaaggtctgaacttggttcctccaaaagaacaagcagtgctaacgaccgagccatctttccagtcccaggattaccctgatttagagttgctcctgagagtctagtccatggagagtcagacaagagagatgaacccgaaacttaacactgaaaaggaaggaatgatgtgaccattagccgtagatgatctgaaaagtccagaagggtccatgggaaaacttcttaacaaaaactaagagaattcaatatagcggaaaggtgcaatgagaagagtcgactcatctatggaaagactgaagatatcaaacaatagcttgtgtccttcagcagtacgttcaggtacagttagttaccatagagatgagacgcagcaggacttcagtcagccccatggttctgtctttgttgtctatgagtcatccaacccttcctagggcttgatccttgtcttggtggttaaaagcgactgctaacaccatgcacggtagcctcatgcaggacaggagagcgaaagaggagagaaaaagtgccacacatgtgactgtcgtgcatccatgctcagccccagaggagactttgaattttagtttatcgctgtgcagcttcctaaggaagtgagggcatttgggacaatcagcaacctggcataaaacgcaacaaaaaaggctcaggatcggcacaagggaatcactaaagggcacagataagatctgagcagatggaaagacaaacatagttattgaccaagaagtattgagcatcataaactatcagctctccccaagttaatttataactttaaacatgttcccaataaaaccagcaacaggacttaaaaatatgtataaacagacgactctaaagttcatatggaaaaataaacaagaatctgagagctaggaaaatttttgaaagtggagaccagccacacggagtattaagcatataaatctacgataactaagaagtgggatatagaaaaatgttaagggcagaggtgaagggcagaggtgcagtagagactccattttcatatgcaaattttccattcaatggggaacgatggctactaaacatcaggttgcttccagatttctaggaacaaggagagttggaagtgcatctcaaacttctgtcagaataaataagtgcactaatgatttatgtttataaaaatgaaggtaaagcaagagggagaaacattagcagaatgcatagattacttgaaaaggggggaaaaaattcaacctaagacatggaagccaaaaccagtaaaatggaatatccactgaattaagtaaaaataaatgatcttagtaaaaactccagtagcttacaaccaaagtcaagtaataaccctgcaccaagtctgggccctaatggggaagcgctctcgaaaaccaactgccgcagtgtgaagaagcgcgcgtgcatgcatgcacataggcatacacacccacacccctacacacccggactgcagcaacttaagcataatgaaaacaaatgctgaaaaacttctacagaggtgcaaggatgttctgagacactgtttaaacctggcacacaccgaagcttggcagcatagcatgccatggcaaagtgtcacctgttgccaatggaaggttaggaagttagcctctaaggaggacagcttggtgacccactgaaaaggctaaacatggatggcattggcaataaatcaaataaaggttatcacattggttcatctataaggatcatctataaggaaagggggacaactaaaggccttattcttgaaacataaaaaaagtcccagattatggatatgcgcacgtgtttgaggacgaagaagatgaggttggtacctgggcagttgtctttctgaaaaactgttggtcaggatagctaaatacttgttctgtgttgagctgggtactgagtacctgggagttctccaggtagaaagactcacccctgcctcccccacccctcccctgccccaaagctggacctctgagaaggcaaagctgggccaagtctggacctcccagccctcctccctcccagaggcctacagactcctagtggttcatcgaaatatcactaaaagctgcaggtgagaaactccctggggaagtggaaagccannnnnnnnnnnnnnnnnnnnacacacacataccacacacacaacacacatacacacacacacacacacacacacacacacacacacacacacacacagagcttctcctgacaaccctgcactagacaagcttgccccagagggatggacactttgtggtgagactgaaaatctccagagaaatggccttctaatggcagcccaggctggttcccagggattgattgtctaaaccttctgtccccaaagaaagcagtcactcacccttcctgtgtttggttttgtgtgcaaagttaagagttttcaaagattcagatatcagagtgggaacgggaggaagtagccagaggtagaactccgtacatcactggctacagggtgggaaggagtgttttggctaaggccaacccaggtcatagccaagggcactcataggacttgctcatatccaacagcagctgggtcagcttcttccccagggagaagagagggcaggaagcaaagaggccagggaggagtggactagagaaagaagaacaggaggcaggaagaaacgagaggctgtccctaactggccagaagcctatgagaaggaggggtggtgcctgctggagccaaaactactccacctggaacctgagtcagatcagaaccaggcttgtgcggactcggggggtctttagactcatgacatactactattacccttgctcaacccatataaaggaagctgcttcttacagagaagaatttaacacaaaggatgtggccgaagatgttcacctttcacacacttcaaaacatcggtccttcaaacaagtccacaaacatagcgtgtggtcccgagctgacagacaggggaccagcccagcaaggtgacttttagcagggctatgccacagccagtgatgaaaccctgacagcctggatcccagcccagcattcagcccagctttcccaccccagccagagccaagccttgccccctctcgctgccagggctggggtcggtggctagctgcagtggcccagttgtttgggctcactgtgccttctgtaactccggagtatttgcttagagcagcacttttctatgtgattgcttctttctcaaggaatcccagctgtaagcagaaatagggtcacagatacaatgcaggcaggtccagaagcacttcctgccccacctccactccagtctgggtcccatgggatgcctggagctctcaagttgagatgccagcaggcacatgagcatggccctttctgacctctgcttgtacgggaagaggccttctttgcaaggctcacctcaatagcccagagtagttgctgagggagacacaatgtgaatggttactccaaccacatagtctagattcctctacagagccaggcctggggtttgcaggggtggtggaaaaattattttctaccaacctggtttctaggtaagaaatcttagaactctggtgtgttaaaatgggcctcaaagaaaccaccttgattgaggctggcccgctcctgtgactctcacctctcctatacagaaacatctggatctagattatttctcttacctgttacacccagattgaccttgctcaggcaccatgctcctgcaggcagggctcagcctcccttggtatggatttcaaatccctctttccagcatctcagactctttgaagttgtccctcaaagacacagctgtcttgtctcactatggtcaggaaccccgttctctggcctctttccctttgcctctaccttccatctcctttgattgctctcttcacggtctgtccaaatgctagctttcaccgaaccctgagagccactgctgttggccatacatcaacagatgttggctacaccaaccatccgtcatctcccccctctcaaactcagcagctcaaactcttgtggattttttttcctgattcagtgatgctatatatatgtgaccctgaatcccctgagctagttaacttgtgaaggatggaggtcagaggagacctcctttctcacagaaggatctaaatatgagttctaaccctaatatggccccgattctgtgcaggatcctgtcttttgctgaggtattgtaaatgctgttgaaggttgtccagctgggaaatggccctagcctgaggttaatgaggcaggtcaaaacctactccaagattgccttgactggagatgtccctagggtatgtgcttctttctctctaactcaagaaaggccctgtggtgtgtatgaggctaaccatgtggccttgacctgtgttgcagggatttgaaactggacaacatccttctagatgcagaaggccactgcaagctggctgactttgggatgtgcaaggaagggattatgaatggtgtgacaactaccaccttctgtgggactcctgactacatagctccagaggtaaggcccacccacgtgcagagttagcttctctctcttagcgtcagaacagagaaacaacccaatgccgtgcatgtgggggtcatccgaggatgccaagagaagactctgcaaaagccagatggattctaggagtaagagacaggaagggaaatggtttcatgatttttctgtaaggatggagtggtagtgaggatggactggtgagctgagagcgaccggctagtccccatgcttgagtaagtcctcgctaagtatcatgcatccacccagagctaccgccagagctcggactaacaggaaccggttgacttgcaggagagttttcacttcttactgaatggaaacattgaaagcccactgaagaggcagccaagtaacttcaccagatgtcagataaacagcaaaaccaggaatgctttgccatttccactgaggtagcaagtctgtagagtgcgcatgcacataggacatgaggacagggtaagcaaaggtcagaggtgtctactatgagctttacctgtgtgaaagttgagtcaccatgttgtgaccatttgtcttgtgtccttccagagcagtctgacccaaactgagaggtccttagcatgaatgattcaaacttagccgtgtagtcacacagacacttaattaaatgccttcgatggtttttgagacacgtaagatgggaggcaggtaccaagcctattaagcactacccgtgtgtagaaagccgcttccatgggacatcatctgagcacctgccagacaaagctctatggacatggagctgactgaggctctggctgctcttctaagagagcttttggtctagacagagtgacaccgaaacaagcagagcaatggtgcctaaaacaggacagggcccacaggatatgggaaggcttcacggagcttccaagaccgggaaactgatcggcaaagagtacattttaggcttgctttaaccctagggatgaggagagcattgttgaaaacaagaaggatcagagtgggagcgtgcagagaagggaagtccatttctcaaggctgcgaatcctctcaaggcagtgtctgggtttctgatctgggtactacacataggttctaaggagtggtcttttgactgagtgagtgagtgaatgaatgaatgaatgaatgaatgaatgagagacatttcaacatgaccagaagccatgggatgaaaacatcttggccattttcaggaaatgtaaataacacagctagagagctggcaggatgactcagcaagtaaaagcatgtgtagccctagaccacactcaaaggtggggtgagagaaccaaaggctaagcgttgtcctttgacctccatgtgcatgtgtgccatgtgacatgtggcctacacacaccactctaaccaataaaataaaacacatttcaaaaatagtagagatagagcaaatggtttgttagtgcttgtaataatgaacaaaattcaggtaaaggagccgggaacatgaaatcaatcccgcaggatctatgggcctgctaagggtttcaacgtaggagaatctttatcatgtccatcctgggaggaatacaagcccccagagcacacatcagcaggctgaggagagccttcgtgatgcacacccagcaaccacgtaaaccaggcctatggtgcaagactgtaatcccagcactcaggaggtgaaagctcaagcctgaggagttcaaggtcaccctcagctgcatagcaagcctgcggctaccctgaagttcctgagaccctgtgtcacaaaatattttaaatattctgatctcagtgaacttgaactggactggacggctggaggatgaaattgtttacattgcatattcctctcttggtccctggggtgatattgttagatatcacttcctcgtatatgtctcctggagttggcgcagcttttccagaacattccataattgagctaactgtggatatagaacacctgttgggttcacccatgtaagtgaatcagggtagcagactccatggcctccaacttggaatctgagtctatgtgtctttgaaataaaattcttatacttcctctttaagatgcatgtacaaagatgttctaaatgcacagagaaggattcaccttgctttttctgtagccattgataccttgatcaatactgcaatacatccagtgaatgtctgatcatactgcaatacatccagtgaatgtctgatcatactgcaatacatccagtgaatgtctgctgaggtttctccttaagaaaaggggacattgtcattgtatccttgtgctgacatggaacctctagttttagaattcattctcaataccgagtgaattgataaagttttgcaaaaaatcgaaacgaaaggccgaggaagggacaggcctccaggcttctgtccgcaggtcagacaacacaggtggagccagggagagctcaggagtgaggcttgagggcccagcagctcagtgcaccacagagctctgatcttctgaactaggtagtcctttctgttgtgtgctcccatagcgagaacaccagccagccaacagcacagagacatagatgaaaggaaggcctcccctgggacttatctttaccaggagagccttccattcccacccctctgtgagccaatgccacaacggtcaaaggcttgacagcagttaaagatctgctcaggaaaaacatgcgcacagctcacaacaaggtctggccaagtgtagctccctcccctggtctcttcactgctgggttataacatggggtatgagaaacagtcccaagaattgagtccagacctgcccagaatgtcctcatatgcccttgatatagtggagaagtgtattggagccttgggttcctgtctttcccatgggaatcctaatgcctgctctgcccagctcagcaagctgcgttaagactctaataggattagaggtgggagtgattcataaggcatagagaggctagccttgaaaccagagccaccttcttagtgatcagctctgccaagccgtctctacccattcttgcacccctgggcgacacaccccctagcacttgtctcccccccaccccacctcccatccccgatacactagaaatggctctcagttccgggtcacacccggttctatcagggcctatacctgtccttctcttttacccttgaacctctcaaggggctggcttccataccagatgccctccgagggcacacaaaagcattaccttatcttccttaccagctccattgctggcgaggtgatcaggccaaggataatcagggctgagccttaagggaactttacaaaagatttcaccaaaaccaagtctggataaggctacctggccatttccacagcaccatccagtgtgagcatagatagacacgcttatagacaaaccgcggaagtgcaggcgccagccagccatgaagaaacggctaaagtggtcaactggtcagcagggcccctgagctgcagagttaatgtggtgcactgagtaagagccacacggtgcaaggcatggagtggtagctttgttttaagagtacgcagactctggaaaacaaccgacaataactctctggaactttccagatgctccaaggagagagctgactgtgaacaagtgactgaaaacacagtattataagggaagtgcccacaaaccctaggaacaggcaagaccttagtatgtcagaggacagaagaccctgaaagggaggcaatctggcataggcatgacccggaaggacagaagccagtggtacagaggaaacttggtaagccaggctgactactaggtctcaggaggttgagggagcctaagctttgcctgggcccccagccagtgcagcctgaagttctgagtctacaggtctcctgcactaaccactggacagagaaccccagaggctaaggaaacaggtcgtcagacagaaatactgaagaggcagctgaacgtcctcacactcttcttcatcccaaatagagaaggttcctaagctaagtgtggacttcgtgtcattagatgttgctactgaattctgtttaaccccaaaggatccaggcttgctgtagaaaggggtgtgggtagcgtgttcttcatgggtccttccagagttaatgctctggctatccatttggccagatacacagtggttgggaggaggggacattgctgagtgtggtcctggtcaaaggtaaaattcacaagacagtcataaactggttgaattttggctttgcccataaggataacataaattcacaaagttagccccagaggaaaggagatccacagggtctgttagatgaccctaagttcattggtgagattcagagaaccagaaagattgatggaaatgagtcttttactgtcatagacgagagcatagtagtctctggtgggtaaaacacaggggcttggggagaggccttccctcttatttccttccatggagcacggggctgaggtaagtgttgtcaccacttaaggaatatcaactttctgtttcaagccaagcatggtggcacacacctttgatcccaggacacaggaggccaaagcgggcagatctccgaatgttccaggccaatcttgtttatatagtgaattctggtctagcctgggctacaaagtgagaccttagctcaagtgggattggggggttgggggaagcaaaagcaacagagattgtggtttccttcctacatgggcagtcagggtgcccaggctatgaatgatgggaatagaactttctgcacagccgatccctctcagcatcgccttttgaagtttacaccctgctcccctagcccagagttaatgtggagctgtgctctcatcttttgaaagtggacttaaatgctgccccggagctttatctggcatgcaaactgagaagtggcctcttgttcccagcagaggttagatggcagatctcactgtggagagaggatagcggctcccacacttaagcctctctgaagaagctggggtagtgccacaccccacacctcagggtagcacagctccactatggcggagtaaggtggacaggaaggccaagacttccctcgagagttgggtgggagagctgctgctggagtcaggctcttaaatgatccctgacactccgtctgtttccccgcacagatcctacaggagttggagtacggcccctcagtggactggtgggccctgggggtgctgatgtacgagatgatggctgggcagcccccctttgaagctgacaacgaggacgacttgttcgaatccatccttcatgatgatgttctctatcctgtctggcttagcaaggaagctgtcagcatcctgaaagctgtaagtgactgtccctcacctgtggctctgttccctgagggcgctcctcccccagtctatccctgacccggggtgtgtgtgtgtgtgtgtgtgtgtgtgtgtgtgtgtgtgtgtgtgtgcgcgcgcgcgcgcccctgcctgcctgtctgcctgtctgtctgtctgtcttcctgtctgcctgtctgcctgtctgtctgtctgcctacctgtctgcctgtctgtgtgtctgtgtgctcaccagacagtttgtccaagatcacagtgctggttcaaggcagagccatgtaacagcccagaagccccagcttttattcctgccttctgttccccttcaaaacaccccagagttcagtagttgaccagtgatattcacaaaaaccagccctgttcaagggccccagactcttggtcttcctttattttatatattttctgaagaaacttggctgtctatatgacagctggggaattttgcagcactcgccatggctagtggaagtcatgacattaagacatacaattattttgcaggggtctggaatcacacgctctgccctgctcacttctctctgcccctctgccccccccccccccggctccatgttcaaggattcatgacttagctgagcctgtgctcacaccctctttgttctatcatggtggcatttgccctgggcagcctcttctctgtctccttcgctgtttcttctgcctctcactggatgtatgccctaccgtgtgtgagtcttgctctacctcctcctcatgtctctaaaagacagaatttttcttgaaattccttcattcaccctcacagcgagttatgccttctggtatactatgggggactaggaatgaggcccgggtgttgcgtgtttgttggcattcatgaagccctgtcatcaattgcaagccatgcattagtaacaggagcacatgcctgtctgtcatacctgttctgggagaaagaatgaagagttcaaggccattcctcagctacatagtgagttggaggccagcctgggctacctgagaccttgtgtcaaaaacaacatcagacagcatcagagagcaaagcgcttgctgtccaagtgtgctgcaaagagtgtctgttgcaacatggaagatgactgctcttcggtctttgtgctgtcctctttaccccagtttacaaggaggtaatatggcaggtgacttgaagcgtggtgggggcagggtttgcttgagagccacacctgtctggggagtgtgtccacacctacctccagctgactgcaggcccgcagccgtcagcacttccttcgccagacctgcctttccaaggagaagcctgaagcccggttttatcctccctgtgaactgacatgaactccttcccttaaaaagagtgtgttggccaaagtagagcttgtaagggtcacatgtgggtgccgcagtttgatccaagcctttgctgtttcctcgctagtgtttcttactgacctgtttggttacgtcacaagtacagtcactctccggttctgagctctccccagccctgcgctctcactagcttggataactaagacacatacataattatttacaatgatagcctgaccacacttctacctgcctgcctcctatactctgtacgcagtgtgaggtttcatatccttaggtggataccaagacgataaagatatggattctcaccgctttatctttcaccattggtacagaacttggaaggcttgctgtgtttccttctcccagaaggggctgtagattcttccaccgaaggctgcgtctgtctgtctgtctctgcatttcgaaaagcctttggggcagctgtcacaggggttctcccaccaagaaccatccctgagtgattaactagggtggagatctgagcctcctgctctagctcccagacccccacccagaccctgacaactgatctccagcaggagatccacaaggagaagaactctgtgcctggcaaacgtcagctcggcctcattctgagcccctgcccacatagcagctaagtgtgtgtgtgtgtgtgtgtgtgtgtgtgtgtgtgtgtgtgtgtgtgtgtgtgtgtgtgtgtgtgtgtgtgtgtgtatgtggtgtgtgtgtgtgtgtgtatgtgtgtgtgtatgtgtgtgtgtatgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttgatactccctctagacacttatccagcaatgtttggacatattggagctagtgcaatcgcagggcacgtggtgggtgcagatgtgtaagggcatactaagacgtaccagagctactgccaaagagcctacagcacacaggacagccctacaagcaaacaatgtcagtagcactgagtacgaaaactgttgacacctggggctggagaggtggcttggtggttaagggcacacactgctgttacggaggacccaagtttcctggcacccatgccagacagttgaaatccacttgtgttttccgctccaggaaactgctgctatctgctgaactctctggacaatgaattcacaccagcacatccctccttacatgcacctacacctcatttaaaagttaaaaaataaatgagagagacagagagagagagagagagagagagagagagagagagagagaagagaaccgttgacctgcacagactcaggggttaggggttatgctgtggtaactgcttaatgtctgagaagagagcgtctggcccagggcattaccgcagggcttcctccttaggctcatctctgctagctgaaggagggagggaggcccatggagggcagaggggaccactgcttttctttggagcccacctccccaaccccttaacttgtcacttaacatttgtagcccatgttttctaagactgtccttagagctacctcactgaaggctgttactcactgagaggtggttcgggatctagagaaggccttttctgtcacagagcagtgaagaacctttgccgcagcgagctgccatcttgctgctgctaaactcagcgcagttccctgagagccagctagcctcccttgcagccttcagtttcctgagcaccaggtagaaggagggaatagagctggtgctgggtgaacgcatctcaggggtcaagggaaggtgcactttagtcagcttataattcaagttgacaagcacacagaggtcaaatatcagaggaggaatcaacatgttgccggcttcttagagaacactaaggcactacaggggacactgaaccagagattaaaagtaggcaacacccaaactgaaacatctccatgtgccaaacaaaagagtatataggccagtgtgggacatctgagtcactgaaccagggtgacttcctggacatgtaggtgaaggagatgaggaccacaagtcatcttcacatcaatgcccatgtggtttgggtttaaggacaccaggggcagatcataagaccccaaccctttcccatatgagatgtttgcttctgctgatgagccttgaaattccaccacagtcaccaagtgtctttgtcactagagatcttttacctataaaacactatacttggtctctaacacatcatggacgacacatacacccctcaacacacatacatacacatacacacatatacacacacacaccacataaacacctttagtttttggtgcatatcaaaaatattttttagtttgtcaggtttggtaaaagcaaacacctttatccactgggccatcttgctggcccaagcatggacattttggggggacaattgaaaattcaaactaaaaccatgagatgggttagggaaagaaagagttgggagggatgtttgataatttgcatacatttgcatacccttagtcatttgcataccgggtggtctttgcctacttccttgctgtgaatgagtgactgccaggatctcagtctctgctgaaaagacatgaatatctggggcaatacagagtcggaatcaggtcctaatctcaacttggtaccttactggctgtgcatcttcagcccagctaacgagcctgtctgtgccttaagttcctcccttttaaagtagaactagtaatggcacctcaagggagatggatccgtatctgaactatgtttagaatgctgtctgacacatgctacatcatatattcaaagatagaacaccctgaggacagataggcccctagcatgtaaacgcagacgtaggaaatgatgtggaagatatcccctcatgagtcacgcccgggaggctccatcagtaactctttggtgtcttcctcccacagttcatgaccaagaacccgcacaagcgcctgggctgtgtggcagcgcagaacggggaggacgccatcaagcaacatccattcttcaaggagattgactgggtactgctggagcagaagaaaatcaagccccccttcaagccgagaattgtaagtggggctcccagcccttcccctctatgctcagccggtactttggcaccagtctgtgtgagcctcgagcagcctgggtatcactgaaaaaaccagggaggagtctcccagaggcgtctgagaccctagacattgactgtcaaaactacgatgcctacagcaccatggtcatacctcccccagctttacttattttgatcggtcacaatgacgctagtttttcacatggcatagagatacatgcaaggttttttttttatttttcccaagagaaaggttttgccttgaaagtgtctacgtaaaggaaaatactagtccagtgctgtcaccatccttatatggcagagtgtaaggggagagccagcaactattggagaaagaccgacccacagtcgtgcagggaggacaacctgtgtcctggcctccatcactgtcccgtctctaatatgtccctgccctctgcctgctcaaggcaccgcatatgctacagtacttccatgtgcagtgccaggcacaggtcaggagtggagaccagtggggcgtggcactgagaagctgaacagtggactccagtcaaggctcaactggggaaccaaagccatgtcctgtgggctaaccgaacatggaagtgttggaagagcaggcaacattatccactgaggtagtcattcacactaagaatctccgctagcttcaggcaccagggagctgaagggaagagtttcttagacagtagcttcagacctatgaggctggcagaagatcagaggtcatcaaccagtactgtcagaggagtctcagcctcaaggacagaaaagccatggcgctagggcttgccaccattcctacattgctttctgctttggtctatgtgattcttgagagatatacagcttcaaacaagtggggcttgggggtccacttctctctgcaaacctctcttccactttagcccatctcgctacagctctgcactcccctaccccaaccctcaccccatgtcatgcccatgttgtgggttttgtagatagggaaggtttgaagttctggtttttagggcacacagagctcatcacatgtgacagcctgcctgatggctggggctgaggccactacaagtcgtctccaaagacaagagcaactgaatactggagagaatgtgtgaagcaggtcgctaaaggcctagcagaggaaaagaaatggaaggatcaagcctgagggctgaattacaatttccatgtagtttaacttaattagtccctagagcgatgagaggcagagctagaaatgtcaggtccaagtaacaagagcccgaacgagaccagctggaaattatgttgaggctctaggccaacgagccactctcagccagattcatggggaagtcagacccagaaaggctagatgaagaagacgaaggctcagcctctcaagagagtatagggaggtgaggcccaaggaagtcccctggaaccatgaagagaagcaaaggccggtgtggacgagggaagccagtgctgtagggaagctcccagagggaaggagctggagccggagccatagtcccgaaggacatttaaatgaatggagtcacggagattaggctcgctctggggcctaatagatgacgggatatgagaagtgaccatgggcctttcctaggaatatttgctcaaagtcaaggcaggctctcagatttaagcagtggtgagaaattccagttcctgaagcatcttttaaagccccatcagtccagaacatcctctctgggttccaatctttagtctggaatacgatctctttacactctaagcatggcttctgtccgttctctaacaaggcatttctgagaggaaccacaccttgatcagtgaccctcacacccacaagttaagagcagaatgacagggggccgtgcagaagagtgtgaggtggcagtgagcctgggatctgggacagaaccaggacaccaaggaaaaggtggaaaagtggggaacaaacaggaacaggcttccacatgtcccactccaccaacgagcaggtttcaccccagctcaggtgggcagagagccccctcaggttgtccctagccagatgggaagatgtttttgtaggtaaaggaatgaggagtccctcgaagccagaaggaggaaacctactgctgggtctgcgatgaggtctcagagcacatttccctgaaccccagtgcacaagactgggcttcccttacctcagcctctgggagacttcctcctgagattacaagcaggaccctgttcgattcctctgctggggattcacatgagcttccggtggctttctttccctttgagagtaagtccaaaggagaagactgggccacatggggcctccaacatctgagtctcctgaaactgtcttcaccatttccattgcaagtgtcttgtgagcatgaccccactgtgcccagagtaccatgttggaagtcaaggatgtacaattcgttgggctgatttatatttggctgaaatgagaaaattagttcattaagtatgaagaaagtgggaaggaagttagaagactgtgctgcaggaggtgtttggctgagtcctgtgggttgttcagcgcttccaggcacgagtcttcaaggcgtttaaatatctgatcacatttttatctatggaatctgcaacctctctcgtaaatatcaaatttgtgaataaaaagaaaggagattgaaagagagagagagagagagagagagatagagagagagagaaagaaagaaagaaagaaagaaagaaagaaagagagagagagagaaaattgttattaaaaaggtgtcctagctctgtccccaagctaaatctccttcctgagatatggaaacaccactagtccgtagtgcctgcatgctcaagactggcaaaagacattggattgcactgaagtcattccatttatcatctgggcaaacctcaaaggcccactgtagaaagaaactcagatgggtttttttataagccactctccccacggagccaactagcatcgagatgacagcctagcccaggcagttgccgagaggcaggccagctctgtgcttcctaagcagatgcagccttggacaatgcagtcacccacaggtcactgggggagagagctactttggcataatgctacaaagtcatccccatgggtcagaggttccattattagactggctttccttggctcaaggtgtcttataactagagaacatgtcatgtgccttcctaagagagctcagtaaggcctggttttgacagctgaaggaaaaagaaagccagttcaatgctggaaagaagccatgaggacaagggaccgctatcagccagggacactgtgagattcttggatcctgtcttacagactggtgtcaaataaagggatgatactgtgtgtagaaaacaagataaaaatctatgagcaaacagtaccagccacaaagagacaactggccacaagtttaaacaggcaaatgaggcagagtcagaaaagcccatacctacaaataccaaacaccttgagagaaatgtggtcaagtgctgggactcttaaaagagcctgcattttttttctctttggaatcagctccacttgctctccagctatgtcttgctgaccagaatgccaccatcccacaaaaacctagtcagtagccaatcccttcacttcccttgctggccaccacagcggagacatccagcaggtgacctgcctgttggattcaggaaagactccattccattgagcccaggagcggtcatagcatccagcttagtatttgagaatagctacagtgtagttattttgtgtttctagagctctttaattctcctcaaactcaccaaacagccagatttgtctctgccatgcctggctcacctgggagggatggggggggggggagctgctcacacccacatcagaacagcttccaacctggctcccagcccctccacaggaagcctcctgcctctgaagatatatcaccaagagattgtccagattgaaggctggaatttagcctctggtcagtttccatcacatacctccgttggctgctgtggctgcaggctatgtcttcctgacttgtttgctaagctgagattccaatgcccctggtgcctcagcttccctgtctaacccctcctgtgattccccagacgttaggagtgcagctgggtttccagcctttagatcgtcacccctctgtgctggcctctacttcagtatggaaggcttctcctcatgtatcctccgatatagcaacgccttccctcctcgagacccctgtatattcctcctatccctgctccatgcagccacacactgaactggttttaggcaagtaatgttccatcaacaccaaaccaaaaattccacggacataagatctaacggacaacaactagcagagcctctgatgctacagataatagccaagcaggaacattttgtctcattggagatttccttccaagatggcggtgctgtctaatcgctaacacacgtacctctcattgagcgtttgagctcctggcaggcttatctgttgggggaggaggaccgtagtgggaagagatgtatttggaatggatgccagtgcaagttgttgggctagtagctcgcttctggccctaattttttgaatcccgaagcattagattctaagatcatgggctcctgggctttgacattggaacgggagcaagccagttaggagggggagagagctgcctccccatagacctagctgtcctccgagaacgccaaaggccataagggaaatgccggccaagtaaacttgtctttgtgtacgtgttctttcttttcaagtttgcttcagtgtgaatgtccctctgtcaggtaaggcttccagagtggggagtctctccaggtaggtgagcccacaggccggtgacatagaggtccccttcaacctcatgatctgtctccattcagccatccacgctgcatggcaggaccccgagggaggcccctcctgcatgctcccgcatgactgggctgtgctgagagaaaacctgggaagtgggctcaagaactcacaccctcacttacttagccccaggaggagccctgctgggcaggcattccctaaagctagtccaccggcccagggacccccgatagcatggatggtattgcagagaccagtgagaaaccatcattatcttccatcctgggtggaccaggcccaggattttgctgggtccttcagtaaaggcaattttcaaggcaatgtccatgtcagagtgagatcccttggcctctaagagggcgttgactctcgaaaagagctgtagggactctggctcaggtctagaggccgtggggaaagtccatataccagtgtttggtagcttactgaagtgatagcatggtacagtggacagggaactggctttgatcacagagagaccgtgagtgctgtcacaggaaagccttgtgatcatgagaagtcacttcaccgtgaccctctgaccttatctgtaaaatggagtgagaatagttctctcatataattgaaaacatgacaggtagcaagcctagaccattagcaagcctaagacactttgtgtacccccgtcctggcttcttgggtgagttaattcctctctcccttcatgactccttcccgtagtctgaaggctcttttcctccctcactaaggctccaggaaccaacaggttaagtattacagggaaacatatgatgtttggaggctgggcttggaaatcagatacaaccatggccttccactctggcctatgggatcgtaggatgatgaacactgtgtctgctacctagcaagaaggatagtgaagaggaacaggagtctaagactggggaaggctggcctagattccccccctctaccacacagaggtcaagaaagttcaggttactgggtggtggcaccactcggggcagtagccagctgaagaccaggaaggcatgcctctcaggagttatgcagagactgctgggctcaattgggctctgatggagtctttggtgctaaagagggaagctcaccaaatgggggattctcaagtctttgtcccttttgatagtgttaaatgatccttcacagtatgtatgatcactttagttttcagactaaagagctatgttatctagactaggctggaatactaggctatgtagctcaggctgttttaannnnnnnnnnnnnnnnnnnnnnnnncctccctccctccctccacctcagtgctgggattatagacatgtaccaccacatctggcacaagtctttttgctgtattatcactgtgtgcgttccctctgctttcggtctcagtagtgttttggatgaatgaaagctgtatggcttttggtaccagccattttgctatctgagaattctggttgcaggagtcttcctgtgggctgtggtattagtccccccccctccccccaacaatgtcataagtaccccgggaaagtgcctgactagcctgttctggatttgactggacatttctttaggctcatgaattttccattgtagcttactggctgttgagatgggctatgccttcgtgggttcacaaacatagtatttattgaacttaatttcctcctcgctccaccaatatttgaacatatgcacacatcccacacctacttgttgagagcatgggaggatcggtgaagctaaagatggtgggaagggagagaagcaggagaaatcagggccagcttcctggagaagccaagtctgggcagggaaagatggtgatggttagggagagagaagcacccgaaaaaagatggcttcagaccacttctaatcagtgggatttatggagcctgtgcctggtctgttctctacagtcctgaaggacttactgctgcctggcaaaagcaaagaaaaactcttcccaccaacactcaaccaacagaagctaggcagagttagcgtgcaggaagagacaaattgaaatatgtagatgataatagtgactacgggattcagggctttgataggaccaaagagagatgctataagctttgcctttcaaagttacaagacagagaaagacaggatggaaaagaggctttcaccagactggctggaatccaggtcctccatgcacaaccccaggagtcttgttaggtcatgtcctaccctccatcttacagatggagccaccttgctaaagaagcaatgtcctcctgtctgcctttgtcttgctaagagctttgaagggttggccagcagccaggagtgcagggacagtgcttaggggctggctcaggtgtggccaaggaaaatcagaaatgatcttagccctccctaaggaggggctcagtcctttaaggcctccagcctacgtttgttctgtgcagagtacaggtgtatagttatgctgtgcatgctcatggggtcccctgcctgcatcatcctcaaagttcaggccttgaatctccatggagtcatcagtcacgacagaaagaagccaccccaagtcacccccaagtcaccctgttgtttgtaccgggaatacgtaaggagcaagtagcagacttggatgtaatctaaaagtaatgttcaactatgactagaattctgggagttgacaaatgcacattaggtttgttgtctatgatgactttatgtcaacacttatcttttcacagtgaaggggcttggccacaggcatgcaagccatcttcttgccctggtggtttctggagtctcacttctgagacataccaccttgaagggttcccatggagcacagaatattatttagcatgtgagtccagataagtcagggctgctaacggctgagccagtgaagcatgaaaccctttgccttgagtagagacaaatcctacggactatacttgtcaaattgagatgacctgcagagtgaattacatccttcctggagaccgtagctagcctccctccttcttctccctggttcccttagctccaaacaacatcaattcacccttttctaaaagagtgtctttccttttctttttgaatgtgtgttcatgtatagtggtggtgggggcgtgggagtgtattgcatagtgcacatgtttgcaagtgtggaatgagaaataatatccaaagtcattactcagctactgtccaccttggtttttgatacaaggattcttcgttgacctggagctctcagattagataggccagttgtccaatgagttggtggcatctattcacctctgccttccaatgcttggattacaagtgtctccaaacattgcgtggttccagaaatggacttccagtccttgtgcttgcctaggaaatgcttgaccaagtgaaccatctccatcttcttggcgtttgaccttcctcgtgcagctgccacttccattggtttgctggaactttacgtaaacaagccacacagcatgtctattgtttgttcgtgttgcgtctttcactcggcaccatgcctttaaggatagggttctaggtttttacgtttttatcatagaaaattccaatcatgcattgatgtagtgacaagggtccagtgggctgccttagacctgtgagccaaggtcaaccattacttctgctgagggagttctattgctttgatcagaggtacatacccactcccattccctccctcaaccccctcttaggatgcctcctgtatttgatcaacttggggatgagtgaatgcctcctagatctctacaggactcgctcatccagatagtatttctctctcaggttcatctctaaattctcttttcaccttttatggcccaagacccatgcctgactatacctggaagtttaggataattagttcctatattaggaaacctgacatcgttgttgaatagggagagaaagtgggtggcctcaccttgacgtgagaggcacacatttgaatgtttaccatccctatttcaaagccagccagcagcactgcaatcaatcctaggccaagagaactgatctccatctgagacattttcataaataaggtgaatggggaggctggtgcatggagacccctgggctatgctgagaccagactgcagtttccctcttgaaaactctagctcttagcaacgatactgcattgaaatgttctcagtaagtggcagaggttgccacagttagcagcagagtgagctcatgtgtgccatggtatgctgcctgctgccagctagatacacaggcactggatggtactgctgtgggcccagctggatacaaattgctcactgcagagctctgctcagtggccttggcctaagatgccgcagcaggccgggtgatagctctcctagaggttttcatccccttaatttccatatcatgctcagtcccttgggcccccaagcccttttccttgcacttcaggatccacccagaagcagcctgtcaaattatctcagtgggaaaagaatctgaaaaggcagagggtacaatggggtgagaataggatagacaaaacatttgaatataatacagagcacatcacagatggtacatgtatggtttgctgaatctcgggtggtcatgtgaaatgatatgtattagggcatacatacttacatacatacatacacccccaaattcctaagagctattaattaggtacatgctgcacccataaagtataaaaaatgatcctgaaatttttgtacacatttattttagtttgtgtgtgtgtgcacatgcacgtgtgagcatgcacacatgcttagctgtatatatggacatcccatgcatgcaagagctcacagaggccagaaaaggtgtcagaccccatggaactggggtttccgatggttgtgaattgccatgtgggtgccgagaaccaaacccaggtcctctgcaagagcattcacttctcttaaccactgagctttctttctagcccaaacacctagctcttaatacccacggtggccgctgcactgagcaatctgagctgaatgcattttctttatagtacagctacacacaactggcagaaatcgtagagcttgttccagcctgtccatcaatcaccacatctgtgcctcctgccaggacaccgtgacaggaggcaggatggcacaggccagggagcccagctgcaggtggaacaagatgaacacacgtcctgactcacagcttgccagttggtgctgagggcaccgtgggcaagtcgtttaatgcttccaagccaggttccatcttcacaggaggctatgtcggggttgacctctacagagtgggtgcagacattgtgccggacacccaaagcaccctgtccagggtccaaatctaatcaggcctgttgttctgagctttgtagcttctttccaagaagaaactgagggcatcccaggtaccagggcagagaggaacactagacagatacccacatggagctccaggctgtgaaagacagccactagtcagctaagctttgagttccaagtgctgagaaagagcagtcttcccaggcatgaaggaagggaggcggaggtgtaagacagtggctttggggatggttccccaagcaagggcattcctttcccatacagcaaaggcccctgtcctctgcagcagctttcagagctggtaggccacattatgaaaggtggttaaccctctcctgccctcagttctgctgttaaagatccactccaccaccaccaccaccaccacccctcaaaccagggaagaagagttttgtgctctctgctaggccctgcagagtgcatttgagggaagtttgcatggcaggcctgggctgggcatggcagatgacagaggttcagcaggcctccttgctctgagtactgccagctttactctactcagagtatggttagagacacctttaggccattcgtgaactctggacctagttgtgtccatgtgctctgtaggacaatgtggattcagttggcaccgaggtgactcttagctgagatttcagctttagtctctgttgccaggttttatagtcaaatggtccaagccaaagagctctcatgtatgtttccagacaggccgggacagttggtcatgggcagtgcccactaagcctctttcccaagaatagggacaaaagtgcctggagctaatggtctctgacagttgactctattgtccttaaaggtccattttggaaaaattctctgatacacggtctatgagcaggaggaggtccccggttatttacagtctcctctggagagcgttcataccacagtcatcgaagcctgaggtgttcctctcgctggggactcactcctgtgttctgaaggtcttaagcaatgggacatttccagtcctggaaaccttctgagggcttgtcccgggcttgtccccgcacatgtgttattcacagagagctgtgggaccatgaaagtcaactttgataaaggacttcttcagtcagtactgaggatgaacccagactcttgcatgctagtggtagataagtgttctaccactgaaccgcaccccaactctgaagcagtgtaccacctcccggagaacctaccatagtgcattctcaccaggaaaacctaaatttgccattacacaaaacacagctatgttggttcaggagactctgaattccctccttgaatcaacgacttacccaggtgtgaagactggggggctctgatgtccgaatctattaataaagtttatgggtgtgctagccagggccatccacaggtgcacactgtgtctgtagtacctttgtgctccaagagtggagtggaattgttgtgacagagaccacatggctcttagagcctaacgtgtatactatctgaccttttagagaaattcaccaactgttgctttagagggtgtcttagtcatccaagtgtctggaatggcctttctcactgtcatgacaaaacacctgaagaaagaaaaggcttgctgagctcacaggtggagaggcggggtggcagaccccatgaatgggaagctatactcagctgcctccctcctccccactttttatttggtccagggcgccacccacgttcaggctgggtctccccagttaaaattatgtagggaaacacccctactgatttgctcagaggcactgggtcaagtccacggagagggctgacactggcaatctgggcacccaggagtgctcactttacactctacacgttcacttaaaatgtttcaaggccgtgggatgtggtccagtggtggaagnnnnnnnnnnnnnnnnnnnnttcttccaaacaaacacgacagctttgggggaactgttttgttttgttttttgtttcaaagagtatgccacaaatgtttggggttttgtaactacctgtcctgtcctgtgacggagggctgtgcttgtctgtgaggtccagccaatgcagaaagagtaaccggtgaacacacttgcttttacaaatagttgttgagcgtgaggacagaggtgggtggtgctggaattctcaggtggcttgcccttttcttctcctaaagtaactctgcaaatgggatttatctttaacaagactttaaatgtttaatttttatttatttctatttatatatattttttaaaccttaaaagtttagcaggcaataactgggaggacgggaagaggagagatgaattccattcagcaggcagcctgacagagctcacctggggccagttgtgaaactcagcagtggtctgaagccatttagttcattttaaaaacacattggtagctaggtgtcgtgacttacacctgtaatcccaacacttggcaggtagaggtaggagagtcaggaggagttcaagatcagccttgactaccaaaggcctcgtatgaatagaggtctcatcatgtaaaagtttgagtacttaagtgtgatgacctgaggttgagccccagaactcatgtgaaaagctggatgcagatgcacgtccctggtgcacacacttataatcccagctctcctaaagtgagatgagaggtggaggcagaaggagcagcctcaagctcatgggccaacagcccagactacagatctgcagagacaagagacacggcctcagcaaggtagaaggcaagagccaactcaagaaagttgtcatcagacctacatgaatgtatttgcacatatgtgcacacacatgcacataataaaaagtatatatacacacatgcattataaataaatgcatatatctataaatgtatatattatgtactttttgcatgtaaatatatgcatatgaatatccccaggaattgtgggtaatgcctttaacccaagcactaaggaaacagagatgagcctggcagtggtggtgcacgcctttaatcccagcacttgggaggcagaggcaggaggatttctgagttcgaggccagcctggtgtacagagtgcgttccaggacagccaggactataaagagaaaccttgtctcagaaaagcaaaacaaaaaacaaacaaacaaaagaaagagctgggttctgagttctgggcagccaagttacagaagggagagagaaagagacagacagagacagtgtgtcactccgtgccccacagagtacattagagaagaaatctgccagattgtgctggggcatatgggggtctcccctctgtggctcctgtgtttcctgtctttgtgttccaaccagctcccccaaccctttttccctctttagaccagggagtggccagggactgaggggctctgacttcagctgctataaagctgatcactcacgttttaaagggaaattggtgttggttttcttctcccattcgaggtgcaagcaacttcataaaatgggagtcacaactttgggactgtggaggcttaatcctctattcaattgggagaataggcagtagccaatcgaacgaatcggcaaatcctggggcgcttctggggagttcagacctcagggcccaagtctgtgctcctgatgggtggcaccgtttctctctcatttctgtttgtttatcattgaaattgtaacttaacgacaacatttctcctcccccttttcttcctccaaaccatcctcgtacacctctttctgctctccttcagatctctggcctccttcatcaattcttattgcatgtctatatgcatttgtatatacgtagatactcctaagtgtaacctgttaaggaaggctcttttgagtgatcacacatttggccatttgctaggaagtgcgaccaggcagaatcctctccctgtgtttcttgatctatgcttggaaagggctgcgctaataatttactttgtccaatggcatttggggttcacgcttcagtgtatccaaccacttgatccttatagcaaatgtgtggggacaatactaatgtcccagtttcatgggtgagcaaatgtagataacaccagagagattggtaaccggagactccagcataaaatctgggagactagagaagatggctcagtagttaagagcactggctgcttttcaagaggttcaagtcccagcacccacacagcagctcccagccaacaaatagaatctaggagagcagttctcagccttcccaatgctcagaccctttaatacagttcctcatgctgtggtgacttccgactgtaaagttataccattgctacttcataactataattttgctactgttgtgaattgtaaatatcagatatacaagatagctggttgacccacaggttgagaaaaactgatgtaggtgttcaggcaaagggcatgggggtgacccactgggtatcctacctctcaaaaagtagcttggaaagagacagatggaattcagcgataaaattttagatgtctccattttaaaaaaaagaaaagaagagaagagaaaagaaaagaaaagaaaagaaaagaaaagaaaagaaaagaaaagaaaagaaaagaaaagaaaagaaaggaaaaggtgtatcaggcatggatagaagggaggaaaccaaaaagaaatgcccacagttagcatgaacttcaaggaactcaatccagaactgtaagttcctgaacaagcttttttcacatcaaaaaggccactggaaacagatgagaaaatgaaagtgatccacccctgccttcatagcctcaagtagttgtgcatccaaattactcagagttttaaaagtacagaggctgggccctacctctgcagagtccctgaggtctgggccagggctgaggttcctgtacagctgtgtttgtttctgatagaccaagagcttccattaaacagtgactaggctggggctggggctccgggaagcacgcttgctaagaatgtatgaaactattggttctatctccaacccctgcctacacatgcacgagcacacgtgcatgcacacacacacacacacacacacacacacacacacacacacacacacatgcacacacaccaaagggcagagctaaatgaagcaaggctacacacacacacacacacacacacacacacaccccaaagggcagagctaaatgaagcaaggctatggttgtgtctgcaatgaattttcccccaaagtgaaacgtactcaaaatacaaagattcaggcaagaactctttagagggaactggaagccaagagaaattaattatgtttcctaagtctcacttaggcatccataatagctcttgcccaggccagacctcagatcagttaagcagactcggctctggagacaggcactggccgccttggttgaagccctctcaggtgattctcatgtacatctggaattgagccgctgcgctaggcgcctgttgctgaaggttctgctgtgtctgcttcggctcatggtaacttgaacataataaaatacactggcagagcccaacagagacaggcacgcaggctcctagcagtcaggagtagtatttaggaaaacatggggttattttagggtggttgttatttttaatatttttaaatgtattatttatgtgcgtagggggtctgcacacatgagtggaggtcagagaacaatttgcaaaattggttctttctaccttgtggggcccaggggtccgactctcaggtcttcatgcctgggaataggtgcctttctttatccactgagccacccttgcatcccttaaagcaagagcctaaaaggtttttaatgcttcgtttatctattgttattttatgtgcattggtgggcttttgcagcatgtatgtctgtgtgttgcatcccctggagctgaagttaaagacagttgggaactgctatgtgagtgctgggaactgaacctgggtcctctggtgctcttcaccactgagccgactctccagcccaaatctcacatttttaatgaggattcatttgtgggtgtttagacagagaacggtaaatcactgggagtcagttaaccttaggctcttagagaaatgctctcagcgtgtgtgtgtgtgtgtgtgtgtgtgtgcacttctcacaaacagtccactgaaaagcctccaataggagacctgtcagacttgtcatacagaaagcagtcagagcccagcttggtgctggggtttaccatgctaccccgggagcctcctggccagaaggccctggagacttttctgatagacaagagttttacattttatttatttattttttaaagatttatttatttattatacgcaagtactctgtagctgtcttcagacactccagaagagggtgtcagatctcattatggatggttgtgagtcactatgtggttgctgggatttgaactcaggacctttgaaagagcagtcagtgctcttaaccgctgagccatctcaccagcccaacaagagttttagaaatgaattccagtatttcacatgctttctgtgttgattgccattgagttggccatcaagggtaaacattatgtcattgtagacagcacaggtctaatttaagggctcccaccaaaggacaggttaacactgcagcacttggtgtttctcagaccaagggcaggaattgagccatctgctctggttagcaccaggtgagaaaggtggatgagaagagtgtctggcatcaccaagcgctcttggcaggttgggagctatagcaaacactgccagggagtcagtattggcctagttccctagaacttccaccctgttttctctatacagaaactccaaaattataaagggagagaagcaggtagtggcacatgccttcaatcccagtacttgggaggcagaggcaggcagatttctgagttcgaggccagcctcgtctacagagcgagttctagaacagccagggctacacagagaaatgctgtctcaaaaacaaacaacagagcaaaaccaaaccaaaccaaacaaaacaaaatcttacataccagcatgtgtgtaagcatatttacatatgctctattggtgagaatatgctaagaatgagtacatgcgtcaaaagatccacttggtatgtgttgagaaaacatcgggcggtggtggtgcacgcctttaatcccaacacttgggaggcagaggcaggcagatttctgagttcgaggccatcctggtctacagagtgagttcctggacagccagggctatacagagaaaccctgtcttgaaaaacaaaacaaaacaaaacaaaacaaaacaaaacaaaacaaaacaaaacaaaagaagaagaagagatcctgattgaattcttgttttttattttataatattatatgaaaaaaagcagaatgtggaatagtggtgtttcaaggttgagaggatagataaaagaaatagaattatttcaaattcataagcatgaagtgtcccctgttacttcgagtttgcggtgggtaccttaggggctatcacccacccatctgtgatatgtgaaggaatgagacccataagacacattagaagagacaaatacaagaggcagtcctgggaagagagggaggtgcgaaaggctggagttgagggatacttgagggacccaaagggaggaggccaggtacaggtatcttgtgccccatctccagccatgaccacgagacatggtctcttggctctgcactaccgggctgtgttgtcattgtccctcagaccagacagaggaagaacatgagagccaccagcaagacagacacttgagggccagcccccatgacacagtctggaagagcaccgtcctcagctagtctggacgtcacattgggagagaggcagatgtcacagtggcttctcccagagctggcattaagatacggctgcatgagcgctaagagagaggcatccttgccagacagaaggtagccagaaaccatcttggtcctggggtctagcatgctacccagggggcctcctggccagaaggataaggtacccctggaacttcgtcccttgggtacagtgtctcaaatgtggggggctgtcaggtttggatctcctgagcctaggcttgcattactgaagacatgccagaggaggtaggaattttgttttcctctaacgtcgacctctaacacacataccccacaaggccctaaacgcattggccttgatggaatttccccaagccccagccagttactgtttctatcttgtactaagcaattagagaactaccactgtgtctccagcactagcacaggagagaccatcaattaggcctaactcccacgcatacgcccctggggctctggccttgtctaggcaatccaatggcagactcttcatgagtcatgccttagtttccaccctgttcccgcctccacttcttcaaaggacaaacccctctggcagaacggcagccattggacctcaatccaggtcgctttgctggctctagatccagtagcagcaggggaggctcattcacttcttccagcagctgcctatggatgtcaacgaatgacaggcatagtgctaggctgatgatggaatgatgacctcaggccgttcgctgcctgctcagggctcatagggaggactacgtagggagtgtgtagaagtggagaaatggcgggccaccccaaggctcctctccaactgttcacagagggatgaacgaggcttcctgaaggaagggcagtgcacactgggatgaaaaaagagcaaccggtgaacacctacaggcaaggaagggggggtgctccaggcagacagtgaagaagctctgtgggcgtggagtattgttcagcagtgcccagatgtgatgccagggtgtacaggaacaggatcctgaaggcctcagaaatgactaagcacaggaccttgagacttagttctcagagttgtgaggtaccacagaaggttccatatcagtaatgtaagacctggggtaaaggcaggcctgaggtttagctgtggtttaggatttagaggcaaagagagagatatgaagggttgttccctagcttcaagatgttcatctgtagtgtactgcatgggcacctgaggagtgtgtgacataggcccatggcacacagcacccacattgatcaggtgcctatcatcctacagggcattgtaaccactaaaatctcatagatagaaagaccagtgcccagagattaacatcagtgtcctaaaggcagaagcagtggtcttggtcgtcctccacccagccttgcctgagtgtggcccagaggttgtgggaaaggcgttgtgggggagagaaggtctgcagagtcagacaatgctctccgtgtccagtgccactttcttgggctgcacagtatggacactgggaaggtatatgggctgaccaaggaaaagagtaggcagtctctctgaaagtcagacttgagctgtggaatcgagtcttggctgtgctctgaagaaagcagcagtgtttcaaagaccaaaattagtgaaggagccaacctcggcccttttcagtttgggggatgctatgctacctacatgccagtgatagggatacaaggtgatttgaaaacttcccaagccttcagtgtccaatgatcaggaattgcctcccatgggggccattaactatttaaattaagcatgggtgactaacatgcacctaaaatgttccgagggccagaagccaagttgtacagggagttctgaccaatctgccgaggtcagcaagaacggcatcctctggcatggggatttgactcagtggtgggatggcgggtgcctgtcatgtgcaagacatgggcttgatgcccagcagtgtttacagttgacctataggagagagaaatggtgtggcctactgactacacccagacgattctgtgattcccacgagagacctagaactgagctaaccaaccctcccagcaagctcatgatagaatcttctccagatgcaccagcggagcctggttcttgagtgtgggcacacggcggacaccagcaccattgctgcgcccaggtgacctcaggaaagcaaaccagtttctgtgacgaatgggcatgagtctgtcactgatggttgatgaaatccgagtgactaagtaaacaaggacagccagtgccaacaagttgatgggttttctggggttctttatgtgcaccctgtcctccttggtggctagctgaaagggtgtaccaggaagaaggtgttcctgaccaagaattccagctcatccttcactaggttccagtggatctttctgcctgtcctattctgtggacctatccccatcctttgcaaaccttccactccgaccaccagagtatgtgccactaagatgtcctttggacagtacctgatgttttacaagttgtcgtcaccaccccttcgtcttccagatctcctggacagccttcacccaacacagctctccctgtcccttagccctatgacccttccctccttccacagaggtcctctgaagagttgcagccccaggacgacttccccagcctccagcctcccacagccagctttcatccctctggggaccagttttgttgttcatctctgcagcagctctttgcatatgccctcccttttcctctgaccttgaaatccctggaggacagcagctagcccaccctgggccagccttccggttggagaagaccacaaccaactgtgtctgagttccctgtctgaagggaacacagacattccccagccacaaatgctgtttctggaaattacttacagtctctctgtttcctctgtcccccttcacagccctcagttcacagtggaactctgctgctgaagctgcaaaaaacataggactgactgctaaggacagggaagagtagcttatcccgttccttcctgcccatcattgtgtctagtctgggtcattgggctggctcccctgccagcctccccactctaccccctctcactgttatgccaaactctctccccatttgcctatgccaggcccttctggctttaactcaaaagcctactggcctcttctaaaaactgtctcctggttggacttaacccttccttgccatgtatgtcccatgtctatgggattcacatctctagaactcctccaggggcaggaggcatcatgctgagacctggatgtaagcttggctctttcccagttgggtaaccccaaccaagccaccaaatctctctgagtcctagtttcctcgcttgtaaaactggaatcgaaaggatcaaatgattgagtgaatgtgaagatgctctaagaagctctggaacagaacctttcaaactgaccataggtttctctcttgggaaaggaggaaatacattattcaggagggcaggaagggaggtttgaaaatggaccaggattcttcctcctagaatttctaagagattttgatttgttcacgtgtgtagcaaccatccaaaagcagatacaacatatagctttgtctcaaaggtgctctctttcacagactacttaatatcgcctttaaggttacggagttctactaagaataggctatttcattattattcttcctagaaagaatgactctgccctttctataagatggaccccatcatctaggtcaataaccagaggcagtgccagttacccagtgtcttatttagggttttactgctgtgaacagacactaagaccaaggcaactctttttttttttctattagatattttctttatttacatttcaaatgttatcccctttcctaatttcccctccgaaaatcccctatccccttcccccaccccgtcctccccaacccacacacactgaggcatagaacccaaggctactcttataagggcagcatttaattggggctggcttataggtcagaggttcagtccattatcaaggcaggagcatgacagagtccaggcaggcatggaggtgagaggtctatgtcttgttctgaaagcaaacagaagattggcttccagggagctaggatgagggtcttaaagcccacacccacaatgacacacctactccaacaaggtcacacctcctaatagtgccactccccaggccaagcatattcaaaccattacacccagtgtccaaagaggtactgctgaagagcctccaactcccgactgtgctcagtcctgtggacctagcactgaaggcctctgtggtcatatccagtcttagctcctgactgtccctcactctgggctctgggccaggggcttggcagatccatggttctgggcattcatgctctatgttcttaactcctgctttatcccacctccacatctaccccaccacaactataaaccctccttcaggtcataggcaaaccctgatttctctatggaagttctttgtaaaacagattgtccccatcaagcacactgtctttcttacttatctgtaagcccttaaaggtagggtattgtcttgatcttctccaaacaccaggatatgtgggttgattggttgctgccttctactcaagccctcaaagccaagagcctggagaacttgaacatctagctaggttgtccttctgagctggagaatacatcatagatgcttactgtggcagaactacaagtaacctaaagttaactaagagatggagcttatggtctagcccagtggttctcagccttcctaatgccacggtcctttaatgcagttcctcatgttgtggtgacccccaaccgtaacattatctttgttgctactttgtaactgtaattttgctgctgttgtgaattgtaatgtaatcctaatatctgttctctgatggtcatagttgacccctgtgaaagggtcattcaatctcatcccctaaagggatcacaaaccacaggttgaggagcactggtctagacaaaagtatgaaaatatcccagaaagttcatgtgttgagtcaacattaggatagtgggcaagccacggggccataaagtgagatgctggtgagggcggatgggagaaggcatcactgggtcctgtccatagcccatctttacacagagagaggccgtgtgaagcagatgtggcaggactatcacgtctgtttcctatgggaaacaaaagcactggggacttggagcagatgggtttaagtttgactcctgggcacaacaaggactgtcttcatgaagactgatagctatggcagatgctaccaaggggatatgagatggaagctatgcatcccattacacacacacacgcacacacacacatacacacacacgcacacatgcattcacacacacacacacacacacacatgtgaatgcatatacacatacgtgcacacaaaggctcatatacacacagactcacacaattaacactcatacatgcacacatgctcacgcacacacatacacatgtgcatgcacatacgcatatgcatatcacacacacaggctcatgcacacacaggttcacacacaaacacacacacaaattcacacacacacatacacatacatgcacacacttgcacacacgtgcacatgtgcgcacactcagcctgtgggaaccccacttccctgcttttccatcatactcacgcaccctcttccttctcacattgactctcatcttgctctcctccttttcacatctgggtcccggggccatccattgttaccccattggaacagcccgtatctgttcccagtagttagaggcttgagagtctggtcacctcgacacccagtctctgagtgggagggggcggggctcaagagggaagtcaggcctcaactcagtgccatctcttttctctccacagaaaaccaaaagagatgtcaataactttgaccaagactttacgcgggaagagccaatacttacacttgtggatgaagcaatcattaagcagatcaaccaggaagaattcaaaggcttctcctactttggtgaagacctgatgccctgagaggctgcttcggatggagggagctcatgctgcaaggacggtgttgagatactcccaagctgcagaggctccgaaggtctcaactcctcctcctcctccccctccccagagccccagtcccatgtccactctcttatttattgcattcccccaccccaggccacgtccctccccaccctcccagtgatcagaaggcactcttggtctagactcaccaagatcacagatttgaattgcatcagctacctgtgggtagctgtgcgcagtgttgggtttgatgtatccatccaaccgcaagccagaagcagcttcagttcttttactacaaagaaaaaaaaaaaaaaacaactcgaagactctggctctgccactggacgtggactcctgatttctccctcctcccattcctcctcgtctccagcctgccatccctgcccagctacctaagagaagagagcagagtttcttccacgggagggcgggtgccccaaggcttgcccttgatggaaggagcctgagttgctcaggtggtccagctgtggccgtgtgctctggaatcgcacattcctgcttgctttggttttagctttttttgagcatgccaaagttgtatgcgtttgtatctcatggaagaaatcattttgattttgaactctaaacattacaaaaaaaaaaagcagaaagaaaggaagagagaaaggaaggaagaaagaaagaaagaaagaaagaaagaaagaaagaaagaaagaaagaaagaaagaaaactattactacgttcactttctaattggccaaaagatagacatcccaacgtgaacacgggtagatattaaagggctaatacacggtgagaatccagtcatccgacgtttgttattgatgctttagtgacacatgaggtctatgcaaagagagcaaagaaaactctggcttctcatcatgagaattttccctgagcacaaagaccaccagagcaacagccaagatcccagggttccagaaaaacttaattcccaaattctctctccagtcttggtcccatgttcccagcataaacccttattttctctgtgcttctacaagatggccgtaccactctgttgtggtttgaaacgttcgctatgtaggataaactctgaagtatctgttttgggaatgcagggaacgaaacacagccggggtcaggcagaaggtctcaggagactaaggagcaactgatctgagggccgtcgaggtgctgggatgtagccagagttttggtgacatgcgatggtaactcacgtggactgatattacctcctgtagctatgctgacagtgttacagttttgattcctaagggttccctgtggctttgtgtatatgttccctgaaggtcatttgattacctattttattgaactgacttagcagggagtggaatccattccaaccattgcacgtggatttcccaaccacccctaagtagatatacctgtgagtggcaaactgacactaacgaagctttttgccttttgtacatttgagattttttttgtatatagtgttcgctgcaaggcctgtggagttaaatcattgactatagaggtatcaactgctgcatgttcaggcatattatagaactttagtctatgaaagaataactataataatgtccaggtgcaatctccttatcacctattggttcaagttgctgagagagaggtatgtttctttccagggagggctggggtccttcatattgtttatttccttttgggttaaaagtgtaagcacatagtgaactctgttaaagtcacgctcggttctcctgtgtagtgtcatgccctgagagagatggcagacgggaaagaatgttctcgatactggtttccaagcttggacagtgactattttgagcccatactaaatgtgtccctatttgcatctggctggtcacagcctttgtctctaatgacgaccttcagttttcctctttgttttgctttttttttttaagaaaaactcaggtgtaactgtgatctgttcttatgatgattgcaaatattaaatgctatgctgtatcaatctgtatgtttggcataccagggaagtgatgaagaacattagattaatttaatttatcttcagtaacttgacatactgggggaagactatcttttggagtggaaaacaagcacagaaacatcttcatggtggtatcatctcaatgtttagaaaaacataatcccatcatactcagatataatctctctttctctctctctctctttctctttccctctccctctccctcttcctccctccctccctcccttccttctgctttctttaccattgtgaacattggacagccaaggccaatatcaagtgtttttcccccagggtttggtagtgttaatgttacagtgaaggctacacccttcctcatggccagttggcactgttgctgggaagtcaaacaacacattccaccagcaactctaagaagtcaggcccctgatacccttttggtgcccatagccctgctggctaggaggcttccagccaacgctttgaatctagtggagacctacacacgagtgtgttctttggatgtatactgagtcctgtcagcaagaacttagccacagggaatgtggcttggtggcagaactcttgcctggctggtgtgaagccttgtacatgggtcccagcatcacaaaaacagcagtggtggggatggccaagctggcaccagggtatctggggaatggccacactggcaccaggggatctgccaggtctatatttttccaactctcactttctttatcttaaaggaaaaaagtgggggggaaaagccaaaaaatactacatgaaggatagtaattcctccctgcctctcattatggacttcttgaagtagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgccatccatcagtgtgatttcattgtaaacattattgtgccaaatgtactgtactcaaaaggatgtgaatgtgtattgttccagaacgtaataaatatgatgatgttaaatcttacttctctgtcccaacaaggatgcctccccccctctctctctccttctgctttttgtgcactataaattcaaaacttccaggatggcgttattacggtccgttgtcaagagtgcttgtccatcatgaatgacgttctagattcagtccccagcacccacaaacctcagggcagtgacacattcctgtggtctcagcacttgggtggcagaggcagtatgaccagagcttcaaggccatccacggctacataataagttcagggccagcctcagctacaaaagacgtctcaaaagccaaccaaacaaacaaaaaaaaaacttccaaaacctaaccccagcttagtgggacacatttgtaatccagcactcaggaggcagaggcagggggatcctgagcggaaagtcagcctgggctacagactgaactagaacgagtacatacaccaaagggctcggtgggtgtggccagtgccacacaagcctgacagtctgactgcatggagagagacgactctacagttgccttctggacctcagacacatgccttggcatgaatgcccaccatacgtacacatcggagcattggttattttatcagggggatgggcatgaatgggcatgaatgtgagcatacacatgtgtgtttggggcagaggccgtgagtgcaaagttatttctgtctttatgtgggctttggggttaagctctgctcaccgggcttctgtggcctgagccatctcacctgtcctaaaatccgacgtttaaaacagaacccttcaggtcaaaaacccacatggttttctgctttggccttcccctttgcaggcgcatgaggtttgagaagcaatatttgcctactctcctgactcagccctgcttgccgaccaacagggaaggcctgtttatgtcagatgtggctgcctcgggtccttgggagggaaggcatctttcccatattcaggctttggaatattctggcagtgagcacctgcatgcactttctggtgctgagggtgtactggtaggatgctttcctaactactaggaagccttggcatcagtcagcaggagcccataaaatgggtgtggtggcacatacttgaaatctcagcactttggagggagactgagaaggaccagaagctgaaggtcacccttggctatggagcagggtagaggccaacttggactacatgagtctctgtctcaaaaacaaaaaaacaaaaacaaaacaaaaactaaagcaaagcaaagcaacagacaaacagctctcagaggctaaacctgacaagcacaggtcatgcagacctctggctgctgtaatcccgggaaccaagtcattacttctaagcttggggggtgggggtgtccctcaggctctcctactggcagattggctgatgggactctgactttgctcccatctgtgtctaaagccagcaggtgtttctggctttgctagtgactctcacagtttccggtgcttcctctcctcaggcccttccccatcatttcacttctgtagtcctgcccctatatagccctggctgtcctggaactcactctgtagaccaggctggccttgaactcagaaatctgccagcctctgcctcccaagtgctgggattaaaggcgtgggccactactgcccggcaatggtagaagttcttagctttggttctagtgctggtggtagaatctaaacccttcccatgttaggtaagtgctctctctgccttgacctacttcccagtctagaagaacatctgaaactcttgggtttacagacactccaattaatccatacttttgctcactagaagcatagatcgaagtcttcttgtctgtcagcctggccccctttcagaccacagaatacttggatatgttttgttttgtagagttggagaaagggcccagggcactgaatgttctacagaaaaccccataacctttccaaagactcaggggaccttagtgtacaatcacaaaaggccttctctctctttagttctctcagcaacacaatttgcttatctgagggagggagggagcatggtctccagagccacctcgggagaaggaactgcacatctcaatttactcagtcacgtgtttcgaggtaagtggtcacccgaggagacgaaagcttccagtcaatatatctatcatgaagcgagagacagagacagagaatgagagaaattagactcttacaccagagattgtcttcagattaggaggagaaggagagagatcatgggaagatgggagtccaggtttcaggtagatcaagtgtagtggcctaggtcaataattttagtactagcagatctgaagtaggggaattacaagaatttgaggccagcctgaagtgcagattaagattatctcaaccagatagcaatggcatgtgcctttaatcccagcacaaggaaggcgaaggcaggtggatctctgaaattcaaggccagtgtgatctacagagcaagttctaggatgcccagggctatacagagaaaccttttggggggagagggaaattctatcccaacaaacaaacaaatgataacataccatacacctaacaggtctacagatgggaaggttgaaaatagaataagccctagagagttgcatagaatttgatacatactagaacactgctaatggttggtagagaccatctcctgtccccagctagacgcttgctccaacttcacctaagaatggagtaggcaggcagcatagggaataaacaagacaaaacttaagagtgactcaggggtgatgaccttagactgggaaaaaaccatgttaaatggatgggcgcatggatttaatggaaggaggcttgacgtcctggtgacagctagatgctcagatgtacaagtctgggaagcagatgcagtcggtccgtcgcagagaggctctgtgggtctgagaagtgtgtggcagggaacggaaaacagtggatctcggtactgggaggctggaaactacttcaggaactagttatcattctctggacaactgtggagacttggaggccgagacagagcttcctttgcctccagtctacgtgagcttgagggaaatggaccatagggtaagacctcagacaagggagaggttggtcccgcggagtccatcgcccctaaggtttgaacgcagcttctcttcaccttcctttgaattctacagtttcccgtgaacttaagcttgaatttactaacttccaacaccaccaatggctggtataaacatggctgcctgtgtgctgctcacatttgcctctgtgctagcagcacaaagcagggttagaaactaacttcattgggggaaatgttggctcctgagttaacataaaggaggcaggaaggatggtactgatggtgttgaaggtaactagattgacaaagacactcaaaacaagattccatgttaaagagtagcctggttggtcctggtggcacggataccacagatgctggggcgagacgctatctcaaaatacaaagcaaagggggctgtggagctctaccacaaggcccaactcactgctttaaaggcatgaaggtttctaaaggacttctctctgcttgtccctcctggcgatatgacttccctgcctggagttgtaagtacagatcctcagacacacccccaggagaagggttgtgtttattgtgcatttcctctcagattcagccataaacaagaccctaggctcaaggcctagtagaacaagagcaaagcccagtagatttgaaaactacagtgcagaaaagcagagctccttcggctctccaataatgaccacgctcatcagccatgagcatgaccaaaccaaaacaggaaaggagagtgttgaacagtgacgctcagtggtggcttcagatgagtgggaattttcactgttcattctctgagtataaaatgatccaaggaagccaggagtagtgacacttgactttgatcccagcacttcggaggcaggtggatctctctgagtttgaatccagcctggtctacagagcaagttccaggacagccgaggatacacagtgaaatcttgtctccaatgccaccccacagagacatttattttgtggaagagaacacatgccagatgtgtgggtggcacaaacatggaggtcagaggtcaggaggcaagtatttccttggatccacgtggatccaaggaactgaacttgtgttgtcaggcttggcaacaactacctttacccactgagccatatatctggccctccatgctgtcttgacatggaaggactagctgagtctctcctttgtaccatatcaagatctccctgataaaaacaagcaagcaatcccagggtacacttagggagtcagtaccaaacaagctttggcctcagccatttcaccttgggcagaagtgacaatggcctctttgaaagaagtactacctcaagaaaagcctgccacttcaggctgtctcttctctgcagattgtcccctctgcagtgccattccttttgctcattcttcctgctggagtcctttattttgaagggtttggtttgctgtagtccattaaggtctcacacggaggccattgattggatttgaattgatttcttatgcagagtgagagactggggatctatctccagtttcccccaacaccatctgtaaaatgttaatgacctaaaaggctagtaggaccaatggctagggcctctgttaggatttctccttgataagcacccctgacccttgatctgcatgcagtgaaacacagggtcagctgggctggcgtcactaggtcagcttatctttactctccaattgacttctcccatctctgcccctccatgcctaccatcactgccagagacacctggataaccctccatccatcccaaggccacactaaaacaggaagagagcacattaaccacaggggctttggtcttgcagattaattagtccaggagagaagacagtctcaatgctgaagtcctaaggcagactagcaaggcaaagaaatccctgcaggctattaacaggggaaacgtggagaaaggtgcactgccttaccaaggtggacttctggacaaggcaggaggaagagcctaggagcagggaagggcctcacaagtgggtgtttagtattccacagccttggatcgttgggagcttgtggggactgagctccatgacggccctctgctccctgcctcagcccgagtgttgctggcagtgagtaagccgatctctgagtgtgctcagcccacctctgtgtatcttgagagagatcagcccattcactgctctctctagtagatgagagggatatcccttcagatgtgcccaaccccagtttaaggcctagctggggaggagtaagtacacactccttccctccttccttatgggcctcctcaacttacccggtctaagcccatcgccattcctaagtctcagccccaagacctagaaatacattttacctggaaacctcaggggccaaacctatcaagatcgcagaatttccttccaggcaacacacaaccagccgccacactctcctaagaacccgagatggcaacaaaaactaagactcaaaacacccacccaccaaagagaagatcagatagcagcacccagaatcacagtctccccagacccaaaatgcccagagccagtgtaaaaacacaatcagcaacaggcaggacaatatgtctccaccagagctcggcaaccctgtcacagcaggccctgagcattgcaacacagctgaagcacaaggcaaagaccttaaaatagtctttaagaatatgacagaagttcttaaagaggaaatgactaaatcccttaaagaagtctatgagaatacaaataaacagtggaaggaaatgaataaaacagttcaagacctgaaagtagaaatagaatcgataaagaaaacccaacgtgagggaaatgtggagattaacaatttaggaactcctcagaggcaagcctcaccaacagaatacaaaaaacgggagggagactctcaggccttgaaggcaccatagaagaaatgtcaaaggtcataaactcagaacattaaggaaatctgggaaagcaattctataaataatgacagaggaagagaagaaacccagttcaaagacccagagtatattttcaacaaagtcctagaagaaaacatccctaatctaaagaaggagatacctatcagggtacaagaggtatacagaatgccaaacacattgaaccaggaaaaaagtccccttagtacataataatcaaaagacttcatgtacaaaacaaagaaagaatattgaaagttgccagggaaaaagaacaaataacatctaaagcaaaacctatgagaatgacatctaacttctcacaggtctgagactctaaaggtcagaaggcttgaacagatgtgatgcagactctaagacaacagacaccagccccgactactatacccagcaaaattatcaatcaccatagatggagaaaatgagacattttatgatgaaactaaatcaaagcaacatctgtctacaatccaagcccttcacagccctacagaatgtcctacaacaaaaattcaaccctaaaaaaagtcacacccaagaaaagacaggggaataaatggtcacagggcagcaagtcaaaagaaaggaagcttgtgcacgcacacacacccccacacacacccccccacacacacaccacatacacacacacacacacaca

SEQ ID NO: 986 - DNA, 1823 bp, Mus musculus
tcttctgcagcccctaaagacaatgaagaacgagtgttcagggagcgtatgcggccaaggaagcggcaaggggctgtcaggcgcagggtccaccaggtcaatggccacaagttcatggccacctacttgcggcaacccacctactgctcccactgcagagatttcatctggggtgtcataggaaaacagggatatcaatgtcaagtttgcacttgcgttgtccacaagcgatgtcatgagctcattattacaaagtgcgctgggctgaagaaacaggaaacccctgacgaggtgggctcccaacggttcagcgtcaacatgccccacaagttcgggatccacaactacaaggtccccacgttctgtgaccactgtgggtccctgctctggggcctcttgcggcagggcttgcagtgtaaagtctgcaaaatgaatgttcaccggcgatgtgagaccaatgtggctcccaactgtggggtagacgccagaggaattgccaaagtgctggctgaccttggtgttactccagacaaaatcaccaacagtggccaaaggaggaaaaagctcgctgctggtgctgagtccccacagccggcttctggaaactccccatctgaagacgaccgatccaagtcagcgcccacctccccttgtgaccaggaactaaaagaacttgaaaacaacatccggaaggccttgtcatttgacaaccgaggagaggagcaccgagcgtcgtcggccaccgatggccagctggcaagccccggagagaacggggaagtccggccaggccaggccaagcgcttggggctggatgagttcaacttcatcaaggtgttgggcaaaggcagctttggcaaggtcatgttggcggaactcaaaggcaaagatgaagtctacgctgtgaaggtcttgaagaaggacgttatcctacaagacgatgatgtggactgcacaatgacagagaagaggattttggctctggctcggaaacacccttatctaacccaactctattgctgcttccagaccaaggaccgcctcttcttcgtcatggaatatgtaaatggtggagacctcatgttccagattcagcggtcccgaaaatttgatgagcctcgttctcggttctatgccgcagaggtcacatcggccctcatgtttctccaccagcatggagtgatctacagggatttgaaactggacaacatccttctagatgcagaaggccactgcaagctggctgactttgggatgtgcaaggaagggattatgaatggtgtgacaactaccaccttctgtgggactcctgactacatagctccagagatcctacaggagttggagtacggcccctcagtggactggtgggccctgggggtgctgatgtacgagatgatggctgggcagcccccctttgaagctgacaacgaggacgacttgttcgaatccatccttcatgatgatgttctctatcctgtctggcttagcaaggaagctgtcagcatcctgaaagctttcatgaccaagaacccgcacaagcgcctgggctgtgtggcagcgcagaacggggaggacgccatcaagcaacatccattcttcaaggagattgactgggtactgctggagcagaagaaaatcaagccccccttcaagccgagaattaaaaccaaaagagatgtcaataactttgaccaagactttacgcgggaagagccaatacttacacttgtggatgaagcaatcattaagcagatcaaccaggaagaattcaaaggcttctcctactttggtgaagacctgatgccctgagaggctgcttc

SEQ ID NO: 987 - protein, 603 aa, Mus musculus
SSAAPKDNEERVFRERMRPRKRQGAVRRRVHQVNGHKFMATYLRQPTYCSHCRDFIWGVIGKQGYQCQVCTCVVHKRCHELIITKCAGLKKQETPDEVGSQRFSVNMPHKFGIHNYKVPTFCDHCGSLLWGLLRQGLQCKVCKMNVHRRCETNVAPNCGVDARGIAKVLADLGVTPDKITNSGQRRKKLAAGAESPQPASGNSPSEDDRSKSAPTSPCDQELKELENNIRKALSFDNRGEEHRASSATDGQLASPGENGEVRPGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGIMNGVTTTTFCGTPDYIAPEILQELEYGPSVDWWALGVLMYEMMAGQPPFEADNEDDLFESILHDDVLYPVWLSKEAVSILKAFMTKNPHKRLGCVAAQNGEDAIKQHPFFKEIDWVLLEQKKIKPPFKPRIKTKRDVNNFDQDFTREEPILTLVDEAIIKQINQEEFKGFSYFGEDLMP

SEQ ID NO: 988 - DNA, 203264 bp, Homo sapiens
gaatcatgctcagcatctggcaggggtcccataaatgctagctgacatctttcagcttttgaataggcagggtttgacagttatttagaccaaaataccaggatagttgaattgttttctttgtgttgtaaaattaccttgaagactataatcactctttacctggattccaagataagcctcctgatgagctgacccccaccccaaccccagggttttcctcaatctagtcccatttctgcttttttctagagttaagtcagtgttccttgcccagcccagtctttctgacagttttcccggtcctaaagccttgtgggatggggtgtggggaagataaggcaggcgctccctcttacagtggcaagtaggtaacatctgggggtagctgaaccccagcaggttgggggccacaagggagcatcggagcaggttctgcagggtcagggatgaggctgtcgctcttcctcagtgaggcattgttggctccagggagatagagagatgcagggtttctggaagtcagtattggattactaaagccacagctttggtggatacagcctgtttttggaaagataaaagagaaagaacctgaaccatggctgtatatgtctgatctcctcagggccaggggtgtgctggtggtaaacgtttaacaacaacctccccaagaaagtcctgatttgtagcatttgttgattttcctgtaaatacccccatggtggccatttcacgctactatgtgtagtcctcagatgtggagcggtatgtactacaggatccagagctggcttcaaaccccactgccatggtcataggaggagaaaaccctcccttcagcatgtgctagatggcaggtgaaattcaacaatcaccatctgaacccatcacatttttggcagtattttttctgtcacttctggtccttacactatcaattttgggggccatcctggagtgtcccctggggtgaaggaggtcctggaggcctacctaccaccccacagtagaccagcagagggagagaagggcaaacaggggccaggcttccaccacccttgcgaagcctggtatgcttaggaagaagaacttcacttgggcctttatcaaccattatagtcaaggtcaggactatggtgcaagcagaatttagggctgccccaagtctcaggaatcaaataatattgtaatgtagtagtttagaaaatcagattaatgaaggaaataacaaaatttgaagtaaagatacagtcaggatgactcattttttttctttttttctttttgcctcagaatccaacatgggtctgtgctgctcctctcagcttgaggtttgggttgagccatggaattgcccctctcctgatagataagataggaaaacagtggctcagagatattaaatgacttgttcaaggatatgaggcaggttttgggaaaggacaaaatttgtccagtctgctaatacctcattcaaccatactggcagaaaggggaggtcaaaagagagagctcagagaaaagaaagaagaccccacagcacacctgcctggggcaagatccctgtgtgccctgaacacaaagggtaggggactgtcctgcagtgaggaatgacagtggtgccccaagatcatgcatgttggcaagtctggcccaggcaaggttgacccttgttcttggctccatatactctggaaggcattgctggcatccaggcatacgtctgtgtgtgttagaaattcactgttagcgattcacaactgcaaagatatggaatcaatctaagtgctcatcagtcaatgagtggataaagaaaatattacacacacacacacacaccatggaatactactcagccataataaagtatgaaataatgtcttatgtagcaacttggatggacttggaggacattattccattattctaagtgaagtaactcaggaattgaaaaccaaagactgcatgttctcacttaaaagcaggagctaagctaagggtatgcaaaggcatacaaagtggtataatggacattggagactcagaaggagaaggatgggagggaggtgatgatgaaaaactacctattggggtacaatgtacacaactcaggtgacaggtacactaaaatcttagacttcgctaccatgtcattcatctgtgcaaccaaaaaccatttgtatcgcaaagctattgaaataaaaaagtttttttagaaaaagaaattatctgctgaatattcctaaactgaaaggcaatctaagaacactgaggttgtgggtgcccctgaccccacatgaggaggtcgttcagtttttccagcttgctttttgtgtgggaggagacgtggtgggtaagagaaaggacagtggagcagtgaaaacttcaatgaccagactggccagaaaatgtggtctagggtttggtgccaggggccatctctccctgagtccctgagtgttcctgtggtgcagactgagaagtctcacccccaaagaaaacgggccaggtgaagttaggtaaacagaagaagaactgcacggtacagaccccatttttgctcctcttgccacctgcctacagcctgtgagagattatcccgtgcattggggctgtaaaatattcattgatataaaaccttctggagtttgaagttcatagcctaattgaatcaaggagaaaccatccctggaatgttgttggaggttggggttactgtgaatcttgaagctgcttcagaggacgtctctgcttcgccttatttatgcctttgtgaattcttgttacatccccacagccaagttctccatttccacagagagtttcccaaaagttatccagctttgtcttggcctttccttgactcaagttcaccccttctgcagtgaggcagatgcaggcataaaacaacggacctccaaagagccaaatgggtcctctgggaggtcagccaaccttgatgttgcctcagaggtcacggcaaatgaactgtcatgctggctgagcacggctgagtgcatccagtgccagcagcgagcatcttttggagcggttcagaggtgaacgggcatggatccggcaactctggtgtgcagcgggcccagcgtttactcagtccagaagcacaggcagctgggaagccggtggtttccctcttctctccccttctccacggcaagctgcagttccctcacctcctgtttgtgccaagcagccccccactcctgcagcatgagggagcacctcattacctaatactttttaggcaagtgaaagctttaaaaagtcactaaagagcattagagaacactttttcaaatgtcagcctatataatcccatcatcctagtggagcgccgttcttacgttatcttcagcctgcaaatttgcttgacataggggtgtattattgttcattcttttttcacaatattacatcacatttctccaggtttctgtggtctttcttcaccctcttaaagttgctgtcgatgtaatgtaattcatcagaccattggcctaatagtagacagtcaagtcatttctgtttgttggctaatatagatatgcaaagggaaacatctataaggatatagcttttagtttgtttaattattgacttagagttaattcctaaggagttgccgaatcaaaggatgtgaatctctttgtggccttccctgtgcagtctctgtgtcttgtgatactgctttctgaaaacatgtcaactggcattgcctgtagcagtgaatgaatgtcagtttcatagtagacttgccaataatggataataattttaaaacaaattggttacttttttaggtattaaatggtatgtcagtgtatgccaaaactgttttgctttgcatttcaaaattcctgattatagtcagtatcttatgaaaattttatgtttgtgtcctttaagctattatctatggggatcttgatatatatatttcaatttgttgatacatagccctttgtgctggtcttgccatttaatcagaaactaattgggaggaaacaatcagagaaattcagattgtgaagcattcaatgtgacaacatcctggatgctacataaatgtatcattaaaaaagatacatttatgtatctagaacagtaaaggagactgttctagactaagattaagaagatatggcaaccccatgagctctgggtagctcctgggtgaaaatcagaaactacaaaggaaacttgggaaacaattggggaaattcaaatatgaactctatattagataatgtcatatcagtgttaaatttcttgactctgttattgtgattatgtagctgaatgtctttgttcttaggagataaagactgaagtatttaagagtgaagtgtcactacgtctataaccttcaaatagttcagcaaaactatatatgtatatatcatacatattatatatactatactatattatggatcaatatataatatataaattatacatactatatatacatacacatatacatacatttatgtatctgttattttatacatcagacacacgcatattacctctactatgagagttgcattttatttattttttttgtgataatgcttaacataagatgtacgctttcagcaaattaagtatactatgcagtgtgttaactataggcacaaaattgcatgatagatctctaggacttactcatcttgcataactggaacttggtgcccttttactagtatctccctgattcctcctttctcccagcccctggccaccaccattctgctctcttgcttctatgagttcaaccacgttagattcctcatataagtggtatcatgtagtatttgtcctgccattggcttgtttcacttagccaatatcctcccatgcatgttaccccaaatggcaggatttccttcttttctgtgtctgagtaacattcgattgcatgaatacaccatattttcttctttttttcgttttttagaaattgtaacaaagcattttatttacgtcaaggaagaaagctatgctaaggacatagaaatctgcttcagctttcctttagcctcacacttcataaaagtatcaagtggttctctctggcttttacttagtcatctgtgtaaccagggttgaagacagtagaacactgagtcttagtgtaagtgtaagagattgagaagacaatctcttttgaattatggtttttcaatgtttgttgtatcatctttttaaaaagagcaatagagattctttttagaaaatacaaagaagcacaaggagaaaagtaaaaatcacctgtaattccaccagtgtcaacgaatgaccaatgttaatgttttctaagtagttggaacatacctttccgccttgtgttttcttttgtgtgtatgtgatgaatacaccatatatttttttaaccattcatccatagatggacatttaggttgcttccatgtcttggctattgtgaatgacgctgcagtgaatgtgggagtgcagatgcatgaggactcttcagggtccttactttcattcctttggatgtgtagaagtgaaattgctgaatcaaatggtagttctatttttcgtttcttaagaaacctcgatactgtttcctatagtggctgtacaattttacattcccatgaacagtgaacaagcgttcgctcttctccacatcctcgctaaaacttatcattctttttttttatcatagccatcttaacaggtatgaagtgccatctcattgtagcttcaatttgtatttccctgatgattagtgatgtagaacatcttattaaatacctgtatacctgttggccatttgtatgtctttagagaaaagtctactcggttcttttgcctgtttttaaattggattatttggttttgccattgaattgtgggagtttcttatgtattttggatattaaccctttctcaaatatacagtttgcaaatgatttttttccattcttcaggttgcctttttattctgtcgattgtttcctttgctgtgcagaagctttttagtttgatgtagtccaacttgtttatttttgcttttgttgcctttttggtgtcatatctaagaaatcattgccaagaccaatgtcaagaaagttttcccctatgttttcttctaggagctttatggtttcagtgtttacatttaagtattcaatccacgtttagttgatttttgtgtatggtaaaaggtaaggatccagtttcattcttttgcattggatgtacagttttcccaacatcatttattgaagagaatatcctttttccattgtatattcttggcactcttgttgaagatcagttgactcttcttggcttggaagaattaatgtttgttaaaatgcccataaaagaattaatgttttgttaaaaggaactgcaactttaatatggttcctatcaaattctcaaaggcatttttcaataaagacagaaaaaacaatcctaaaagtcatatggaaccatgaaagactgaacagccaaagcaattctgagttaaaagaacaaagatggaagcatcacatttcctgatttcaaaatatattacaaaaattcagcaattaaaacagtgtggtactggcataaaaacagacatatagaccagtggaacaaaatagagagcccagaattaagttaatacatatgtgggatctacattttggaagagacctttcatagcggagggaaatgctgaagggatccgtttctggtggtggactccaggccccagtagggaggttcttggggactgagggacctagtagctccccttttcacattgtataggccactttcttctccacctgtgggtgacagtgctgaggatactctggcctgacccgtggctttcctgcccagaggaatgtggaattggggtgttttcagcagccacaggctccaacccctttctcctgtcacctgctttgtagctttgcacacaagcctcacttgaagcatgaagtttacccatgttctttccctcctgtgaccttctgtttttccatatctgacatcaaatctgacttaaaaggcagtgcagatgctcctttggggcaatagtaatagaaaccatggaggaagttgaacttagaactctgacttacaggagttatccttggctgtctgcctagcctgtgcctgagactccccctccacacccctgccaactttaaacagcttccctccaggtatcagggcaccccgctgagacagctttgaaatgaatagagtcaaattaattggttgccatattgccctattggattgatgtcaacacagtttagaacgattggtttcattgctcgtcatttctgtaaaaagttgggaaataagactcttaggaaggactgtaaccaccgtcataacagtgttcctttgagaaaattagattggacccatcaccattttaactgaaaatagtttcccaggatgaaaacaactagtcaatttgagagatttgtaaatcaaattgcatcttaaatgcattaggagacgggcttactgttcaaatgtattccgtggtgaatcctgtgaaaggagttaagggtgctcttttacgaaaagaacctgcatcctgtgtcctgtgatgcccaggatgatgtttctggattggatttttgtaggtaagtttgtagcaagtaagggctactgaatagatttggtttttggttgtcatatttttgttcttgcttatgaaaatagtagaacattctacacattgtgaaagtatgaagcggaacaaaaacttgcctatgatggcagcaccgaatggtgattgccatacttctgcagctgtgtgtgttgctgtctctatactagaacagacctgggtcctcccgtgagaatttggtcagcaggtcaagacccctaggttggagcagggtaggaggtggtgagctttctgtacccagaaggtcggtgatgccagagactttttgaaacaataagcaccaattgaaacccaggtgggctaggggtcaagaagcaaggggatccacaagcagacctccacccgggtcatctgagcctgtgttgaagatgcagtctgggaacgctgagggcagatttccaataaacagctgcctgtttgctcagaggctgctgcgtccttggaagcacacgctgcgcatttggtcctgttctcaccttttacctccttcaattttaccttccctctaccctaccctccaataacaagatgcccttggattaatctgttgttcaggtcatacatatgacctccacttcagggaaccttacattcagagaggtccaggagggatcaatgcttcttcccctgaagactggccctgttatggtgagatgtcaggcactcgctgatgcctggagatatttgggggcacagagccttccagtgcattttaagctgacctgtgcaggggaccttctaggagaccttctagaaggtgtcagaaacctaggaagaagcccaaagcctgcccactgtgttcttggggaagccacaggcagctggactctttggtgatgaaagccactcagatgagagcttggggactttctgtaaggagtgcaggccgtccttcagagcagcgtgtgggtggaggaacaatggcctctttctcactctctgggttagaatctgggcttccccactgagtagctgtgttaacaggagtaggttacttaaactctattcttcgctttgcatacctgtaaaatggggctaatagcagtacccttcaagtggagttgtttcgagggttcattgagatgtattgtatcactaagatataacacacttagcatagcacttgccagagcgtaagcccacgataaacatttatcatggtcatccttgtcttaatcagctcagactgcaataacaaaataccaaagactgggtgtcttaaccaacagacattcacttctcacagttttggaaggtggacatccaagatcagggagccagtatgggtgggatctgctgagggccctcttccttgctcacatgacagagagctcactcactcaggtctcttcctcctcttataaggacactaatcccatcatggaggctcaaccctcacgacctcatctaaacctaattacctcccaaaggtcccatctccaaatagcatcactttgggggttaagactttaatatattaattttgagggggcaaaaatatgtagcccataacaattatctttattatttttgtgatcatctgtgagtccccttgcaaggcattctcagttggtggggcagtctcagaactggggggaaggaaggtattgggaagatctttttgactccagtgggatctttacagcccatggtggtggtcttgagccttcgagaaactactttcactgtgtcatatttccctctccttttgacctctgggaaaatgctcttggttggcttagtctaggtaagaggaagaaggaagaagtcagatttattaggcagctacttcttgagccaggaagcttagggtgtggagattcatctcattgcgtcctctaagccaccccctgtggctggcactgccattgccatttacaaagggagatgcgctcagatgctcagggggaggaaacaccacctatccaaggtcacactgctcaggagttgcactaagatgcgaaccttgagccttttgacccccaagcccttgaaaccagctgtagcctgtgtggggaggaaagggcagccagccctggagcagaatttggattggatggaatctgaggatatagcaggaataggcacactctgggcctttccaccctacatgtgctcgctcactccagctgctcagtgggactcctcagacccccgagtccctccacacacaaaggctacctctcacccaccccagctccactcccccagggatggagtagctctccagagggagctcattttgaaggtgcactaacccagactccgttttcttccctgctcttgtccttccccagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggtaagcctttctcttgggaacctctaattacaacatctctgttacaagatgtcggggatggggtaggggagactatgcacctcatttaaagaatgctggtgtgcctcgtttcttccttatctgaatgcaggggactattatggaaggctaagtgtgtgtttggtacatagggggaaatacatggaaagaagcgatggtttctggcaactttatacctagaattttatgaaaagagttaagattttagtaaccaacaaggatattgtgactgtgtgtgtgtgtgtgtgtgtgtgtgtgtgtgtgtgtgtgtgtgtgtcttgttttgagacagagtctagctctgttgcccaggctggagtgcagtggcatgatctccactcaatgcaacctctgtctcccaggttcaagtgattctcatgcctcagcctcccacatagctgggattacaggagcacacgaccacgcctggctaatttttgtatttttagtagaggtagggtttcgccatgttggccaggctgatctagaactcctggcctcaagtgatccacccacctctgccccccaaagtgctgggattatagatgtgagccattgtacccagctgattgtgtgtttttaaaaagaatacttatcttttacagacacacctcagggtgaggattccactgaataataatccactgaaaaataattcactgaattatttacaagtgaaattatctgatgcctaggatttgttagaaaatcaggaaggaggccaggcacaagtgcggtggctgatgtctataatcccagcactttgggaggccgaggcacgcagattgcttgaggtcaggagtttgaaaccagcctggtcaacatggtgaaaccctgtgtctactaaaaatacaaaaattagctggccatggtggtgtgcgcctgtaatcccagctacttgggaggctgaaacatgagaatcactttaaccctggaggtggaggctgcagtgagccgagatcgctatactatactccaacctgggtgtgacagagtgagactctgtcttaaaaaaaaaaaaaaatctggaaggaggagaggggctgagataaagatgatcgaaggccagccccattccactaacaatacccaggctcagaaatgaaaatgagactggcctgatgtcctctagctaggaagtgtcagaagtatgattctacccctagtagtctgacttttaatgctgatacttttcctgacatcccaccagcctttctagcaagctgtctgagctctttgaagctgatgtagaggttgccttcatgaacccttggatccaactggggagagcgagtgaggccaggatgcagtatgaacccagccagggacatctgcactgggctctgaggaccccttggattccaggtgtccagtagtcacttgtcttatcctcatgatgtcacaaagccagtcatccaggttggcgtagacatctgagatgatatagctcagagcaagcccagcccaactgaggcagaaataatgccccattccagccacagatacttccaattaccagggcagacccagctgtctgaccttcacttgctacatttggtcatgaactgagtggtcggtcttacagatccaggtctcctctaagtccatgggcaaaggccactgagctctaggttccctggggtggagcctgaatagcttctggttcccactgggctgggaacttcagggagctccctgaccatctgtagttagtacactaaggacaggggtaaggccgggtttgtgtgatagttctgtgtccatgctgactttctgtcttgccctgggaacaccactctggccatggaaggaacctctaatgttggccttcacctagacaacctcttgaacctctagttcggggcacagactggcttagaaccattggtggtctttggactgcccagggaaatatacctgccagctgcagccctcttccacagttagagggcccacagagcgtgtcctggtgctgggagaagaggaatgtccattctatccacaaggaaaggtatgcttcactgctcaatgcctaccaggagcaagcagggtcgtttgtggctttccagaacattgctgaccacacaggaatggctctctgtataggaaatcaagctctgatgctgaccaaaccttgcacctccccaagcactgggactgccctctgtgggcttctggaaggagacatttaaggcaccttgcaagtgagagagaaattacaatattctgcatacttcatgtacttggtgctatgtgggtggtggcccaaattgggtggtttttctgtttgttttttgacctggtaagatttcactttttttaaaaaaatgttattcttcttttcaggggtgtcataggaaagcagggataccagtgtcaaggtaagaggcatttatgaattaaatcttcagaggcccgtggttagatccagatcactggcacccataggaggcaggtgctcagtctgatgacatttggaggctctccacagcttgcatgctttctttgttcccacttgaccattacttctgcatatatgggaatatatatgggaggcatttgcaggtgccacctgtctccaggcgtccttgtgatctcagcaggtccccaatccacccggcctttgtgtctcaactggagcaggtggcactttcatctttctgaatgagacattctgcttcagttggaggctctttgaaagtcccactttgtcctgaactgggtctgtgtattctgccagatccctccctgtctccctccctgaagaagcttcctcgcctgctcgttgtacttggtatcactgaaaggtccttgtctaatccctttttttggtcttggctgtgtgatcattagctcttaaaaatgtaaagctcacttgaaggtattgaagattattcctttccagttaattgactacaaatgcaagtttaagttgtacaaaattggagggtggaaatgtggcatggtcatgcggtggttttgctgaggttagagcagggaggttttcctgtctcctcgccaagcactgttgggtctcacccatggggtagtgtctggtggaagttgctgttccttggggtaacacgtacacagttacttaccttttcagccacctactgcccacattgctccatgacactaacaacacagatataggccacttgtggaagtattaaagtcgatgggaattttgaagtttggtatgtcaggacacaaccagataaaaaagcctcagaacctctgcaccgcctgctgcagttccccctatcacgtcagccaccctgcatggtcccgagtggggtgcgaggccactacaacacctttaataggcagtgctccatgggagggctggaaggaagtttttccttgaccttggcgtattgaagtgagaaaattgatcagtactccctcaactggagaaaactgctaatgtcctttgaatataaatgttaccttgctctctggagcatttaggaaactgatggctctgataggacagtgttttgaaatagctgtataaaagactttagggagggtattaaattaaggctcagtggcagaaggggcctggctccccttgtcactccaccaagccctgaatagatcctgggagggacactcactttcctgagtgtcattcagccttcctgtctttgctatttgcagtctgcacctgcgtggtccacaagcggtgccacgagctcataatcacaaagtgtgctgggttaaagaagcaggagacccccgaccaggtaagtgttggtgacacggaaattctgggcttcttcaccgccagcctctcccttcactgcctcttctgtggttcccaagaaaaccttctctgcctgagaccctgtcatttcattgtgttgataaaaaaacaaagggagctgtccacggtcttctggcatgagacaccatccgcaggatgagcacaggtccaagtcagttctatccccttggatgttatgccaagtgcagtgtgatcccagcactgaagcccacaagaaaaatatgaattcttttattgcatcatctcatcagaactaaaatggctaaccaatgtgtcactagctcctcacaggtaataaacagtaatagaaacacaagcaggaaccttgtctaatgagctgatgggggagtggtgtggaatgagcaagcccaaggaatacttaggaggcggcaacaaccacaggaataaaaagagtcaacattcactgggcacttaccgtgccctgattgaagcactttaacatatattatttaatcacataaaaaccttcatgaggtagatgttattatcttcattttacaacagaatagaagcacagagagtgaaattaacctgcccaaaatcacacagctaagagccactttcaaacccaggcagtttgttctaaagcctgagcccttgaccactgcactacgttgtctcttaatcttagaaactagcatcagattgcctagtttggtagaggtaaggaagcaggaaaatgcaacaatgaagctaggttcacctaactgagcaattacgagaatgatagtcccactgatagattaaaaaacctttttgaggaagatgacagttgtgaatatggatgtaggtattatcagaacacttgatttcaagagcatgctcttaattctgggggaaataaattctgtgtagtcataggctattagaatcgcgggttagagagaaaggccttgggtaggtttataatcagctggtctacaatttgacttccaagaggactgacttatagagacttctacctgcttcttaataattgagtcaaatagcatcctggcatctaaggcatttcccatcttctctctccttctgctttcatactgtctctggaaagcaacaaaggacaaggcttagactgagccttctgtgtctgtgaaggttagtctgagcccagagcaccaacattgtttgcaggggctctcttgtggttaagactgcaagccagcacctgcacctcccgactcctggtctaggatcatgaccccagtacatcactgttgctttcacgaggaaatgaaagaaagagatggcttgcttgctgtctgccttatttccttcctatggacattccattgaacatttactgggtatgtcctgtatgacaggcgttatgctgtgtcccatggaaacaaagaggagtacactagtccctccctcaaggatctcagtctcatcacctgcaggtctctgcctctgcaggactctaaagctcttctgcacttttttggagggaaaggtccgataagagtccatgccatgcaggttaaagggttgagatttgaaatgttcagaacccagcttgatctgtgacccagttcttctgactgtctttcctggcatattgagcagtgagaagaagtctccagtgaagtgtgttcccaaacttgacatgtatcaccaagggacaaattgccagggactgagagagggaggctctgggtttcttagcttggtggagttgactcccagtcctggctctccccgccaccaccttgtgcttccagaggccagtctcccttagtgtcagtgtatctgcccctcagggtgatgggcttgccctctgccgggttactgaactgctggggaccaaactttgagttcgttcttttgtgcaaccacctttaatgtgatgcctgtgcatacacacatcatacacacatacacaccagaaacacatgtagccctaaacaccatgctttcaatgccctccttcctattaaaaggtgctctggtgatggacttcttgggtgtcctgcaccgtgaacactcggccggtcccccccatctcatgtctgtgtgtcttagcatgcggtggactcacaccctgcctgcacttccaggtgtggtaaccaaacaatgttccatctccactggtgtcacatttttttttctttaatctcacaattctttctgccattgtcttcctctccatgttctctctgtgactctcactcaccccattgtatctgtgtcctcctcagcaagcgcacatgtgacatgtccccctgcacacatgccgtctttgtgttggtctcttggtcagtctgatgctgtggcatgctcttgtgtggactccttcatcctcctccctctgttctctgataccttagagtttttagtggtcccaactgagggtcacgtagctctttccacccccacactggatttcttggtcacctgggacaacgtccccactttttcgccttagtctgtcattcatacccctatgaggtgattcctgagagaccaagactctattctcagtataggtccaccatgccttcagggtatgtgtaggaatagagtgggcacagtgatctcatacttccttagcagtgagggagaccatggcagagtcaacatgtctacattcacaaacaggcacacctaagctaggcatctaagaatgggtgagtatagttgttttcagtagagctgacattcttgttcccaggcaagacctcaagtggtagaccatccatttcagtagggatcagtgaaatcttggtccaatggaaggatcagccattccttggaactgggtgctagggaacttgtcttcatgcttgcgttcaagtcgagctccctttccagctctcatttcacccctcattagtcccccacgggggcctgttacttatcagtcagccagggagctgaggcccagctttgccgcatgccagccacttcctaatccccggggtagcaagagtgatctccccagcccatggatgtcctgggtgatggtctcctgccgatactgagaggggctgggggtgcagctgctccactaaagacatagatggagggtagcgctgtggaggggcagagatgactcagaaaggtagcccagcagacccttgcttccatgaaatgtgttatgcttctagcctcttccacccctgaggtctcattgaccctgccatcctgtgacactgggtgggacagggtatgatagtgctgtgccttcatttcctcatctgtgaagttgcggtaaccatggactgccctgtagggtggtggtgaggtttaactgagataatggtgcctggtgtgtggtcagggctgagaccttagcattcttagtgctcaccattctgtattagccatcttcctcctaattgttgtccgttctgactgatccacagtttccacaacattgtgcagagtttacacgctgctgcacagaatcccgtgtccaccattgagcttcctagagactttttgcctaggtggggcttccaggcacacagcagtattgaaggtacaatttttttttttttttttttgagacagagtcttgctctgtcacccaggctagggtgcagtgggatgatcttggctcactgcaacctctgcctcccgggttcaagcaattctcctgcctcagccttccgagtagctgggattacaggctcgcaccaccatgcccggctaatttttgtgtttttagtagagacagggtttcaccatgttggccaggctggtctcgaactcctgacctcaggtggtccgcctacctcagcctcccaaaatgctgggattacagatatgatccactgcacccggcctgaggtacacattgaggacactgtactatgattgcttaaagtcctgaagtcctggagaggaccatgttggggagtaggcctggccttgcacagtcaaatggagtagccaacagtgagttaagagcatcaggagccaaggccagggcaggatggaagctcttttcacctcagggcagcttttagagccaagctagggcctgccacctacaatgacacaagctctcttggaaaaagttctttgagagttccgttgacaagtcttctggggaactgaggagctcggtggtgaacctgtatcttgccatccctgcaggtgggctcccagcggttcagcgtcaacatgccccacaagttcggtatccacaactacaaggtccctaccttctgcgatcactgtgggtccctgctctggggactcttgcggcagggtttgcagtgtaaaggtaagttgctccctgccctgccctcagcccctgcatgtccccttccttgctgcctgcccccatccctgctttataaaaaacccttgtctgattccagatttggccaagaactgagcgcaagcctttgttaatcctgcattagtaactctgtgcatttggtaggcagactctgggcagagaccatccaggactgggtggagggaaacaccgaggaaggaggagggcggactccacgccttaagatcactcacaatctggggagacaaaatgagtctacaaaagcataataatttcaggaaagatacattagagcagaagaaaagtaatatttttggagttaggccatgaaggaagtgagaggtgtgaattgaggcttttcttgcatggtccatggctcagtgcttactctttgaaagagccatgccagaaccttgtcacataaggtagcttgctgactcgtcaccagcttgggacataggggatattattcccatggccctggtgaggaaacggaggctcagagactaagcaacttgctcacatcacacaatttattagcagaagtaggatttgaaccttgactctcgcgtcctcagttccttcctgtttcctgccgtgccacccgcaaacagcgcactcagatgatgatgctaagtggcacggggagtagcatataacacagggaggtggaaatgtattctggtggcctgagaagtgtgtccagttttataagccggtccagcctgcttgcacggttgggcaaccgtgaactactaggcagggatattgcatggacaatattttaaaatagtgttttactgtttgtgtggaatgtattattcataaattcccattgtagaaaaattagaagaatataagtaaagtataagaaaataaacctaggacataacaaattggtcattgaagggatcccaatgagaaactatgagaattggaaataagatcagggctgcagtgggaatgaagaggagaatgactttaatatatcaaggaggaatgatttattggatgtagtgaccagaagcagctgggagggcagtgatagcattcactgagatggggatacaagagggaggataaggttggaggtagaaatggagcctgagctggggacaccttaactcgaggtgcccgtggcaaattgacacgaagctgtccacctgttggacattctcactgacagttggggaataggtctagactgagcatttagatgtgggttttgtcaggatctaagcaattaaagctataaagtcaatgtcattctccagggtaagtacattgagtatgaagagaaaaaagtcaaagataacaccatgagggtgggtaccaacatccaagggtgggcctgccaaggcaatgagagggaagcactcacaggtaggaggaaaagtagcaaagaatggcaccatggaagccaaaagagtagataatttttaacagttttataaagaagtggtgccaaatgctttccaacaggttatttaagataagacacgaaacatggggttggatttaacaacaaggaggtcactaggaacctcagcaggagctgtcttagtgggacagtgggatggagcccaagtgctgtaggctaaagtgctaatagagggagatgttttttcagaatgttttagtcaggaaaaagacagtggcaaaggagagatggatgaggcagaagggagaggggactgactgttgatacagcagggaaggggaggcgagcggggatgggccttggggagaatgatggacaccgccttccccagatggagggcaagcctggctaccaggcctgggtgcagatgcatctcgggtgtcagggatagaaatccaggaggaggtgagtggacaaagtcatcatttaagttttgaatctgttgagggcattgcaaggagattccccttattttctgaaagaggaagtcttttttgaagtaggagggagaagtgggggtgtgagaggcacgaggagggtggtgagggctggaaatagcaattgtggggacagaacacaatccagccactggacatgaggaggtgctgactgtggacatgcccagcatcctgtgagcttcccggcacccctggaggtgggggcggagccattccacttccccgttggagtattctttctagtgtgtgaccctgaacaaaatggggcctgcctggaatcctgtaggtgaggtgaagagagcagaagaggaagaagggaggggagcaggagtctcgagtgtctagcagaggagtgatgtgcttttggaaagattagtgtggttgccgggaagcagggcctgctttggagggaaccctgatgagctgatgtctgtttttttttttgtaaatatattaattattgatctatctagtgaacctaaatgaagatactatcatcataaatattgatattttaagaaagcagcccagacacccagacatcactgtgagggctgtgggtccccaatgaccctggaagaaggaggggcagggacagtgtattcagctcttgttgggcaggaaatgctcttgcccctgctcaaggaaagaaggggcagaattaggatgcctggagcaagggtatctgtccatgggagcccaggaacccggagggaatcaggccgcatgagggctagaagacgaaggctgagacctgaagctccccagccaaagtgtgcagacttttactcttctgtggctctgatgttattacttggcctttttttccccttgctgctgttctgtgaccctctccttctccctctccctctctctttgtcttcctctctctttaattaagaaaccttatttttttaagagcatttttaggttcacagcaaaattgagcagaaagtacagagagtccctgtattatgtgccccccaacacacatggcctccccccaccagcatccccaccacagcagcacacgtgcacagccacggaacctgcacagcacatcattatcactcacagtctgtggtttaccttgggatccactcatggtgttgagcattctgtggatttggacaaatggacagtgctcgttatctaccatgatagtatcatacagattagctggatggccctggaaaattgcctgcttccacttatctctttagatcctttctcctccttaaggcttcttggccctgtagactccttaccctgtggagaggggtcatggccagaagaggccagcatgggcccaaggcaggggctgcttgtgcccaggtctaagcctggttctgctactatgattactaagaaaaagaaatcaagacttagtgacctgcaagcatccccgagcaagtccctatgaagctggctcttgcacccatgcagcctggccctgttcctggctttggcaggtgccctatgccaccctttgctgcttaggaagactcagccaggctttctgtcttgctggaccatgctagcagggcctgctaggctggagctctggtcccctggtcctggctggagatcatctatttggcctgctgccctatggcttcagcttttttgccattcccgttcccattcctggaaatagattacagtattttcagcaaaacaggtttcttcagagcttgggtctacgaggagggatccatgagactgtcctggtcactctttctccagtctaaaactgtctgagccacacaggttcaagcattgtgtgtgtacccttctggggactgtccctttgtcagccaggtagagggagcataattatgtctgcttttatgacaaggaaatggaaatctggaaagagtgggtgcatgcagggcatacaaccaggaactgtggggcaaccagcccttgtcctttgcagcccacagccacagaggggccagacccttgcaggatgctcacacgatcattgggtaactgagatccttaaccgagggcagaaaaatgctggcacaaagtgagcaggcaaaatagttcatttctttctttcattttgtgactcaagtgcctgctgcgtctgagtctctccagactcattcgtgggtctgtccgagcccctcaaccactattaaacagtccagaaatcagcttcccaggttccaggagcagcatcgctagtctcgggcatttgtagccttttcattctgcactttgttggaacagtgctgccttctccaatctcaggttcactggcaccatgggcctctctggggcccttttccacctgttttattttcccattgacacatggagtcagtggcccctggaggcagagacacccaataccctttgattgcagtttccttctctagagaagatccagttctcacctgcccccgtcccatcccccacactcatgtctcagcacagctgctctgaagtcatcgggcaccaaggggcaacttcacaggaaagccagacctcctgacggagcctgcagttgggcctgcgggggcctgtggaagcggaagccctgctttttctcatccccatctggggtgaatgctctgcacctgctgtcctccaggacaggggacgaggcacagggaggaaggtgtactccacgaagacctggcctggagattcctaaagaatcttcttcctcgctcctgcctctctctgacacacatcttaataactgctctgatctgcggctgttttcaggggccaaggggacagggtgtcccctcctctccagtaagtagtaaacaggagtggtggcctgaagagatcacaggctaggatttggaggagctgtcctggtttgggtactgcctagctgggaggttgcaagcaggtcaccctggcttagtgcccttggcttttaaccccaactgccctcttcccttctgaggacagtaataaaaaataaaaatggagtgatcttagccacataccttggggtggctgtgcagagccataaagatgaaagaaaggcctgcctgtctccctccttccttcctttccttgtttaaaaaaaaaaaaaagtattttggatacttaaaaacactaaaaacatgcagaataatttttaattttcaacatttctgaaaatgtcagtcctttactatttttaacagctaggtcccttgtcgtaacttcaacttttatttttagaattataaagagcacaatacataaatacattctcactgttcttactgtcaaagatccaagcaagactgaagttagatatatattaaaaatattaaaggctttctttatattctctttccactttcatcctcagacttctaaaaatgtgctatgggtcctcttacttctaaaaatgtcctctttttgtgtgcctttgctgcacggatactcacacacactgcgttagagtctattgctacataacaaatgaccccaggacatagtggtgtaaaacaaccaatacttattttctcagagtttccgctggtcagaaatctggatggagcttagctgggtgcatctgactctcatgaggtttcagtcaagctgagagctggggctgttgtctcatctgaaaactcaactggaagaggatccacttccaagctcgcccacatggccactgaccagaaacatcagttctctgccgtatgggcctctccacacagtgactggcttccttcaatgcaaacaagaaagtgagaaaagatgccccagacacgaggcaatgggacatcttatcgcttttgatgttttctgttcattagaagagaatcactacgtccagtcctctccaagggagggagttacataaaagcatgaacactatgaggcaggggcaatcaggaggcagcttaggggctgcctggcacacctgcacctccccatccacatccccttcgcctcctcacaaatgcaatcgtcttgtctatggggtctaccctgaccactgggtagctctcaagctcttgtctctcgtctcttacttcctctgcttttttttctaacatagcacttatcatcttctaatattctaaattactttcttttttttttttttgagatggagtctcgctctgttgcccaggctggagtgcagtgacatgatctcggctctcagctcactgcaactttcacctcccaggttcaagcaattctcctgcctcagcctctggagtagctgggactataggtgcatgccaccacactaggctaatttttgtatttttaatagagacagggtttcaccatgttggccaggctggtctcaaactcctgacctcaagtgatccgtcctcctcagcctcccaaagtgctgggattacaggtgtgagccactgcacccagtctaaattacttgtataatgttagtttctttctttcttcctttctttctttcttcttttttttttttgacagagtctcactttgtcacccaggctggagtgcagcggtgcaatctcagctcactgcaacctctgcctcctgggttcaagtgatcttcctgcctcagcctcccaagtagctgggattacaggcacctgccaccacgcccggcaaatttttacatttttagtagagatggggtttcatcatgttggccagggtggtctttagctcccaacctcaagtgatccacctacctcagcctcccaacgtgctgggattacaggcatgagccaccacgccagaccttataatgttaatttctgtctctcccaatccaaatacaaggtccatgaggacagagatttttttttgtctgttttattctctgtttacccagcatctagaacagtgcctgcacactgacatccaataaatatttgttaattcaatcctccgtgcatagttatataatttgcttttctacagtatgtcttggagtatttccaaggcagtgtacagacatctactttacttactagaaagagtccacattgtggatgttccgtagattgtttaaaatgttgccctcttgatggatgtttactggtttgtgtgttgtcgccattttaatttatgctgtcacagacatcctcatacataccttttcatgcatatgtgtgaataattatgaaagaaaggcccacagaaatcaaacaatcactttaaacccttgtctttttgtggttgaattatacaaggagggaattacataagggcacttttacttgtttgctttaaagtcaagccatgttaatggactgctttaccttccttttcattgacgtttaatttgtgtggcttgcatggtgagcttgggattctagttccctgttatctattgggtctggtctgagaggtgtcatttatgccactgtagtactactactttccgtagagttagaataactgaaaagcatgttgtcctgatttgtgcaaggcgtcgtggtgaacctggagataaaacattactttagttctctagaaacttgcactgtgcttggtcattgaacataataagtgaaatcataggcgataattcaggcattgagtcagaaataagtgtgagcaatttacaggcaagagagggcctggaaaggggtgtagggagaaagaatgccacaggagtgctttggttgactcagaatcctttgcagtaacatccacaatgcctggggaccatgagaatgtcccctgtacacgtggcagattggctgaaaattcagtctgagctttgatctgaggaatgctgggtagcagacaagcggccgatcgtggtccccggaaagctctgagtcacggttctggtgtgatcaggactccaaaatctctttctggtgatgacatttggcccagcatgaccccaggggggcatccctcttacctcctttctcctcattctgcgtgaacgactttgcggtcgttcactctcacacccctgccaacttccattgcacaagcacacaatttcccatttgcaaatatttgctctctgtctctgagcttggcatgactggaacctgttatgaaatcaaaccattgccctggctcaccctcaagggccaaattaccccaacataaagaaattcctgcagcatacatgggcctgggcccctccttaggagtggctctgtcaccattcccagaaggttgtctgcttgctttggaggaattcccaggagcctggcctgccttttgcttcaatctcagctataaaaagggtggaaacatggaaaccaagtctctccaaaggacggtaggatgtgtgatagaaggtgaaagtcagagtgcctgaaccccagtgtgtccccagacaacactgctgctgctgcaccacccagcacatagtaggtcctcaacaaatgtgtggtgaatagctgggtagtagtagaagagcgcttctctttttgtaagagcccctggcaaagcagatctatttcttcccggtacaactttatccaaatgaaaccagtgaaagtgagcactgagaggcattctggaaagagaagccttaaagggcagcctagggctgggagtggattggcagcaggggctcacggcctttggccttggtgctccccagtagtgttgtgaggggtgggggtgggtggttcatttggccacattaatgcaaatgcatctcaggtttcttttggttccaacagggacgcccactgtcctttgctggtctgtggcctcccagtgacacctgcagcctccaggagcccatcttgctcccgttatggctgcccagagtaactggagctccccttcctcaccactttgccctggcatttccagacttttcaaagcactttcaaagtcactatctcacatcgtgcatgctaactgatgtgtgattgagattttttttacatattaagatgagtacataactcaggggaaatagcagactttttaaaaataaaaggcaaagtcctcaaaaccaaaaccaaaaaaagataccccctttgccgacctgccagcccaagttgttttgtcaggacagacaggtctggcatttcaacaccagagggagctagtggtcaagttatgtagacaagttagttgcccttctcaagaaattctcaacttggctcttttattctcttttccgtcacttcacagagaggcagaagacagctttcatgggtttggtgggtggagcaggtgtggtgaatgagcatcaaagggcagctgatgcaatgaggcagggtagtggggacagaattctgggcacagtgctgttgcctggtctctgatcagcccgcggatcagagttattagtgataactccattagtcaagtcggtgccatggcctggctgcgctggagttttcttgtttgtttttgtcctgagaaagccaccctgccaccacctcaccccacccccacctttagcccaatgggcatcttgggttcagtagctcagttgaactgtccaggctggtctgggggggctctctccagacaggtgaccaggttatgtagagcattacggagatctggctgcttatcctgcctggcttcactccaggaacagttttggtttttaaacatttttagtagactttactttttagagtagttttaggttcacaacaaaataggtcaaaggtataaagattttccacaaaccttctgcctccacacatgcacggcctccctcaccatcagcattctgcaacggagtggtatatttgttaacggtcagtgaaccttcattgacacatcatcatcaaagtccatagtttacattagggctcactcttggtggtgtacatttccatgattttggacaaatgtataatgacatgaatctaccattatagtatcttacagaatagttttactgcactaaaaatcctctgtgttctgcttcttcatccctccctctctcctaacccctggtaaccactaaactttttaccattttcatagttttaccttttccagaatgtcctatagttggaatgatacaggggatagccttttgagattggcacctttcacttagcaatatgcatttaatgttctgctatgtcttttcacagttgctaactcacttctttttaaggctggataatatttcagtgtctggatataccatagtttatccgttcacctactaaaggacattttgcttgctttcaagttttggcaattatgaatacaactgctataaacatccatgtgcgggtttttatatgaacataactcttcacctcatttgggtaaatatcagtagtgtaattgctggatcttatggtaatggtatatttagttttgtaagaaactgccaaactgtctctcaaagtggctggaccactatgcattcctaccagcaatgaataaaaagttcctgttgcttcatatcctgaatggcattgggtgttatcagttacctccttgtattttggccattttaataggtgtgtagtggtatctcattgttttaatttgtaatttcctaatgacacatgaagtggagcatcttctcctatgcttatttaccatctgaatatcttctttggcgaggtgtatgctcaagtcttttgcccattgggttattcattttgttattgttaagtttaagagtttgttgcctatattggataatataggcatatattatcatatatgtcttttgtaaatactttctcccagtctgttacttgtctttttattctattggcagtgtgtggtttggttttgtttgttttttgtttgtttgtttgtttgttttagtttggggaggtgggggacagagcaaaagttttttattttaatgaagttcagcttatcagctctttttttcatggatcatgtccatgcatcatggtgttgcatcaagaaagttatctgtgtagccaaggttacctatattttcttctatattatcttcaaggagtttcatagttttgccttttacatttaggtctacagtccattttggattcatttttgtgaagatcgtaaggtttgtgtctagattcactgttttgcatgtctagtttttctagcaccatttgttgaaaactgtctttgctccattttattgcctttgcttctttgtcaaagatcagttggctgtatttgtgcgggtctgctctgggctgtctgttctgttccattgatctatttgtctgttccattgatgttttgccaattccacattgtcttgattacttcagctttatagtaagtcttgaaattgggtagtgtcagtcttctgacttcgttctttttcttcaatattgtgttagccttttgcttgggtcttttgcctgggtcttttgcctctccatataaactttagaatgagtttgtcgatatccataaataacttgctgggattttgattaaggttgcgttgaatatatagatcgagtttggaaagacatcttgacaaatactgagtctttctatccatgaatacggtatatctctatatgtatttagttcttgatttttttcacaacggttttgtagttctacttatatagatcttgtacatattttgtgagatttatatgtaaatatttcatttgggggaatgataacatagatggtattgtttttatttttaaattccatttgttcattgctggtgtataggaaaacaactgacttttgtatattaactttgtattcttcaatctggctataatcattattggttccaggagttttttgttgattcttttggattttctacatggacaatcatatcatctacaaacaaagatagttttatagttttatttcttcctttccaatcagtatactttttatttctttttcttgtcttactgcattagttagaacttccagtatagtgttgaaaaggagtggtgagagggagcatcctttttgtgttcctgatcttagtatgaaattggctgtagggtttttgttgatgttctttattaagttgaggaaattctcttcagttccttgtttactgagatattttatcataaataggtttggattttgtcaaatgctttgtctacatctattgttagaattatttgattttttttctctctttagtctattgataacaattgattacattagttgatttttcaaatgttgaaccagccttgcttgcctgggataaatcctacttggtcatggtgtgtaattctctttataaattgttggattcaatttgctgattgttgttgaagattttttgcattcatattcataaaagttattgatctgtagattttataatatctttgctttgatattatggtaatggtggcctcctaaaatgagttaggatatattctgtctgtttctttcttctagaagatattatagagaattgatataatttcttccttaagtgtttggcagaattcaccatttgggcctagtgctttctgttttggaaggttattaatgattgattctattgctttacaagataagcctgtttgtactgtgtatgtcttcttatgtaagttgtggcagattgtgtattttaaggaattagtctcattttgtgtgggttatcaaatgataggcataatattctttataatactcttttattcttttaatgcccataggatccataatgatgtcctctcatttctgatattaataatttgtgtcttctctttctctctctctctctcactagccttactagaggcttattgagtctattgctctttacaaagaaccagctttttgttgttggtttttctctactgattttctgtttttaattcaaatgatttttgctctaattcttattatttcttttctcctgcttactttggatttaagtaagctactttggtctcctttttctagtttcctaagatagaggcttagattattgatttttagaatgtttttcctaatatatcattcaatgctataaacttcctttgaacactgttttgctatatcccactaattttgatgttggatctcatggtagttcaccggggagtgggatattatttatttatttttttgagacagagtctcactctgtcacccaggctggagtgcagtggtatgatctcggctcactacaacctctgcctcccgagttcaagcgattctcctgcctcagcctcccaaatagctgggattgcaggcatgcgccaccacacctggctaatttttgtatttttagtagagatggggttttgccatgttggccaggctggtctcaaactcctgacctcaagtgatccacctgccttggcctcccaaagtgctgggattacaggcatgagcttccatacccggccggtaagttgtattttaattaattcaaaatattttaaaacttatcttgagatttcttttctcactcatatgctatttagcaatgtgtttaatctccaagtattttggaatttttgagctatctttctcttattgatttccaggttaattccattgtggtctaaagccaacattgtatgatttccattcttttaaatttgttaaggtgtattttatggcccagaatgtggtctttcttggtgattgcttcatatcttgagaagaatgtgtattcttctgtcaccgaatgaagttgttgatagatgtcagttatattcagttgattaatgttgctgttgattcagttgattaatgttgctgttgattaatgttgctgttgatttgattaatgtttctgcctgctagatctgtttatttttgaataaaggggtgctgaagtctccaattataatagcagcatcatctgtttctccttgtagtaccatcagtttttgcctcacttactttgatgctctggttttaggtacatacacgttaaaaattacgtcttttttgagaattgacctttttatccctaataactttccttgctctgaagtctgctgggtctgaaattaatttagcttttctgcttttttgggtttagtgttagcatggtatatcttactctatgtctttacttttaatctgtatgtgtctttaaggtgggtttcttgtgaacaacatatagttagttgggtcttgttttttttgatccactctaacaatctgtcttttaattggtatatttagactattgacatttgaagtcaatgattattgattattgacatacttgggttaatatctactatagttagtactgttttctatttgttgcccttattctttgtttctatgtttgtcttccactcattttctgccttttgtggttttaattgagcatttaatatgttcgtattgtttctctcctttcttagcatatcatttatactttcttttttacttattttagtgcttgctgtggagtttgcagtatgcatttacaacaaatccaaatctactttcaaataatattgtgctgcttcatgacagtacaagtaccttataataacaaaattatcctaattcctccctgccatccttgtctcattactatcatttatttcacttacacataagcatacctagcatatatgaaatactataattacacataatcagcacattactaatattatgattttgggcaaaccattagctgttaaattaattaagaataaaaataaaagtttttattttacctccacttatttcttcacctttctttacctgctctctttttcatgtagatccaagtttctgagctgtatcatttgtcttctctctgaagaactacttttaacatttcttacaaggcagatcactgcccataaattccttccatttttgtttgtctgaggaagttttaatttctccttcacttttgaaggataatattgcagggtagagaattctagggtggtggggtttttatctcaacattttgaatatttaacttcttgatggcatggtttctgaggagaggttggatgtaattcttatttttcctcctttataggtaaaacttttttttttcctttgacttctttcagcgttttttaaatagttgattttctgtagtttagaaattatatgccttggtatagttttttgttggtttgtttgtttgtttctttttggcatttatcctgtgtggtgttcttcaagcttcctggagctgtggtttggtttggtgtctgacattaattttgggaaattctctgtcctcattgtatcaaatattaatatttttttctgttcctttctctttcttctcgtagtggtagtctctttttgcatatgttacactttttgtagttatcacccaatccttggatattttttccagtctttgttctctttattttttcatttttgaagctgctatggatatatcctgaagctcagagattgtttcttcagccatgtctagactactaataagcccatcagaagctttcttcatttctgttagtgtttttgatctctagcagttcttctgattctttcttagcatttccatctctctgcttatactgcccatttgttcttacatgctgtgtacattatccattagaacccttagcatattaatcatagttgttttaaattcccagtcagataattccagcatccctgctatatctgagtctagttctgatgtttgccttgtcacttcaaactggttttttggggtttttttgtttttttttttctttgccttttaggatgccttacaattttttcttgccagacattatataccgggtaaaaggaactgtcagtaaacaggctgttagtaatgtgagtaacgtgtggagggagggaaagaattacatagagctgtgattagggtgttttcatgaatttgtgcctttgagctgtgaacctcacaagtgctgttcagtcctcccctggccttagataggacaggatggctagagtgggctggagttggggatttccttgtccccagatcagtcggggtctgataaaacctcaatctctgataaaaaaaaaaaacaaccctcaacctctgataaaatagtttctcctaagagaagccctcgttaagaagagcagagtgctctgggctattttaaaaaatggttctctccccacgttccccacccccaacccccacactgaaatcctgagattttctccatatttactatgagaatctagttgagctcctgaagagcacgactctcaactgaatgtacaaaagtctatcaactcaacgactgggtcccccttagagtttttgactctcaggcttgtctgctctgagcccatttgttggttacagttacagtttttctaccccagcattgttcctacagaggtttctgcttcagtaagttgcgattctctgtattcgcctggttggctgtctaattctgggagcagcagtttcagtttgccctaggacttcacttcacttggtggatctcggaagagctgttgattttgtagtttgttcagcgttttgcttgttagaatggagtgctgctgacttctaagccccttaggtgccagacttcaatgagcaggttgttttcacctgtgatgtcttacaccaaggacaactaagtgaagagggaaaagcaaaggaattcattgaattcagactggagatctgaaagattcccagtccctggagggaaatataaatgtgacatttacttacttatctatatttagggtatacgtagaaaggatggctggaatgaagtactagaaacagtggttatctctgcaaggtggtttaatgaatgattttggttttgtatgatggaagacatatctatataaatatatttatactgtattttccaaattatatcttaaatgaacatgtaatacttcatgaacatataatacaatctcaaagaaaagtaagcaacatcttaggccatgaacacttatctgtcttttctccatgtctccttacagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaaggtaactggctgtttggtggtgttgctggagcccttttcaggctagcatttctgtgctgacttccagagggtgctctggagtgaggtaataagattcctgggtttgaggtattttactcagaactgcagtacttaaagaaaaaaacaaagatagaagccaggcaggtaacattaatgtcttcttgagctccaaaagtggactgaaaacacagcaagcctcaagggttacgtttgccaaagaaacataaactttgagatgaggaatttgaaattccttctagaaaaagcttaacaactccatacaaggaaatggacttatctgcttccagaactggcatgaaagcaatgtcagtgtctgaacttcacccttggtatcattataatggagataaatgggtgaagaactggaaccacattcttttctagggaggaagccaagatgatttgtgatcataccagcactgagctgcctggggaatattgttaatgtctcacgacatgaaacatctgggccattctttggagaccaaaactgtctctatctctgtgacattctaaatatcagtaagaagagatccatttgccaaaatgttattttggtaagtcagggcccacagatgtaaacagggggaaaggcatccgtagcatttcatttgtaggctcttctttagccctggctcctagcctagaaaatttaagaggtctttgaaaagtaagttatgagaaaattagaaccatgttaacagggcagaaaatccgggtgaagggtgcagtggggcgtggccctcattgcccagtggcgaacatcctcaagccccctgctagaaaagcaagtctgactctaggtacctctgcaatcttccgcctaaatagtctccctgaattttgccctgaaatgtcttctaaaggcatttcctacatttcctggtcatcttgtcatgttagaagctacccgtggctcttccatgttgcttctcttgtataggaaaggttgaagggttcttattttcttaaacttctcctaccctgttttctcaataagcaaagctgttgtgcaagggttgcagaaaaaattctcttctctctggttgagataactgagactttgtgcttttggtggctcttctcagctttgtaaattccactggtggaaacaagacttcagttgttgacccaaggccctggaattgcaagcagagtatcagtacccaagaatgctagggccctgctgaagaggcaagctgagcaaacactctgtcatgacaacgttatgcaaacacatttaaaagctctagagagaacccttttcaggagacatggtttttattcttgtctagaagtaaattaagacagaatctttgtcatgaaacatttgaaagaaaactcagtacctgctgtctttgcgctatatttacatgggttgtcatgccagctgtgagacattgtctgccttgtcttggatttggaagaaccaacaggtaagaagccaacatggagaaattcaagaaggggcagggtggaaggctgagggactgtagtcctgatatttttattgctgggatgcttctgatgccaaaattgggaaaaaccaagttgtaactcaagtcactatgagaggttgggagaggagtgcccttggtctgaagctcaaaggcttctttgcaggaatatcagactttctggtgttttggtagccctcgtgttgccccttgcaactagtccatcatccagaaaggatgtgtgtgcacagcaggtagaccaagagttagtactaaaagggagcagaagtgtttgtgatctttgagtctaaaccactgatgttaatggagactcaaagtggatatgccagcatctatgcgaaggaacaaacctcactggaggtgttctattaaaatttaccaacaaatatcaatatatctgaaaatatttattgagcatctattatgtttcttactttgtgtaagtcactaggggcaataaaagtgccggacagagtcttacctttaagtatcctatagtctacttaagtggagaacacctcacaatatacacataaagatactaactataaaaagctgaataagatataaataagtgccaaacaggtgttagagacaagtgtcacattgctttgcatgagataacttgcattgcttggataggtggagggggacgttatggaagacatggggtgagctttgcttagaaaggtcaattgtatttggatagaattaaaagtgaacaaactgaagtctcttgttttcttcccttaaattggcaaatgaaaccttgagtctgtgctttcagaatatcaattcagcaagtaacactgggtattaggaacactctcttttttttttattttagcagtttttaatgaaagttatatgtaagatttattcctgaatcctctcaattgttttttccttgcatttgcccttctcttttcctacttggtgagatgtggctttccgttcaaagatctctttgcagtctttgtccagctttagcctggtgataaccaccttgctggggtagatacccacgtggatagttgaacattagccttttcctgctgtacccgtccaatgtagatgatgtatttcttcctgtaaacctggactacttttccagcttgctaacctttatggtgtcctcgcacaacccgaactacttcatccttttggatggggttggatcaaacattgtacctctgtctcagctctttggaatgaggggaagacatcatccttctgtgaatgtagggaaggtgcactgaaattccttttgtggttcttgctctggtcagacgtcacagagggatcgaacttcattttggctactttggcgatggctgcaagaggacagagatctactgaattcctgctgctctgggaactctcatggctcttatacggcatcttgatgcttttgacatcagaaaactctcaaccctcccttctgatgcctctgtccctgctttctctcctctctagctcattgctggtgccgagtccccgcagcctgcttctggaagctcaccatctgaggaagatcgatccaagtcagcacccacctccccttgtgaccagggtgagaccctcagatttgcttcctgacctctgagttctgccattggatggaccaaggagctctgaggcctctttaaccaagagtgagcttgttagctgaaatagctagcagccctggtgggttttcacacacccgttgcctgttgatttaacagttctttcattctccaagaccttcttgagggctgggcactccatggccatatctgccttaatttccttccaggccagggtaagaggagagcgagtgtatgatgttatggttctctgttttcccttgcctctgtccctggttccaagtgtactgcagagagaagggtacagctccctctcttaaagctcttgcctggccctagacctgtcaacaccactcccttgagttgagtttgacactccctcccccatcatcatacccaaaacctgagatcagcttgagtttggggctgggtgagggaggatgtcttctatcctggcctttgggtgggtgaggatagaaagatgaagctagaggagagactgagaaaagaagtgggaaggaggccagtcctaggcctgtttcccctctacagctccagatatctccttctgtccgactgtgcttcagacaataagttctgcagacataatttgcacaataataattctgcagccatccgagaatgatgaggctgaggagggacttacacttgcaaaacctcctgctctcgtgaccattatcagatatgcctggtaagggacatatgcatctgcagaagaggaataaccatcacagcctgacaatggtgccttggtttttctatatccctttttgtattcattatcctaattttatgcccatacccactctatgttggtgcttcattactgtcccccaggttagtgagtgggaagtgggaggtcagagtgtggaaaagttctgtcccaaggtttggagataagtcagtggtaagggcaagactgtacccatgctggctgagggacacactctcagaaaccctgccatcaaaccttccttggaggtcaccaccatgacccagaccttcttacccaggagtaaataaaagagcttcgggggtcatgcaccagccctgaggccacagaataattggtctcagtccctcttcgtgctactccaattaactttctgtgtctttatactctacctcattccaaatgagatttgaagcattcataagtagcctgatgtactctggggctgcagaacttgtagctattttcccagaccagtttgggggttttcacgtgttcctttctgaggctgagatcccctttgggagcttcagggagacagggtcatatagaaaagagaccccaggtaagagttcagagaccagggtttgtaggcctggctcctgccctgcatgctctctggctctgagctctgccattggatggatacagtggcaggatacagcggccccagggcctctgttcatcccacttgacacagacgccaggatttcccagtagtgatgttagcacagatgtccctctgagcgacattattacagaacagaaataagacatagtttctttttcttcccttgtaaagacacatagaaaaaccttttcttcaagctttggtgtccccaaacaactatgttttgccttccaaaattcatttaataactgaggcttttagctctattgtgagattaaaagttatttagtcaagctaagtgataggtggataactgctgaactggcaaggggagtgtctgcagactcagcagctttccccgtcttcaccctccccaacacgtctcagaggagccaaactccagatctaggaaagatctccggattccttgagtaagcccttatgggactctgtccttctgaaaagaagctgaagatctctttctgtcactcgtgcctaattctcattcccaagggttaataggctatgttccccttccataatccaagttattcacaagcatcatttaaaatcggattttgctcaagatgcccatttccacacagaagagtgcgtgtcttgatgaatgagttgctaacagtaaagcttcttcaaatagaaaaggtcagaggatcatccagcattatctcccccaggtaattcaggtcataagctctagagcggggcacaagactgtctcgtagttgagaaattgtactgagaaattcccgccccattggagataagtttgcaacatgtcacttgggaaagcaattcttttgttaataataagcccattgctcattttgttagataaccttgtgtaagatgggtatttagaagaaacccggcaacaaggctgagtaaaggtttttagaaggtatgaaggtttctaccttcaatgatcagccaccgttctgatggctcagttgttgaaataattatatcaccagtgattactgtgatgacagttcttgattcgttgttctcatcttcagaggaaacttgaaggatacctgtgactctgcagaattccagagagggcccagatttgtgtgctttacctagaacaatggaataggctactagccaaagggggctttcagagagacagccaggtccagtgtaatctggagttgacaagggcagggaagggactgtgtcctcctcctctttgcatacctaagctctgctgcgcattaggtgccaataagagtgtggtgaacagatgaaggaacatacaaagggatgtcacactggatctgttgtgaagaaccagaaagaggactgagagcttacaggggaaagtctgagtgttgagtcctaatgtaacaggcttaagaggtatgcactaatgcaatttcttgttccccttggccctagaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtctgtggcacacacgggtggaactgctggttttgttctactccttagcattgtttcgtctgtttgatctaagattgagagaggaacctttcagcctgatctcgttaggttttctttccttttttgtaagtgcaaatgacctgaggccaagtagataggagcgctggttctgctattaattggctatatgagactttcaagtagtgatttaatctctttggaattcaatttttctcatttgttgaatggggacaggaatcaagtgagatggtagatgagaaagcactttggaaagttttaaatgctcagtgttccaaatcaatagtagtgtcaatacatgtcttccctccttcagagatcagctgaaattctgtttttaatttgttatgaagactttgagaatgaatctctgccctcagcaaacctagggtttaaagcaaatttagcatgcattactttggaaggtaaatgttatttaactgatctttctggcatgtaataaatgttctgtttatcctttacacgtggcaagaaaatgggaataatcatctcatgccttggatcagggtcctctgcccttggtgccattctccatatcctgttcccactgagatgaacacagtggtgtggggtgtggcctttagtatgctcaataaagcactaaaggtgatcagccaccattccgatggctgggtgagatggaaaaattaactcctgttcatttagaaagaagatgaaggggcagggagcagaggaagctgtttgcatttcacctgagatctctgattgttccctggttctgttcagagctaagcctgggagtcacctttctgggaccccctgagaagttctgggaggtcctgctctggggaccaggaagctcctgggatcacatgccctggcatgtcctggactcttgaaagcagcagcctgtaggtcagtcagctggcccatcccacctggttcccagccgtctcacctgcccctatctcaccctgataccactctggtgggaaggtaactggggtttacttaaatggcaaaagctgaagcaattacattctttagagactgactaaataaaaagaggtcctctggttaggcataactctgggacctgaacaggatgtggtctaattttgagcaagactccgagattctaggttttcatatagtgtaggcagaatgggaacttagatgactttggagcatttaggttatctcttaggaaaaatcacagccaaagtttgagccagttttaaagagtctgtaaaatacgcgggcgacaaaaagtcttcaggttaacatcatgaattccctcattaagtttctgatggctgctttttagctttgatgacttacattggaatactgtacttaggagttacttatttaagaagagaaaggcttgtgacgtttgtaggtaaatgagtgcaaaaatatcaaatgataggaacactttaagaacatagaactgttaattagctctcttgaaaaggaatcacgtttccagcttcagagttataaaagaaaccataaaggcaaacaaggacagattcaactacataaagatacatgattcttttcaatagaataaaataacagaaaattataaaacaggcttagaaaaccttttacagaaagtaaagggttagtatctttatatatcacatgtgtataaatttgtaagaaattaatatgatagcagcataattagacaaaggagacgtgaataatttacacgaaaagaaatacagtcagaaaacagttaattttaaagtttcattttaagtaaaaatagcatcaaggtaacatttcacacctattaagtgagcaaaaatactttttaagtgaaactactcagtattggtaagtcaccatgaaactccaacacttctacattgctagtggcacattgtatcacacatcctttctgaaaataggaaatgtgcaaaatgcttcaccctttaatctacttatgagggtttccatcttacaaatgtaatccaagagaaattgttttaattgtgtacaaaaatactcaatgcaacttatataatacttaatgattagatataactgaagtgcctaatttgagggaaatggttaaataaattatatttacttgaattgagtataagcaaccgtgataataatggagaccatatggagaatgtctgtaagataatgttcagttaaaaatagttacattattttactgtactgtaactgtaaaaatagttggtgtactgtaattgtaagtatgacaaacacatataaacatatgaataaccattcaacagatgtgcattgaacttctcttttctatgcctgggcattgtgccagagatcaaaaataaataaattgtagtaactattagaatgtagtaactgtagaacggtagtaattgtagaataggaagttttcttaaacattatgtatacatcttgagagggggtcttgctatgttgcccatgctgatctgtaactcctgggctcaaatgatccttctacctcagcctcccaagtatcttgggtgcatgccaccacaccaggcttgttataatatttaaaattaaagaaaaaacagaattcgtttttgaagtatttggtattagcttacacttcttctttttattccatacatgcatagattgatggaggcaattgattgattgcaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggtatgttaggaagaagctggctggctgccatgttggggcatcttgactatcagataaaataccaattttagaccctctacattgttctctcaaagactttgtaaagtgggatgggttttacccttgaaaagatcaggatgtatttgaacagcatcttcttttttagggcacaggattttccattcaaggttgtgcttgtgaagggatgagagagctgtagaattctttgcagccagagttggacaaagccaaatggctaaactcactgtttgctcattggaaaaaccaacaagtgtggttagtccttgctctgctcctaactttctatcactaatcaaatcacttaacttctaagttattttcatgtcatatgaaaaagagtaaaggccaccttaatctcttctaatctgtgtaatgtcatctgaaataaaggatgtgaacaaatgcttaaaatttcatagtgaaacacaaatataaggcagcatttttaatttaccgcataggtgtctgggaaccagaaggtggcagtaaagaaacaaagataatccataactccatggtagagtctgactcgagtattattaactgatttgttacctgtttttagtaaagaaacagcaatgttcttcatgaagctctaattttgttatcctttttgaggggttgggaggagttaaagtcttttaggatcattatggatgtttgtagtattttgcttcttgagaaggcaaagacagacatcacctgaaactcctagctgtggcttatgtggaacccagaccctgagggtgacatcatggagaggtgataccttgcttctgggtgtattctcatctccatgtcattttgaatgccagtttttccacttaaaattcaatagttattcattgagtcatttggcaaacttttcttttattatatttcattatatccttcccgtgtatctgatgccatgccaggtgctggagatacagtggtgaactagactagtccctgacctcatggagtttacattatctttggtacaccgtttcccagagaggatttctcagaaccccaatcacttgagcagctgtaagaagaaaggactctgtgacccatagttggagtcactgcaaacgtaacctctcttagtctcaacacacgtatgtttattagcatccttgaggagacctgcaatgaaaacaaaattacctttgtttaatctacttttccgaacttatttgatcccagggtcccccatctctctcttacacacacatacacatgcacccacacacacacacaatgcccattccatactgaggaaccctgatccagtggaatttttcctatccttctgatctctcaggagaataagaaatatcgtctgaaaatctggaaatcattctgcttatctttcaagatggacacatatttctttgtctacgaaactttcctcagagaccactatttaataggaatctatccctttttctgcacaagtataagaattactaactcttctcatttttcatgtgtgttgtgtaatgcctaatatttatgggtttgtgtgtgtacagaatcctgaataatagagactcagtgatggagttaactttcttcttttttccactagagcataattttagattcatgagaaatgtatcatattttgtattttccatggtgcctatcacagggcctcacacttgacaggtacccacggacagaatcaaagacttggaagattttttcaaagtcaccttatctttctttatctctctctcttttcctttcttttcttttcctttttttttttcttttctttccttttggtaccagtgagaaaattgggtttcagagaagtaaaactattttgctcataggcactccatcttggcagagtcagacctggcatctcatctagtctcagggactcccaaggtagtggggccttgctctgattcacattgctagtttcttgtgcctgatccagcacagggtcccttctgttggaggaaccctcccacttccccctgtccccagcaggtagccctccctctcactatctgaggtggctttccaggcagggagccactctggcaagttttctttacaccattatcaagaagcccaacatcctaggaggggtccagtttagttgtgagggctctatggagcccctgtacgtggtggatcatgggaagccacgttgaaggtcagcttggtgaatgagtgagggagtgggaatggatgtcttcaatgtcagcagtgttctcctttgtgcgttgtagaataacaaggctaaggattcctcatcatatggcagcttttggagcacaaaatggtgttgaataacaccagggatttcttttatggcagaacagtgatcaagctaacatggatgttgtcatggatggctgtagggtgaggatgggcagagaaggagcttcctctgtagttcagatatttactatcttttctcaggccactgtcaggcagccacagtcacaggagcagctttgcaccaactctctcatgccacctcagtttcatagaatacttagctttatgtaacagatgcatattcactgaatttttctaaactgaatcatattttaacctcatagaaggatcttaacttacttatgaaaggaacctgatgaagaatcagcttataaaccttcaacttaactttttaaaaatgtgactttccctatgacaaaccaacagtttatcatagttttaaagagtagctattattcacctgactctgaggtagatgctggggttattaaccaaaggaagacagttctcacgtggaaggattcactgataatagattgggaggttattctaaattccacaagctaagagggagtagcaaacagcattgaatagttatgttctagatgggagtattcaaaccaagaagactcaggggagggggtcttccctacgatctagtggaagaagtgcgatcaagccaggctttgaaaggtagagaggatttggacaggatttgggaatagcagctgggtttggtagccacagaattcagtcttgattgagtttcacttttcctgaaaacaaaggacagttcctctgagccaccttaaacctggtttccactaagactctgatacaacattcaggaacacaaagacccgattgcaatcctattaagatttctttcatgcttgtttaattatgacatacagaacagcaataatattaagtcgagtttaattatttttaggtgagcctttatttttcaatatatcggaaaaaaatggtccttttggaaacattcctttgagaacttcttctgagagattagacattgcttcagactgcacactacatacaagttgcctggaaagactcagaagtgtgtaaagtgatgtcaccatatctaatacggtgaccaatggcaatggtcatatgaacccattggcatcagtcatgatgacatagtcaggttcaggtctggtcagtgcagcccagtgaagggccaacttacagctgaagagagatttgggcttttctttactgagcccgcctacccttggctcatgtgctccatccgctccatgggatctagaaaggcaaaaagcaaataaaatggctccagctttccagggctagtgagaaaaagcagacagaacaacaaattaagccagtggttttaatttcagtcaaattcaaaccagtgtgtctttgggatgcaagagtaacctgaaccatgtagggaattctaccaaacttgatttaatttactgtcaaaatataaagtacagaaagaggaataaagaacttctaattccagtcaagatcaagtagccacattcgtcccaggtcctccctcttacaactaaaaatccctggacataattcttattttataaaggtagggtgcttatcagcttatcaaaattggcatagtcacaaaaaactgtatctgttgatgtgaatgaaagaccaaaatttttatatttaaaaattctagaagacttttaagtgggtaacattgtcagtagtgtttaatattttcttgcatatgagaaaaaaaattttttatacatccacagttgtttcttgctataaaaaaattatggcctataattgtttcaattacaagtctttattgttaagcatctatgtgctagacactgtgctagattctagggctacaaagctaaaagataccaactctgaactcatgccaattactgcctagtagagagatagacatgcaaggaggcagtcaggaaggtttcctgatggaggtagaacctaccctggacctggaagcatgggtggcatttgcaagagggtaggggtaaagacatggctgctgaaacctagaaattatttccaaatctcatttgtattatttttccaatgcttgaactcccaaccaatgctatctcctacttcttccaaggaaatgataatggctaaaccagagcaaagaaggaagaggagaaagggagggtatttggaaaataaggagacagattcctgcatctacaagatcagatgcctatcggtagaggagggaggtaatgctgtgagccctccttattggactgctaggctctaaaacttaggggcttggtcagggtttgtgggggaagtgacttttggaattgcctctcccagttcccaggttcccattcaggcattgactacaagggataggagaaccactgagaggtagttttgttttttttttctggaagttacaggaaatgaaattcccagatttttagagtctgtgcatttgtatttatgacccccattgttgaaaccattctctccaacaggatcccacaaaacctgtcttgaataatttcatgatttttcctctttaaaaatttcatctctacacaattctacccatcccccaccctttggcatttcctgccaggcctgggaagccaaattctggagggctttgctgcaaaggaaacaaagggtgaactagagaatctcccttagccaatctcccttgctgccctagggaaaatgcagcatggaaacatccttacaaagcaacgggagacgtttttcaaatgcgtttgaatcatctgtgtgagcacggggagaagtgagaaaaggagtgttaacaacgtaggagcaaaagtgtcatttcaaggaactcaactctgaagaacagaaacactaaaccaaaaaaaaaaaaaaaaaaaaaacaaagtaaaaattaggccattggtagattttgttctaaagagacagctatgtcagattaaatctaaacgagctgacagagccgttgaggatgggtctctttcctgctagaccatactgtctgcctgaggcaccactactactccgaaggagttggagagtgtgtgagcaggtttggtgagtgcttttcgagaagagattgagatgctcaacacaatgagttggtttgtgggtcaggcagccacctgggaatcaatatgctcgccagtaacagattacaagcagagatagcctcagtaatttgcaatggattttagagaaatgagatccgtggtagaggttacaggcttagtgttggcagaatcagttattaatagaatcagactccagggaagtccatctctttacttctgaagaccatctttgcttgatagtgggctggacagcaatgccatttattctgatcagccaattaacacatctttagtgagcacctatggtgtgcaaatcactgcaagatgtgacaagacttttatggcaggacctttggtcaaactagttgaggggtaagctctactctcttgtgaaggaatgcacgggtgtatgtgtgtggtggcgtgtgtctgtgtagatgagctggcggttctctggccggtcagagaaagatcgtcactggtttccacgatcaagcaaggcttcatggagcaagacaacttcacccaggtcttgaagcataacaggattcattctgtgtgataaaggaaaagttgtggagtttgttaatgctcatgtgtcccaggggcagagaaggatgtgttggctcttaatctaactgctgcagcttcgtgtaacctctttgcatataaggaaaccttacatttgaataggacctttgcttttaaaagtgccctgactggctaggtgcagtggctcatgcctgtaaccccagcactttgggaggccgaggcaggtggatcacctgaggtcaggaattcgagaccagcctgaccaattcgatgataccccatctttactaaaaatacaaaaattatccggacacggtggcgggcacctgtaatcccagctactcaggaggctaaggcaggagaatcgcttgaacccaggaggcagaggttgcagtgagccgagatcgtcccactgcactccagcctggggcaatagagctagactctgtctcaaaaaaaaaaaaaaagaaagaaaaaagccctgacttagatcagccattttataactgcctaatgatgtctctatgaattcacctaccatactctatggttattcactccccctttttttttttcggaatttgttattgtggtaaaatacacataatataaaacgtgccatcttaaccgtttttaagtgtacagttcagtggtattaaatgcattcataatgtccatccatcacccctctccatctccatgcctcttttcaccttacaaccctgaaactcaatacccattaaacagtaccttcctattccctctccccacagcccttggcaacagccactctgtcagtctcaataatcttgactactctaggtacctcttataagtggaatcatacaataatgtctttctgtgactagtatatttcatttagcagaatgtcctcaaggttcatccatgatgtaacgtatgtcataatttccttccttttaaaggccaaatactattctatcatgtgtataatatcacatttcacttatcatctatggatggacattttgacttccacgttttggctactatgaataatgctgctgtgaacatggttgtctgaatatttctttgaggccttactttcaattcttttagctatatacctagaagtgggattcctggatcatatagtaattctctttttaattttttgaggaaccgctatactgttttccataatgactgaactattttacattcccatcaacagtgcaccagggttctgatctgatttctctattactttgcccaacacttatttctttatttgatagtagccattctgatgggtgtgaggtagtatctcattatagttttaatgtgcatttccctagtgatttgtggtcactcatttttacagataagaaaaccaaggcccagtcaagtcttataatttgtttgcaacagaacccagattggaataaaggtttcccaacagtctttgttgttcaccatgtatttctgtctccttctctgtcctcctgtccaaattctccacttcaaatagcctcacctccaaatcccctcttccccaattcctgtcacacacatgaaaaagggtctgaaggggtgtcagctcaattttacatgaactcaatgaggctgggattaaaaaatattaatgtcccttaagctggcaagaggagcagggttgatcagcctgtttctggaaatgtttctgttttctgaaagcgtaagagagaaaggaggaaaaagggggcatgggcacaggaacgatccaaaatgggctggagtaggatgaggccctcacacttgtctgtttagccattgcttactgagcacctgctatgtgccgtgccatggggcatcatggggcgccatgctgcctgctgaggaacacaggtgtggggaaaggtaggtaggagtcccggccttgtgaacttgaagcctcatgggagcgtaaaactgctggcctctacagaggttacagtgagccgagatcccgccactgccctccagcctgggccacagagtgaaactccatctcaaaaaaaaaaatttttttaaaaaaagcccttctggcctctatacagtgcccagaactcagtgctttattttccttcagaaactgttggcctgatcttcttttgtaaattgtgttttaatcacaaagattatttattaattgtagaaattttggaaaagtcacaagaggacaaaaaagaaaataagaacaattcacatgactactactaacatttcgatgtgtatcattccagttttagaaaagtacatgtctgttcatacatatatatttataacatcagtatcatactctatgtaaactgtttcacttagtaatatagtagagctattttccttgtcactaaatattcttcagccaaatgatttctagggttctacagtatctgagggcgtctcgtagacattctgcatcgggggttgcaggtggctggtaagtgcctggcttcctcccagctgatgttagcagtgaatggaccgcatgctctgcccagtgctggccagtgatggtgctgcgctctctgcagcagaactgcctccttctatttttatttctctctgtaacatcaacctgagtacaacatgtaaataacctatttggcattgacataatgcaaactaagacttaaatgtctttaacattaaatatgtgtgtatacagcaggtctttgaataacctgattttgttcaatgtcatttctttataacattaatgagaaaaatatcaattcctggccagggccactgactatgtggagtttgtactttctccccatgcctgtatgagttttttttcagggacttcggtttcttgccaaatcccaaagctatgcacatcgggagaattggcgtgtctaaatggtccccatctgagtgtgggtgtgcgtgagtgtgccctgccatgggatggggtcctgtccagggtggttccccgctggcaccctgagctaccaggagaggttccacccacccataaccctgaactgcagcaagtgggtaaatgatgctcttactcatttttcttcatctttcttaaacatatgtatagctcacatttacttcagtgcttaatattagaagtgttatttcagttttactattcaaagtgttctaaataatttttcttagaagtctgatgtttttgtagccagaagtatacttaggaacttaactcttctttataccaattagcctatggtaaaactggtttccttacgtgtcttttcacttgaagttgcagtttctaagaacttaccaatgacattgtgaggacttcctgtacactgtttggctaggaggcatttttttttttaccactaaggaatatatttacccattctcctaaactgtttgctttttcttgtaaagctgttggttttctctttttttttttttttttttttgagacggagtcttgctccgtcaccatgctggagtgcaacggcgcaatctcggctcactacaacctctgcctcccaggctcaagcaattctcctgcctcagcttcccaaatagctgggattacaggcacgcaccaccaggcccagctaatttttgtatttttagtagaaatggggttttaccatgttggccaggctggtctcgaactcctgacctcaagtgatccgcctgcctcggccttccacaatgctaggattacaggtgtgagccactgtgcccggccaagctgttggttttcaaattacattttgtggaggtgcctctgttgcttcagtgtatggtgggtgggagctgggtacacagacccagtatgcgctattagaggaggatgtacacgcaccacctactccacctggctgtgcagctccatgtccgactgtttcacatgttagcattccaaggaagataacatttgaagaaaggatttcactttgaaaacagtttaaaaccactacagctctgactgggagctggagtgagtcttgatttttttttttaacctacccatattataatctaatgtatacaggtgtcatttcctgaaggtctccattacaaatgtcctttcattattaaaatgggcacattcctgagatttgggcagaaatggaattttggaagcagattcaagattctggtattctgtctcagtaacatatttcattgtttagatcacgccacagaagtgcctgctgatgtgtaaaagtgtgtgtttaaacctttgactcactgctgacagatgtagaggcctgtgatagaatgtaactgggatgtcacactacttcattgatcaggagaatttgcgtcagaatcttttgaggcacagttgggagataacagggactgggaaggagagatatgacaaggcacagcaaacagtaacttagaataaagacagtatgtgataaagaggaaggagagacgtatttattgagcacctattatgtggcaagcctatccaagttgtttaaaagctgatttcatcaatcttacccaagtcccatgggatgtaggtattgttgccagttctttgggcagctaaggaaacagactcagggaggcttaaccatttggtcacgatcacacggagttaagtgataaagctgggatccccacctttgcctcctgggggtgagaagggccactgtggaacagggtggatgctggggcattggggggcagggcacagtgagtttgggggcaggaggcgtttgcaggaacagacccctgatttagcgagtgtaatgatgagtcctgctgctgttgcaggctcatgctaggaagccgtgaggaagacaaccttgtgaggaggtactggctaagttgtggagttcttactctgctaggcaaggagtttgcacttattctggaagtaaagggggattccttgaagatattgtgggaaatgatgacttaaatcatagcctgacagctctgcgtagcctgcattaaaaggaaaaatgaaaagcagagatacctgtgagcaggctatttcaataggccaggagtccagaggcagtggggaagaacttctgcaggaagcactgacgtggccattcgctttcccctttgcatctgcaaaggcctcctgcttgtgaagaaagcatagtcctccctttagcacttagaaactgtcaattgtgtagccccttaccgattagaaacaagaacttaagttgctgctagttgcagcaggtgatctacacatttctaaggtgtcatttggtcacagttcagttggcacatcatgatccaatttaagtaaaaagtttcatcttgaaatctaaaactagaggtctaagttatctaacccggtcaccaaacaaagccagtttcctcatggctgacgtcagattctctcacctctccccaacgcccgccatctattggatttcagaatttacctttttgtgtgtgtgtgtccagtttagattcgtgttgaattttgatagtggtctggtggtgttttctacagggaaagtcatctggggcctttcatagggagcttctacatagtctattgagatgactccattgaagcaatgggctttccccatataacccgaactttttgtcctagtggtctgaaatacttcagacaacccagatgattcctaatgctctgattttgaagactttggtgggtggtaggtgcaacctattcagctgtttgggttcacatatgccctgttgacgtgtgggaaacacaggatgcagtaaagaaggcaccacgagtcaagaaactgcaggtctagctgtgacttctgccactgatgcttgctctgagacagttatctgggcactgacttttctcattcataataaaagatgtggggaggacacagagaggggagtttcaactacatgacctatacgatccctccagaatctgattctaaagacctgtgacaatgcaattcattgggaaatacgcatggtatcactacaggtttacctgttgctaatgcatgagtgagacaaggacaatgacaaagtcagtgaacagtccttctgtttagtggtctagtggtgttttctacagggaaagtcacatggggcctttcgtagggagcttctacctagtctattgagacaactccattgaagcaatgggcttcacccatgtaacccgaatttttcaaagctcaattcagcaaatgcttctaccttgatcaaagcctctgtgttcacaaggctgttattttacatcagggttccaaactcaaacacattttcaatgactaatgctcctacatcagaaaatttaccaggaggttttatagctgtctgtttaaagtacagcatagtttctagcacacagaaggttcaataaattctagcttctgtcttatccagttaacagtttcaatatcatcggccgggcgcggtggctcacgcctgtaatcccagcactttgggaggccgaggcgggtggatcatgaggtcaggagatcgagaccatcctggctaacaaggtgaaatcccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccgtcctgggcgacagagcgagactccgtctcaaaaaaaaaaaaaaaaaaaaaaaaaaaaatcatctatatagatagatcccaagctgacttgagagctttgtcatgtttctctttgcctagaatgatggcctgttctggccagttggccaactgtttgtgaaacagaattgagactacctgagtctaccattgttggtaggtttgacccctggcacactcatttcataaagagaaaatatgtattacctgtcccctaatctgggcacacgttgcctgtaacaacagcgatgggccaaccctgtaacctgtttagtcatctcacaagtgcctgttcaggagggcatcaagcaagaaatgactgacagccaccccttttcccagaagtttatgccagctagaagatgaatgctttgtggtagcacttttgtttcttaattatataacctgtttatgactttagaactacagctggttaatgtgaggataacatctttggctgtgtgtcctcaggagtttgatagcccttccttcttactgcttgacccatagcttgaactagggctagccacaagattccagtgaattcctgctgggccctttgtctccttcctgtcactgaggaggaggtcacaaattggggctggcttccaaatgtgtgaagaggaggttaccggttccagtgaataataacttggacagaactgtgccccccactgcatgtggtttgtctttggaggcttctggtgtagcctgaaaggagagaggggccatctgggtgggccagtcaccaccttcaatttcagggtcatctttggctcaataacaaaaatggcaggaatttctataagtgttcattacatgccaggttcaacttggagcattttacacgtattaatttaatcgtcacatcaaccctatgaggtaggactgttattccaaagagggatcatacagctggaagcggcagagcctaaattcaaacctggttagctagcttctattatagaaacctcattttgtctgaatgcccaggggagattagcctcctgaggattgataaaccaaggtcccaagagcccaaggtgtaaataaaatggcaattggttgatttatactggggtgactgaactacttacgtgagttgcccagggcaccctggagtaattctttaagggtggtattccaggcaatctgagttgtattgggaaagcaactgatggaaaaacagaccctctgcttcctgttatgaggacatttttttttttttttttgcagaggcaataggaagttgaagcctccacttttgacctcattggagcattttgtttttaccatgacgttccagggagaatgccaggaaggatcatgggcaaaaagaattctctcagtccgcctccttagtgtggcaggaggtacaaattaattcctttgttgggtcagtatgatattcacctgggattcatcagcagtatgtaatccattttatcgggaacacttgtgtgcgggttgctaggaagctaagcttattacctggctctggctcttagagctgagcctgctggtgctaacagatttgggcctgagaagtttgtggccttccctggacttcagaaggagggtggaaggtccagtaaagtgtccaaggatgagagtgaatggggaaaatgacttttgttctcagtgtttctttcaccatttatccaacctatccccatgtgtttttggtatttttttttctttttcaggtaagagtttaaatccaacctcctttatcaagccccagtttatgaaaactttctagattcaccagtgttaacactaaaaacataccaacacaaccaaaggaaacacgttgtcatgaatggtgaaatacttctaccatccaatttgcccagagttttattcccttgggagagcttcttaaagatctaggaagtatcttttgatgtacataactcagagattaaacacacttcacaaagtataggtaggctccactgaaagaaagctcgaaaatttgactgtaaaaaaaaacaaatgtaggtgtgattgttgaccttgcaaaagctaactcctattataaaatgtttacaaaagaattcacgagagaactcccggggttggcaagatccatttggattgccagacgtggtgactgaggtgcagcagtgctaggcagagtaactgaaccctgaagtgttaaaaaacagctgtgcaggagcagtaccagggaacgtaagacatctggaacacacacccccagccagggacgaagtgttctgcttcagtatacattagacaaccagtattttttttagtacctggtacggtatgtcttcaacttaatatcaggtattccagggatagaaaaagacacaatccttgttcaaagaactgctggtccacctagggaggttaggctaataggtgaaccagagaatgaaaatcagaggaagagatgagtgggctgactagtaggtatactcctacaaattggaggaaactgaggcacaagcgttgaagtgccccttccgggtcacatacacgctcatgtgctccctctctctcccttgctctcactctctccctctgtcactctctcgctgtctcataagggactttgtcacaggaataagaaccctgggttccacctaccccacaggagcacagtggcaaggtcccatctgattcaaggaaattggctttgtagggttgttattgtgtgaaaaggagcaagccctgtccaaggcagatctggatgtttgtgtagttcagatccatttagctccctggccagtgttgatctctgctgctttaaaccacattaatctctgggagggcaaactgacccatcactatgggaaccagagtgagcctgtgtcctgggtactaggtaaacactggaagtcagtacctggtagacgccataggcagaagcaaactggggccttccaaaagctgaaaatgatcaatagatatgattcttgtgcatccatatcccaggaaggagggattctgtttagctctttgagctaattgttaattttcaaatcttgaagacactattgagcatgaaatgcagatattcaaatacccctttctccttggtaggaaatggtactaacagtctgcaggatcatgggagtaaaaagcgcagtctaagcacataggcattcatggggagagtatacgaagttagagggtataaaagctatgtggatggttcaaagattaaggtaaagatgtgaaacctaaaatctcaattctctagaatgggacatttagacttcatgggtagaggaggacaagaatcgggagtatgggcagttagacaaaatcagaaagaagcgtagaagactatgcagaaacattaagaatgtagtggtggaaatgttacctttttggaagatggtatcatgcagaaggtttgaatgcatttctctgatctttaattctaccaaaagtgtcactctgatgtaagaaaatatttaggttgaaaaggtgaggaactggccacagctttcctaaatgtggttgacaacctgtatccaagagaacagaatgaattggtcgatttgctgtgtcatgacattttagggatgtttttgggatgtttaagggatgtttttgaaggggatttataagagagtaaatgagaccccttaaacacagagatctgaggcataagagctggtaattttaaaagatacacagctgactacagaaggaaagaagcaagtcccagaatagacatgtagcatatttccatttatataaaacccccaaacaggcgagactaaacaatattcttaggaggaaacacatgggtgatgaaactgtaaagaaaagcaaggggccgggtgtggtggttcatgtctgtagtcccaacattgggaggccaaggcaggaggattgcttgagccctgggaacatagtgagaccctgtctctacaaaaaattgttttaaattagcctggcacggtgatgtgtgcctgttgtcccagctactctggaggctaaggtgggaggatcgcttgagcctaggaagtcaaggctgcagtgagccataatcatgccactgtactccagcctgagcaacagagcaagaccctgtctcaaaaataaataaaagaattagccagggatggtggcacacacctgtagtcccagctattcgggaggctgaggtaggagggtaggttgagcccaggaggttgaggctgcagtgaagcatgattgtaccacttgtacttcatcctgggcatcagagtgagaccctatctcaaaaaagaaagaaaaagaaaagaaaaacaagatcatgattaccagggaagtccaaatagggactgaatgaggatggggagagaggttgcaattaaagagagttaaaggggtttcaaaggccagcaaccatgttctatctgtcaaggtgggtcacagctaaaagtgagtcttatttgatctttaaaatgcatatgcatattttacatattctcattcgtaggtatattttacaataaggcagggaaggggaacaagaacatgaaagcatccaaactgtcataggcactagcattttaaatgatgacatgctctccaaaaattcgaactttaacaaaaaactgagcttgtgcactacctctgtgtatcattcttttgccactaaagtttcgattttcctgttcttttggcagtatgatctgtctcaaggacaagaagtgtggtgactggtcccatggcctatttagctggaagaatgaagcgtagtccctatcctctttccaagaccaaggccaagatggggctcaagaccagggggttatctacagaactgctggcccaccttccacctaccctgggggacctccctcttgaaggttgggattcttttttttcttttttttttttgagatggagtcgggctctgtggcccagactggagtgcagtggcaagatcttagctcactgcagcctccgcctcccgggttcacgtgattctcctgcctcagcctcccgagtagctgggattacaggctcccaccactgcacccggctgacttttgtgtttttagtagagacggggttttgccatgctggccaggccggtctcaaactcttgacctcaagtgatccgcccgtctcagcctcccaaagtgctggaattacaggcgtgagccaccgcgtccggccgaaggttgggattcttaaagagtaacctagcccagcctcactctttcagcaagcagctctgagttggggggtaaactttcttcactgccacaacatttgtgttttgcaacatgtttttaaaccatgttttataactaagaagatgccaaacatttcatttggcagtttgtattatgaaaaccatagttatctttccattttcacctataaagtgatgttataaattgaaccttttaaactgtagatgtgtgtgttctttctagattctggcatattctataggggacatagcactcactgtgctgccctccccacctgccaccactggttgaaaataacagctttccttgctgccatcacatacgtaaatgtaactaacatttatagagtgttttctataagccaagaatgataataactgatgttctttttaaaaacttttaagttcagggtatatgtgcaggtttgttacataggtaaacttgtgtcatgggggcttattgtacagattatttcatcacccaggtattaagcttggtactcattagttatttttgctgatcctctccctcctccccactcccacaggccccagtgcatgttgttcccctctatgtgtccatgtatgctcatcatttagctctcacttacaagtgagaacatgtggtatttggttttctgttcctgtgttagtttgctaaggataatggcctccagctccatccatgtccctgtaaaggacatgatctggttcttttttatggctgcatattattccatggtgtgtatataccacattttctttacccagtctatcattgatgggcatttaggttgattccacgtctttgttattgtgaacttagctaatgttcttatggcacttactatatacctgtcattttttaaagctctttacgtatgttgattaacttaatctttgcaatagtcctgagaggtggatatcctgagacacagggaggtagaatgacttctccaacgtcacatagttaagaagtggtagaattggatttgaaccaaggcagtttctgttccattgtcctagtgttcatcattctacagtgctgtctcagataatatgttaaatttacatggtggtttcatcttttccacaacttttttatttccccattttatggataagcacattgaggtttggaatttcatgtgacaccggggtgaacagcagggggagccacaaaagtggcttggaggtgggaccaatgaagatcctgtctgttcactgcccccactaacgccaccccttgtgaaatgaaaaggcctccctgtatccctcagtcccagggtgagtggctcctgcaacaggaagaaggagcaggtcctagaccaagagctcaagcaagcctgttcatgcatcgctaattgcttaaacatcagggaaaggggtttgtcgtcgtatgggtttttttttttttgtgggaaagcttttcatacaatgctggctgactcctgagccttaaagtaaacaactacatcatcctgtacagagggagtcaggaaaaggaaactaagaaaatatcaaactcctgcagctttttttgaaatgtaagtggaggaggaaatgatgtttggagggcatttgctggggtccttgtaccagaagactccatgaataatgatcctcttcccaagctgtgtatctgagtaaatgtttcccacactgtcctttcttctaaataccctctctgtgacgcaaggtgaaaaacccacccgcaaaacatggctagaagattctgtaaacccattagaaagttaagctatttcccaccagggagtaatgaaaagcctcacttgcaaaactgctgggtgactgagctgatcactccctgagatccccacatcctgggagggcagcatcctcactgctgtctccatagtctaagaacatggacaatattctaggcatccaccttgaacatggagaagacagcactggagaaccttgcagatatagacacactcagaaagacagcagacttgttgaaaaacaagcttattttctcatccatacaacagatgtgaacctcctgtctaacccccaggtcctttaaacccacatggggcactctggagtgctttcctgcttccctagctaagtttaagtctttcctgtcctcccagaataccccaagtagtggggcggtcccaaataccaacttggtagtgggggttagagagagggagagactgaaaggacagaagacaaaatcatgaaaatcatgtggctgttccaccatgcccccctccctggggattctgaagtcctgtccctcctccctcttgctgttacttctgaacagctattgcatctttcaggtgtgatttggggatgcataagatctaaagctgctaccttcagggtctctgaaattaatgtctcttaggattgctgctatcataatacttccctgtagcaacttgtaattatgtcccaacgaaaaggaattattcgcttaaacgacttttcccttttccaccttctaacccaccatttgtttctcctagccctgtgtgatgtgggatagtccctgtattcctgcaccacaaactctaacatccttgcagtcttggtcatccacggaatatttcttctccgtgaagacagttttcgttacgtgtttccttttatgattggtgggaccttctctggagtgtcttgcacggtcctgtatacatcatttgttacctggagtgcattctatatttaaacaactctgtcgtgaatgatgtaccatgctctatgtgagtagggatgaatatttaaatggatttcccttaaatactactttggatagtaactgaagcaatggattagagtgggatagccaattagatttttatttgaaataaatcacttgggaaaggagctttacaaataaacgaaaagaacttgcccacttttgtgaccgtattttgagactttgagcaccactcatgcccagcaaaataaaatgtcaatatctccttgttcctttgttggctctcagcctgctgtcttcgatctcactgcccgctttctggaaacattggcatgtgaattcctgcctgttccctctgcctgagatgccccagccatgccccttgattgtcctgacctcccactgatcatctcacatcccgcctcttccacaaacccttcagttcatccaaatccctgtagcatttattaattttccttctttcttggcagccagcatacataccacgactagctatttagatttctatgcacaaaagtcttatctcccaaaatcactgtcagtacccaaaggcagacacacagtcttctacccctttacattctgctcgtgtgtgtgtgtgtgtgtgtgtgtgtgtgtgtgtgtgtgtgtgtgtgtagaaaaaacccacttacccagagtaaaatgctcataaatgctcatgcatcctgtggcagtgatggtaatgaaagccagtgtgattacacccagcaggagtcatttctggaactaaaatcggctgatttagcagctaccgtcaagttgctagtccatcatgctcctcttctcagcccatgactagagaatcctgaatatcccacatgctcctcacagcccctaccaactggtcgcaatttgcatgggagagaatgcgaacttatttttttaacctcttcccacccacacaaactcatctcacagcctcttagcaatagggtatctcattttgaacatttacttttcagacatttatttggttttttaaacttccagcaaatattaacaatgccagtgaatcctggtgttctcctttgcgcagtggaaataatacttcccttagaagactgccgcaagaatttagttaaaacatgtatggcctttagcacagtgcctggcatgtagcacacatacaacttttaaattgctttacaaagtcctttgtccatgatcttactttatcttcatggtgcttttgcgacaggcagggtcctgggatatctttctttgacagatgaggaaataggcacaaacgatgagctgggactggaactgagatctttccagaaccacgcctgtgcccttcctgttcctgacaatgttcattttaaggaggggagagaggacagcatttgtctatggaatgagccctggcacccagcttccgcctgggaaaaccgccatccctctcttaaaatgggcacgggtttgctggcaggacttgcccttaattatggtcaggccacctctttacccccagccttccaaaaccttcccgctggttgtccccagttgtacagtttgttaaagtctaccgtgttttttttcttgcatctcagtcatctccaaaagttccaggatgacttgggagtttttattggctaggctgaaaaaatgcccaggcaacaatggtgtgttgatgcttggagtcagactggctagagcaagaagtgatttatgtaactctagaaggtcctaatcgggaagctgagagaaagggatgaagcatgttaatcctctccataattttctcttaagaatgactttagttagtcatgggtaaagtttatcttccaaggtgtgtgcttttgggatatcgaaagatttcatgtttcccagctgagacttccacatctgcaggctgccagtgttttcaactgtgagaaaagagctctctttcccaaaaattcatcatggactggaaacacggaggtataagttgaagtagccgtcagtggtgcttctaaaggtcagggtttcatgtatagaactggagccatccagttggaggagaagcccgttctcacctgtaatcagatgaaaaatgtagaagcatgagttggatggcctccacttatgacgcaatgacaagaagtcaacatgtagtatttacaaagatcagtcatttctgggaggattagagaggagaaaaggtgaaccaaacatcacttatggacttagtcatatcattttcactgatggtgatgacagcacgtcaacacatcatcatttggtgagagaggtctggtagccgttgctcatcatcttcctcactgggcgtggtggtgggaagtcccaccacagtgggtggtttccttggcattcatagcagaaccccacaccctgtcttctgatggcccttggacatggatcttgctgtctcagttgactattgcattgtccctcatggcagggttcttaaacattagtgtttttggatctcccagggagccggttaattggcaaattgtaggtcccaccccttgagatacagattcaatagggcttggggatctgcattttaaaatgcaaggtggttattggccacgctttgagaaatactgcctgatagtggcatagacacctactgttggagagagttgactttagaatcaatcagcaaatgactgcccaaggcactgtcctaaatctgactggatttgaaaaagatctgtaagctatgagccttatcctcaaaagtgtacgtatgaaatgaggtaagcagtgcaggattcgatagaatcagatgccgggctgctggaggagttcctagaagaatggagagtcagggcaactgggcatgggaggtggcatttcacctgagcctggaggactgtaggatttgcactgatgactcagaggggaaagagcatttctgatgagaggaacaaattgaggggtcaccagtgtgaggacaaccttgagcttgggatttcagtctgaaagcctatgtttcagtttagagaaagccataggctttctaatgtacctaaaacaggcaccaagtctaggcagatggccccagcccactgacagtgggtaaggacatagccttaagccatgctggagatgacaacactctaggcttttagaaatttggctctgaaataaaggatgtcttggggcatcccaagagccaagactgcggtctgtgagagtccaaacctgagtacttatacctcaatgttacttgtaaagtagttacagattttccaagcactcacttccatgttatccttagataggggctgtcacctaccccatagggttgtagggaggattaaatgaaataaattgggtaaagcacttacccaacagcaccaggcccatagcaagcatttaataaatgatagtggtgattagggctcttccccctactttcgtaaggagggggctgtgtgcccgtgtttgcatatttggtattgtattcttccttggtcggagtatcttccattccaactcctaattttgaaaacattgcatatagatctctagccaccaatccttcaaacctcaagcaacaccagaattggctgcttccttccgaagatcctccctcccacatctaaggacaccacagtaactcagtctctgtcagcttcccctcctgtagccttgggagcacgccgaggccatgggcttaggagaggcaacctagcatgctggacagaacccagggcggggatcctgtctgggctctgctgcccaaccacagggagtcctttggcaaatcaactgctctgacctcctttggaggcttgttgggaagattagagatattatttctggcatagtgccatgcacgtatcagaggccaaacagtagccagattcattactgatggtatgttctgaggtttgcacctttgcaaaccattctgagactgctagcttgttggcatgcactgcctacaccttagagtgatagccctactatgtgtggtctctgtacatcttggttctgggaaggggctacaaatctggattagacccaaagagtcccttctcgaaagcagcctgtgaccacatgggttgtacctctgaagctgaaggtctcacccttcctcttccttcagacagggtctcctttgctctggctcagcaaaatcagaatgacccttgatgtcagggctttcaagcagagcacattcccagcttccatcgtccaggtgtccccatacaccacaggcctgcccatagctcatgacaccacacttcaggatttctttgatacctctagagaaacatcagaatttttgaagctggcctgaaaggccagagccttctctgtagcctgaaggatctgaactcctttctcatagagaaaacaaggtccaggtctcctgtgtgagcaagaagcacaaaaggccagggctttgcttgactagaccataccccagggcaggctcttttgtgcagatgctaacttgaaacaggacactttgtccttcccagtccctgcctgctccatccccacctcataactcccctctttagtccagggggtgccctcccagacttagggaaggagtgtgtgaaatgaaaaaccattagaggtctcagctcaaggagggaataatattgttgttcgtaaatgtctgctgaacatttgtcatgtatttggcatatgccatatatgtgcgtgtgtatatagtagatggtaaggtaaatataaattactatatatggtgtatatggcacgttatatatagtaagtgtatatacataaacatagcctaacaccatggaggcaaacaagttataacagatatgcattaatttaacatctgtttatcttatacctgctacatgcaaggcacagtcctaagtccttgagatccagcagagaacaaaagagctggaaacctgtcctcatagagcttcaagtagtggcagaaaggcaataacggattaaaaaatccctgatgtcaggtggtgataacaaatgagactgcaaagcaggggaaggtggaagtgctagggaaaaggtgtttgtttgttgtaatccagggtggtctctgatgaattacagtaacatttaagcagaacatgaaagaagtggaggagccggccactcatatgcctgggggaggagtgtccctggcagatcgagtggcccgtgcaaaagtcctgtggcaggagtgtgtctgggacttctaaggagcagtgatgctctgctcatggttggagacagagggagttaaggggaaagtgggatgaggtggggtcagagcgagagcaggcactcacctgaccattctagaaaagaaagaataactaggccggtgtgtggtggctcatgcctgtaatgccagcactttgggaggctgaggcaggaggattgcatgaggccaggagttcaagaacaccctgggccatatagtgagacccctatttccacacacacacaaaattaattaaaaaacattagccaggtatggtggtacatacctgtggtcccagctacttgagaggctgaggtgggagggtcactagagcccaggaggtggggactgcagtgagccatgatcgcgccactgcactccagcctgggctacagagcaagaccttgtctcaaaaataagcttgggtatctggacaaggcaggacatggcaagcacacactaaggagcacagagcatccatctcaaaactctcagaggggagggagtgtcctctctgggctggggtggtcaaggaaggcctcttgcaagaggtaggacttgagctgatgagaaggacactgcaagcccggcggacacttgagatgttcctggtgggagaaaggtgaacaaacctcagtggagagtttgtgtaggggcctagtggaagataatgcagaagagagatgtcggggctatgtgtagagggcctcaagtgacagagaaagttgtaaaaccagtggaagcctggctgtcccccatcctcttctcccagtcagctaccttggcccaggccctggtagatgctgactctcagaagctcccagcagctgccaggacggaccctcctcctcgcctgccttcccacagctggcgtccaggacacttgggttcagccccttcatttgctgactcagattttcctgtacccattccagtgatgactatcactctgccagggccccctcccagccacagacaccctccccagacataagtctctgcggtctgcaggaattctctttccgcctttctggaaccactggaatcccacagactggggtggacagctattcttatgaaaagtgtggctccatttctggactaaacaggcgtactggcgctgaagataaggatcccaaactccaagtcaggcctatctgcaagcaaagtctcagcctcgctcacctcttcccttcttccatcagtcattagccctgtgtgagaaagcaggggtgcattgttaccatatgacatggcaaaaagggattacctgctaatgccatttggtttagtgatgccttgttacataaactactctggaggagttcaaatatccctcaggcgaacgcttccatccccaggttggtaacactatagctgagtattgttttatttgccatttttcaaaagagggagaaacatacccaagccattatccagcctaccaataatacatttcaagaaaacaaccgcaactcccaatcctttcttctgagggcaggatgttgtagggctattgttccttctcaggccactcttcaacctacagaaactggtctgggctacagtcagattacagggggtatcaggaggcctttgagagtcaggaagaaagtcttacagacagaagcccagctctagcaaagagggaaagatcactgcctttgaagctggatacatatgtggcctttaatttgagtgctggttggttgtcgttgggcaaatgactgaaactccttgatgcttattttctttatcttaaaaacataaaaaataaatgaggataagatgatgatgaccatcatagggttgttttaacgctgggatgcagtgatgtgtgtgcaagctcctggcacagcaacttaataccagtctcctctgtcctgtcttgcatctgctgaggatgaagaaggagagcagttgagtgtggccctgcctggctgggggcccttcctctatagttatcttctttataagccatttatagtcttggtataattttaaggaaaaaaaatcaaggcgctactttgcatttaaaattcatttttgaaacatactggcagcaaacgccacactattgcagttagggaagacaggagagcaaatgtcaggtcttggcaaagtggggtggggaattttttgagtgtgacatttgaataaagaaatctaaactaggaaaaaaaaaagttttccccgatcttatcatggtacaatgaagagttgtataaaaactgtttgtccctgctgcatgtttacttacccatgggcaggatatctcacgggccaaaagttcaaactactgctagctcccaagcaatgtgtgaacttaaaatgaactggcttcagaagaggctcgaaaaatgatttgatccacaaaggttctcacctcccaaatgttctaccaatacttgtcatggtctttggtgtagtattaaatatatacaatgatggaattaaggcatagtaacaacttcacacacacacacacacacacacacacacacacacacacacacacacattttccagatatttccttgcgaatgaccatcttattccattacatcaagcatctaggcttagccatgctttataatgataaaacggagctcttctaccaactccaaacagaggaatgacagaagatttagcatgtttttcttaatgttgattgagttttcctacttattgctgtagcaactatgaacatcttcaggttgggaatcagaccttaccaataaacatttgaagcgccaatatagttcctggctgaaaatgtcttttagatgtaatttatctagttccttaggtatctgagatactgttaaaatgcaatttagcgtggtagtaagaatacggctttaatggctaacgtagttgagaccccacctctgctcaaactagctgggcaattttggtcaatctacttctctgtgtttcggattcttgatctgcaaaataagataatagtaatgaatagactaattttcaggattaaatgagtggatgcaatgttaagtcctttacatgacacacatgatttgctatgcttttaattatgattctcttcaggtttaccatctcttgctcacctgcttcccacccagtttctctgtctctctcacatcttcctccagtgagagcattcgttccagggagcttggaagccagctgtcagttctctgccataatcttttcacaatggcatttgacccattggggtttcagatctccatatgtatattccaaaacattattgctcaatgagcctccactgaggcctgttcttctaaccctactgaccatgattttttagctgtattcgtggggtttttttgttgttgtttttttgtttgtttgttttagtagagggggaggggagagggaagggaagagggagtctggttcatgttattaaaaaaaaaattaaattttgctcccagggtctaagttagatctttgggttggctcagccttcctcttccagaagcctactctggctaatgtcctctaaagtgtttttcctgttgtttattccagaaatagttcaggatgacgatattgacatttgggctaaggcatatacgaggctcttcaattagacacaggctcagcctctcatttgctcagtggctcatattctccactgatccaggagggggatatttgggttcacaccacagtctgccctcagtggggttatttgtgggtctccgcaccatcctagatttatttctctgctactgggatggattgtggttgtgcttgtgggctgccatgcttgcaagcctgtgctgtttctggagttgccatttttacctactgaggggaggacatttaatttgagtaaatatgttagaaaacttgtttcacaacctggtcaacacacccattaaccatggctggaagtttcctgaaggcagggcctgtttgcctctctgaatacacacagtgtttagacacagaactgaacacaatgtctggctctcatggtaggtgcctaggggatgttaactaaattgaactgaactaggcctcaaaggatgagtaggattttagctggtagagctggagagctaggggcattccagggagaggatccacacaaaagaggagacgagtggaaagcaggaattgtgaagggtgaacagcaattagaccgtaatctggttacactggagggtacttggaggacagacagatggcagagcaccgtgaataccttaggatagtgttgtctaccttggcttcagcttaggatcacctggactcctttaaaaacatactacctcctggctcaccccagttcaactgaaattgaatcttcatggtggggcctgggggagcactctggggaagggttgagagccactgtctaggacttccagggacacttaacaggatgtagggagagccccacaccagaagacctcttgtactgtagattgctaacaatcttgagaaaatggcaaaatctgcctttaagtcttctgagctagagtttagaattttagagtaaaactagaaagaattgggtaatgatggaaagagatctgtttatgacacagagttaacagacaggactagtaacaatctgagcaggcagtgctaaagacttactaagatttcatctccctccctttcccttaattctaactaacctttgtactctgaaaatcgctgatttccaaaaagctggcaaactgacgaatctcagttttaaatgtagttcggactttaccctctatctaggtcacagctaaagctgccatatgtaccaggaatgagaactttgtaagttaatcagggcacggtttatatttccagcattcaaaataaatcattccgtttgcctgtcatattctgactttttgaaaatcatttctatctgtgagtaggtggcacgaggtattcatttcataagtaggtttggattcggcaggtcttcaagttcacagcagggatgcagtctccagtttttctcatatttgtaccagttgttaagccataggttttaaactaacaaatgattacccttgatcttaagagtactgggtatacccaagtccaaaatcagaattttaaagcaatattaaaacaaaacaaaatcccttttcatgtaatgattggctcattggtttttccttccataagtcaatatctgatgctttgattttcttaagtcatgtatatttatagagccacatacacctgttagacacacattgagttttcaagagagaaaaacacacttgcatatgtttccctgccctaactcagttcacatccagactggcttctagaagaaaggaaatttatagtgtggaaagttgcagcatttgcaggaactatgggaatctcagcacatagtcttagataaattttacaagtattggcccaagtaacccacaaggcagtgatctggatctgtttaccaagttaactgccaagtcacaaataatagctttttcccttaacttggaatgaacaacatagtactgaagtgtttccttgtgaatacctctccatatgcgtcatgacaaaatactgtatagatcagtttacattagattgtttaattaaatttaaaattctttaagctggaggaatttgccctaaaactgttctgcacggccaacaatttgatgttgaaaaaaccagcctccatgttaacatgtcggcttgaatactcttattttccacactggaaacttaccatgagcaattcttttcagaggttagcttttagttatcaaaatgggtgatgtctatatcaaagattgtaatataatttgaggtggcagtcccccttccaggaatcccattttatggtttgattgtgtttctcaatatatgatctgtagctgaactccaaatactgactactgggattaccagccaagttaatattaacattattgaaaagagtcggttaatgtgaaaaggaaaagtcaaaggtgttaaattagcagtttgttagggagcagtacttgctggtctttggagtgtgtgaatttcatcaattcttctggctgagacagggagtaacatccacagctgacacacagtctgtctgggtgagttctcccctcctgttcactctttcccccagcgtcctagtctcagaatgttgccactttttattcttgttgaacaggtgaggaaagtagtttctcctgtttgcttattgcctgggtcagttggagtttttcacaaggagcattggtaagaaaagaaaacaaacaaaagtaaacaggagaggttagagtccaagattctgttccgaatttcaatcaggactagccacagggtaaattggccagcagggcttaagaggtacttgcgccagcctgcagttctctctctttgcctctggaaaagcatggccgagacctgcttttaaagcccatcagataaacccctcttggtccttctacttaatttcaactaatggcatgagccctgagtggtattctcttaagtaactaatgggagaagaaatgtctccctggaggcttcttccatgttacaaaacaccagaggcgaagggtgggtgcacactctcaaaagctcagctagagacccccacctagttcttcctggctaatcaggaatggtaactccagcctgactgtgggcttcttcccagcatccttgttcacaggcacctccctggtcagggttttgattgccacgcaatgttcttgtttggtgtagcatttttactagaagaagaaagtttcagaaaccacattggcctctgtgtagctcccgtctttctaaacccttctagaattgtggtagtttcctgagggaccctctttgttttgttttgtaacttcattctacactcacaaggcaacttcccatccaaattaaacatttgaagtgggaaaactttgtagggccttcagaaaaacagtttttttttttcaaggtgttctgtaaatatgggattattaccgatccttgtgccaaagtcatgttaaataaaacagtttcagatatgtacttctgacccaaagccctctttcatcacaattaggtccttaatctgttctaggagtattgccataatattatcactctaattacagcccctaaaaatgtgaaatatgttatataactcagagctcgtttggacttcttacagtcatgcttatatggcaagacaaacaactttcattccagcagtgaaggggaagagtcacacatacagtaactatttcaattttttttaagtaacatttgaaatacccattgatatctttttaatatattatgttacaaatgttttaacttacaagagcagtattatagtatacccctagagataaggccattgttgcctataaggtattatggtaagtaatagaaacatccaccaagcttcttcattagcagcaaaaatgagttcttggttgtgtgtttgggcagtggggatgtggtagaggtggaaggggagatggagcagggttttaggcaactgagatgatgtatcagagaaagtaaggtgaaaagggggtttctgttacttctgatttttcccctagatttcccttatggaactccagatgcaaggaatcagaaaggagtttctcttcatccatgaatcattataatgtatcaatttgttctgaaaacatgagtgtttctgtgattgaaatagtggctgattgtttaggagtctcctatttatttttgtggcaaccatctcaaagcggatgccgaattctgaatggggaagatctttctgcataggagagtcatgagtatctggcccactggctggggtgtcctgagcatagcaataatgagtgacatcatgctctctgtccttgttaggatttcatgccaaccaccttggatgggaggccaagatacatttctaatcctggtcaccaactatgcaaattcaattcaattctgtattgtaaaagtacgcactggggactgtgttcaaaccctggtttagagaactaagaagattacaagagaagagtaacttggtgcttagtgggtacagaatgtttgttgaatgaatgaatgaatgaaaaagtctgggcttggcccttacattcttatttagtaaggaagatctagctatgtgaaataattaaagagtgccttaagtcccagtgatctgttagagaaaggagatatcaatattggcttagggtaatcagggcaggaattagtgagaagactagcaaaggccttatgctgagctcatctggtgctttgggggctttgattcaagtatgagcacttaatttttggctggggacattcatgtaataaatacgcttgtatttaactgtgatgtggtcccatttttgcactgtgctcagatttctctcttcaccatcttgctcttgagttgagagagttgctaacttagcatgctgttattaaatttaggatttatgtcttttagcattttaaatgcaaagtcctgtagaaacctggaatgctcaatagctcctaataacagtaggaatgctgtgaggtcaccacacacgaagctttaatttatgctaatttaattaaaggtagttggcaaataaataaattagggaaagtgcactgagttcctcttagctctggatgagcccagtattggagctgtggatccactctgtgcccaggggccctcagctccgctctgcctctccaagcaggagaatctgtcacagggaaggcttcactccacgtggtgtgtgattctagtgtatgttacatgtttgtatcttcttattctatatacttcgttatgtatagtatatgttctcatattttattttacagagcagtatacataaaaccatatatgctatattctacaggtgagttaaagagcattttttaagctccgggttgtgttcaattagtggatcacaaaattcatgtagtgtgtctccatgggcatttttactttaatgaaacagagtagggtagacaacctagggtataccacatatagcaaaaataggaattccattggggaacatttaatttgagttacttatgtgtatgtacacatatatagtatttacatacatacatacaccctcatgtgtgaataagttggccatgtatgtgtctacatgtttattgactgggtcatcagtactgcatgttgtggttaaaaataaaacactgatttaagggctgttaaagcaattttgaccgtcctctttgacatatacagaattttgcctgacttatttatccctcagtcctacctaagacaggctagcgccaggttcatgggttggtggagatgtttaggctagtaatattgcaggagcttctcaggctccagtcagtaggatctgcatgttgttttgtttcttctctctcctccctctggtatcaagggatatccactgtgctatggaaaatgaagcatatggctgggcatggtcactctcgcctgtaatcccagcactttgggaggctgaagcgggatgatcacttggggtcaggagttcgcaaccagcctggccaacatggtgaagccctgtcttcactaaaaatacagaaattagctgggcatggtggcacatgcctgtaatcccagctgcttgggaggctgaggcacaagaatcatttcagcctgggaggcagttgttgttgcagtgagccgagatcataccactgcactccagcccagagcagaactctgtctcaaataaaaaaaaaagaagaagaaagaaaatgaaattgaagcatgttaggctgtaggtcttaacttacagtgtggggccctggtagagggaactgagtcagcaggtgagagatcaaaacagcatctcctgggggacaaagacaatggctggaaggaggcctgagtcacagacatcctcagctgtcatgggaagatggtatctgatggtaaatgaaataactccctttcttccagagaggccagtgcccctgcttacccagtgggatggctgggattcatttctggtggcagtactggatgagaaccataagagcagacctgtttcctaacagatcagctgccatcctttgttcagagtaaatcagctgctccaagttggctgagcagccagcctcctgtctccaccagactcagcatgctctagccgttggatataggctctggggcctgccctacctctagggctagagatcatttcccccaacaatatgcagtgacacctagctccacatgacagtgtttctcaatggccctcagaaccattgcttctcaacaaaatcacctcctgaagttgaatctctgggctgaggcccaggtgattttaataaaccttgtaggggctgcttctgcatgttcaagtttgagagtctccactttggggtttcctcgatgtacacgtcacattgaaaaatggaaaaatttaagcatgtggcatttttctaattaagacacgttaagatggcttaattttgggttcttcctggtaagagtttacatagctggttgaaactttaaaagtcagtgggggaggcggagtgtcaactgtgtagctacagcagcaacatgatagcgctgcccttagggtctacacatgggcaagaccccttcaggaatcctcttgaaaataccatcttataagcaagaacttagagcactttaatagccagggttcccttggatgggattcaagacggacttcacattctctgtttatttccagtgtagtcattgagtgatcattggtaggacagccctatttccactttcatctaccagttcacaggcagctcttaaaatctcatcatgcacaggaggacactgggctttcctcaacttagtggggaaggccatgatcagcctgctctctgtcccttctcctgaagtgaattctttttaggtcaggagaggtgtatctgatattcgagaaatgattgaggcaggaatccaatggcatcttgttcctggagacccagccttcctggccatttttatccctacttagagaagttttgaggcacaggattaagagcaggctgggccaggtgagtcaaaggctttcattgaactgccctccttgtctgatacctccttgctaaactcattagaaaaagagtacaggaaatctcatctccagttggccaagggaacccgaggaacttgaatggacaagatcccattaagggctgataaacacaactgatgcctggtgatgaaagtcttcttttatacagcaatgaagacaggtggctggaacaagagacagaaaaaacacatcgtggaagacattgttctgggaggtgattgtaccctctgccctcccagcaggctgtgagctcgcagtgctgtgtggtcagtggaaggaggcctttacttggcacatcctgtgtaacttgaggagttggagatcacggtaaaactcaaacctattagttacatgttaggtattgaatgtttgaaaagctgcatttcaaaacactgaatttgatcaggacacactctggacaatgtcatttgttgaaagcttcaaatcaaagtggttcccatttcccctccccttatttacttaactcatttattttttagtaagaatgctacataactcaaaagtgaatacttggaaaaaagattttttcaatagggaggatatcttggcttaaaataaataccatcaaagcatttccactgcttactaacctttgacttgcatacaggaagttttctgtcaagtaccagaaaatcctggaaaattgaatttggttttaaaatgcaattctcccttggctttagaaggaccagctgggtagctcattaaatgtaaaaagtactttgaaaattggaagactaactcacatattaattatcatcaatagttatcaaaccagtgtattttaatttaactcacctacttctaaacagcgtgtcaaggactccacaaatgagcctgcctgccacccctcccaccccctgccccttccatagtaaggtttagtgacttgcttatgggcacttaggggaaaaggagaactaagttctgttttctgttctttctctgactagccataggaccttagggcaggtacatgatctctttgagccttattttccttatctgtgacatggagacagtactccctcccagcttcattctcagaactgtcctgaggcttcagctacagcctattgaaaagtctcaagggtattaacaaaatggaaatgtcctatcttcatgttcttttgtattccagcccccatcaatttcccatgtccagagattctttacagccaacagggatccatatggggttcactgggctcaatgtcccaccagagcccctctgccagtgcctcctaccgaacagatgactttctaagcaaggtgctcgggtcttgtcaccgaggggtggacgtgcccagtgtcggggtctgtccagtggtccttgattcccctttgtccacgcacttggcctttctccagggggagacggatgatagctggaagtgatctactctgcttatgggttctggccagttctctctctgtttaggggtgaaccagtgtctgacaggtgaacttttccttagggtaggaaatacattggcctttaaatgcaaaaggacaccaggtcattgagctcagaaccttcaccagctctggaaatattgttcctcttgcaggactcaactcagtgtgactcttgccctcctcctttctccttcccagacagaatgcactctgcactttcctatagctctgtatggggcaccagtcatgtgttgtaatagttggcctggagtgtagagactcgccagtaatgcctccatctgacctacacaggaggaactccaaaaaacttttataagcaatttagttaggctcttctctgtagtctagagtcccagggccttccttggagtcccgtgatgtctcttaccttcatagtcagaattgaaaggcaggaaggagatacaaggtctgtctttccccttcttgactgagcttggggcaagattgtccgggcccatttttcctagacgtttccttagcgcaaccctcatcctatttgatggtttccagggacctcagggtttctgcttagaagcttcccacctgtcagtattgccgagtgggcttacagcctgatagaagcccccacctcactggattagtgctgccctggtttcttcccagtcctgacaatgcacatagcccagctctctctcatgcccacagatactttaagcttctattgacttaaagtggcctgagatagggcaacaggagatgggacaacctatcccagttggtgcaaagccctttacacgcacatcttgcaattaactgtgagcctagactggagtccagcccttgggcagccaaggtagtttctgcctgattgttcctaagcagactctggtcaagggggaagcagctgcaggtgtaatacccgctgcaggaaataccttctagtatccttgtagctgtgggaaaatattctcacttgaattcatgaaggtcaccagaggggcttccctctgctttccactctgcattctcgtaaatcccacctcttctagaaagcctgcctcagtttcccatcatgcgtttccttctgcccagttccttgtgttacacatcagtttagctctttctgatacaccattttgtgttctgcagttgatttcatgtaatttacattttcccatcttgactaagaccctgaggcaaacccgaggcaggtccttctgtccatcaaatccaacacagtactggtcctggtgagtcctctgagaggtacccccagcatggtcaccatggccagtgtagaaggctgggggtaaaagctgggcccaccgactgatggggaaacctaaagttcttgcagaattggaggcttggcactccctccactggctcccattgcccgccctgctgcctggtccccaggggtagggtggcttagctgggctcatggcctgtgatgcacattcccagatctctgaagtcatttccctgaaatcacatttaccgttcacaagaaaaaggccaaagctggacaaaggcactgctgccaagactcgagcactggtaatttcttatgagccctttgtgatggtagagtttatgaaatgtaagtaaacaggcttccttctaatccctgagccgtgagaagctgtcagggtttatttgccgagccgtccctgcatgcctgtgcatggcacacctaggctccagtgttccgctcgttaaaaggtgtctaatttctgtaatcaccttggagtttaatgggtttaagccatgtgggttgcagtggagagaaaacattatttctagtcttttggcttcctttcctgccttccacacctcttctctctccttgtccctcccttgtgagctgaatggattataaaatattagctgtgaccttgtggggtgggaaggaagaaaggtttctgtttcccgctctgtcctgccttcccagccagcactggccccttaatgaggttctaaaggtaaaggtatctgggacaatttcaggacactgccacctgtggcctgcaaagagcatgacttgatggacctttgatttcttttttcccccccagccacgtcctgggaataatttaggagcaagccaacacatttggaggcatcttctctcatttccttcattcttgtcaaagtctcactcttttctagaaaagaaatcatggtctttctcagtgcccacaatgggcagaaacatctctgaagccatcacctgaggagtcttaaaaggcccagttctttgtggtcctcccttcctttcacttcacctcactgtcatcacttcctttatctctcccactccctcacccccaaatgagagagggaaaggaagaagaaagacaatatgtgcatcgtgtcaggtgagaggaattagcttcctccatggattctgctttcatagtcaagccacaaataactactgagatgacttcagttcctcccgcaagagtaagctgataacaaatcctctttcccactgcaagtctcaaaactccttcaactttcagctcatgttatttaatgttgaaatctgaccttcccagagcaccacaagtggtagcctgggtagtgggcccctgggctggtggtttctggtggcaagaagctgtccacatgcctcagtgcaccatacacatgctgtcaccttctctctgatctgtgactgtgaaggtggggagctgtgggtagggcaaatgtgattttctcacttaaacagatgaggaaactgaggttcaaagaagttatatggcacatggcacagctgatctccctggtgcaagagagtgcccttgccattcttctcccaagctgctgattttaaggtggctctgctctcctttggggaacctggaagacatttcctgaatctagcacccgctttgaaggcatgctgcatctcagttgttcatgggccatttcctattttctttggggcttttccacttacaggtattgttttctctactttattccccctgctgtttttaccttagtgaaataaagtgagaaacaaatcctcaatgatgctatattagtctgttctcacaccgctataaagaagtacctgagactgggtaatttataaagaaaagaggtttaattgtctcaaagttccacgcggctggggacgcttcaggaaagttacaatcatggcggaaggcacctcttcagagggcagcagagagagaagaagtgcacgagagcagggaaaactgccttatgaagccatcagatctcgtgagaagtcactatcacaagaacagcatggggaaaaccgcccccatgatccagtcccctcccacctggttcctccatcaacacctggggattacaattcaagatgagatctgggtagggacacaaagcctaaccatatcaggtgcttttcagtgcatgggaagggaggagaaaagccatataatctaagattgtgtcactgtcaacacagtcccttcttccttccagtagttgagtctacctaagatttgaaccactttcaaaaggtagtgtgtgcagagaacaccatctgatatgtagaaaatactagtcaatacacatgcaaaagaagctactagaactaataaaagagtagagcaaggccacaggagacaagatcaatatacaaaatcaattacagttctttatactagcaatgaagaatccaaaggcaaaattaagaaaacagttccattcgcaaaggcatcaaaaagacttaattgctcaggaataaatttgacaaaagaagctgaagacttttatactaaaaagtacaaaacattcctgagggaaattaaggaagatcaacataaatggaaaaaacattccatgtttgtggagaagacacagtattattaaaatggcagttctccccaaattgatctctacattcaatgcagtccctattaaaatcccagcagagttcttggcaaaaattgacaagccgatcttaaaattcatatgaaattgaataagatatgcaaagggctcagaagagccaatgcaaccttgaaaaagaacacagttggaggacttaaattcctggttctaaaacatactgtaaagctacataatcacagtagtgtggtactggaataagcacaggacatataggtcaacagaacagagttgagagttcagaaatgaacacttaacctttatcatcaattgatttccaagaagagtaccaagaccattcaatgggaaaaggatggttttccataaatggtactgagacatttagtctttgctctcacaccatacacaaaagtgaactcaaagtggattataaacctaaacgtaagagccggtcacccaactgcctgtgaacttacggatgagaaagctgaaggccaagggaaccagcagcagaaagatgggcaggaagataagattattgtattgtcaaagacttcagtaatttcaaagaaataactgaatgtgagagagaaaaccacataaacatggggagaagccccactctggggagaaagctgtttggattccactagacatttgcagcctaggaaattaggacctggaaatttaaacctagaaaaatcccaggaaagtgaccttattatgttataagggagcttactttttaataaaaaaaagttactcccccccgattatttattgtggtaaaatataggtaaaatttaccatcttaaccagttttaagcctacagttctgcggcattaaatacattcataaagttatgcatccgtcaccactatccatctccataacgcgtttcatcttgtaaaacgaaaactttatgcccattaagcagtaaactccccattacctacctccttcagcccctgacaaccaccatgccactgttgatctctatgaatttgaccattctaggtacctcatgtgagcggagtcatacagtatctatctttttgtgtctggcctatttcacttagcaccgtgtcctcgaggttcacccatgttgtggcatgtgtcataatttcctttcattttaaggctgaataatactccattgtatatacatacgacattttgcttctccatttatcctgtgggtggacacgtgggttgcttctgcatttttgcaattgcgagtaatgctgctgtgaacatgggcttacaaatatctcttcaagaccctgttttcaattctttttgctatattcccagaagcagaattgctgactcatatagtagttctccttttaatttttttaggagccgccatactgttttccaccgcagctgtaccatttgacattcctaccaacaaaaacagctacttcttatttcagagtagccctgtgcataggtccttactgctctctcacaatctcttagtgagataagagaattagttactattgtcctcatgtaggctaacacttattttgtgctttttatatagcaggctgtgtccctggcactttagaaatgattaactgattgaattctcacaatagccctaggaggctgttactgttattacttctgtattacagataagaaaatggaggcaaaaagttattttgtcacttgcagctagtgagatgggcagtgtggctatgggagtgacctccccatgctgtgcaccacctcttcccacttgcatttgataactgaggaaactaacacgcaggacattaagtgattccttcaaggttatgcaggaagttaagcatcagagccagggtctcttgacacctctactattttttttctactatgtcagaataccccctcagcctctgctcactaggagtgcatctccacatatctaaagtgtttggtagagaagaattacaggagaacaaaaaatcttccattcttaggacaactcatgtccaaatttagaataactgcaaccccaaccatacacacagaatctcagggcttgaaggtgtctctcagaaatcctctagttctgatagggacaggaggcagggaaattcggggcagaagagggcaggtccccagcaagggccctaccctcaagcctaataccgtggcccaaagtgagaacaaacatccctgttttaccactccaatgttgccttttccaaaaccacccatggcccgccccaccccccatcctgtgcctataaaaaccccagaactcagacagcagagagaagaagcagctgtgcatcagagactatgggcggacattggagagaagcagcttgactttagagggacagcttgacagcgtagcttcagaaaggagtctggccatcccggggaagatcacttcccactccatccccttttcagctccccttcccactcagagtcacttttaccctcaataaaatcccccacatttaccatctctaattcgttcgtgatcacattcctcctggacgccggacaatacaagtgccaggtatgcaggcgcaaaaggccgtcacactgaccctccactgagctgttcatacttaaatcaccatggatggcaaaactaaaaggacactattatactgcttctggggcttcagggatcacagccaccaccttagatgctgccacggggccctcacagagatttgctcctgctggcgaccaaaagtgctcgccctggctcctgcacctgctcacctgtgctccccatcccacaagggtggaactcagcgggaccaggtgagtggagtctgcccctgccagcaccgaagcggctggctagttctagcgcccgtgaactctagttccctcccatgaaggggtcagtgaaataccctggttcaattcaatctctcagtcagactgaaattcatcaaagctagttatctggcttgtgtattttctgcaataggataccctttgtctataactttgattcttttatacccctaccagatagaaaattcttctttttgagccaccattggcattggccttgctgtgacttccattctcagtcctggatctgccctttggaaaaatgctaagtctaattttttttttttgaggagggtcttgctctgttgccctgttggctggaatgcagtggcaagatcaccgctcactgtagcctcaaccacctgggctcaagtgatgctcccacctcagcctccctagtagctgggaccacaggtgcacaccaccacgcctagctaatttgtatagttttgttagagatggggttttgccatgttgcccaagctggtcttgaactcctgggctcaaatgatctgcccgccttggcctcccaaagtgctgggattacaggtgtgagtcatagcgcccggccagtaagtctaatttttgcatgccaacccattgtggataaaaaatacaggacttcaggggtccatttttctgggtttgaatcctggctctaccaccaacaggctctataaccttaggccataattttctcatctgtaaaatggaagcaagctgtttcgaggactgaatcaagtatacccagtgagtaggagctccatcagctgttcactgttgccatttgtggaaacaataattgcatttgatcttgatcttacttcttcacggttaatgttcttgaaccttttttttttttttccatttcatcctttggctttcaggcccatcagtttcagatctctctcctccaggtgtgctttgtcttcaaatgtctgtcccaaaagacagaagccagaaccaacctcagtacctctggcccgtttgcccctgctgtgagctaagcatacagtaacttatatgggattaagttttcctaacaggggctttccaataagctgttcctgtcctatatgttatttgcagtgattgtgtggtactttccccaaatcctttcatcttttctttcttaaaaggtattgcgttgattaagataaaaattgtcagcaattagcgaattaagatgtttccagaatttagatcttttcctcttgaatgtcttttcattacaagctttactctgcctcatgagtaattatttatctatctaaaaatatgtgttggatactagtcaagcctagagttagattttgccatcatcatgtcatccttccagcaggtggtagcagggctgaaattctcttctcttattcttaaagagagccttcaaacttttctttttttaagtagtgaatcatggttctaatattaatgagaaaattcaagtatataaaacagatgaaagcacttctgctctgactgataggggaaacttggacctgtttggatcactattgctacaaaagaaatcaccccaaaactcagaggctcagctggttggttctggctcagggcctcttgtgtggctacagagggtttgaacagtggggatggagggggtggaaacaactgagggctggctgggcatctctctctctctatggagtctcagagcttctctatgtggtctctgtgtatggcctgactcgggcttcctcatagcatggtggcctcagggcagtcaagctgctcacgtggtggctgaagtgttcaggagagaatattccagtgaatgatgtggaagatccactgtcttcatgacgtactctcagaagtcacatagcattgcttctgcaaaaataatcccacctggtgtcaaggggcgtgtggaatgggaaacattcctgtaacgatcttgagaaaatttgttcttcttcccacctattcccccaaatttagggctctttaatacatagttgaaagttattggtataaagtattggaaacagagggaaccaggataagaaaaaatattctcttcaacttttttttttttttgagtcggagttttgctgtgtcacccaggctggagtgcagtggcacaatctcagttcactgcaacctccacctcccaggttcaagctatcatcctgcttcagcctcccgagtagctgggattacaggcgccaccaccatgcccggctgatttttgtatttttagtagacacggggtttcgccacgttggccaggctggtctcgaactcctgacctcaggtaatccacccggctcagccttcaaattttttttaatgtactgaatgtctatatgaccttgtatttttgtttgtttattttaatttgtattttttctcaagcattcaggcgtcagtttgttccttcacaaaaatggagatcaggacatagccacctgtctccctcaccaagctgttgtgaggatcagataagcaacaacttgtgaaaagatctgagtataaataccactgttagggccatccacagtgattctttctacactaactgaagtgaaggaaaggcaaaagccacttgccggccacaaagagaatgcgaaccttggtcagacctcaggagttacctcctaattcagtttcctttcctctgccctcactttccaatttgcaacagtgaagtaatgggcaaattcatagtttcctctgcactttgtagttagagctggaaggaacctcagggaccatctagttctgttcccattcggtaaagtggcctgcataggtgcacacagacgttagacaaggctgcacggaggactgagttttgctgcttctgcagacttgaggcttccctcttggcaggacacaaacatccagggcttggtggcccatggcaggtcaggacaagaggaggctaactggccacaccacccatccagcctctggaaagctgggacaggactggctgggatccagatgctcattgtgtggggatgaaatgtcatgttcccaaaggaactggctcattgtttaaactgccaaatatttatttaatcaaccaaacttcaactaaagaagaaaaagggtctgaattttaaatcccataaacctggcttggagaaacaggcagtggagaaggggagatgagagtcgtttcaaatcagaaagttgtggtaaagatgtgaacgccagactcattctgcatatcacctggtggcggagtgtcggactactcaccatcaagacaggcctcgacacttccagtcttccagatgtcccaaatgctgtggtttcactcacattgaattgattgattgattgactgattgagacagggtcttgctctgtcacccaggctggagcacagtggcatgaacacggctcactgcagcctcaacctcctaggttcaagtgattctcccggcttagcttcctaaggaactgggaccacaggcgggtgccaccacacactcagctaatttttaaaatttttgttgctatgggatcttgccgtgtggcccgggctggtctcaaactcctgggctcaagtgatcctcttgccttcaccttgtgaagtgcttggattacaggcatgagctactatgccccactaaaagtgtcattttaagtaatagaataaaagatcattcaggctggttgcagtggctcatgcctgtaacgtggcaagaccgtgtctccacaaaaaaatttaaaaattagctgagctttgtggtgcttgtttgtggtcccagctacttgggaggctgagccatgaggatcactagccatgagcccaggaggttaaggctacagtgagccatgagcccaggaggttaaggctacagtgagccatgatcgcgccgttgcactccagcctggatgacagagtgagacctcaacccttgaccctccaaaaatcacttttagatcaaataaaatagtattaatgcctatttatttgcactttgttttcctttagccaaacaaattatcttctgcaatcactacatacagtggcctcagcccataagtcattacattaaccagggatgattcttgtcactcctttaagtaaccagcagcagtgactggtcaatctttatggcacaagtacttcagtagtctctttccagaatcttattcagaaaaactcaggccattaggatttatctcacatttgcagagattagttatttttctaatattctaagcagatttgagaggcggtttattattttagttattgcctaccatgcttgcacttctcaacattctcaaaacccagaagccagatgcctagagtgtcagctgcttggcaggctgagggggatcacctgagcccaggagctcaaggctgtaatgagctatgagtgaacctgtgaatagccgctacactccagcctgagcaatatagtgagacccctgtctctttaaaacaacaacaacaacaacagtgcctggtttgggccatttgcttactacttgtaatttgcttatttcagcatttgaattatttttgaaataaacttaacttcaaaggatattgcacattctagagattatccaggagcacttcttactactaatttgacattttcttattgctttgtgctcaaggtcatgtgtttgcattattgccacatatatgggaaaaattaaaaccaaataaaattaaaagaactttaaaggactaaagaaaaaatagtaaataaattcaatgtgaattattctgtattttattaacctcagtgtatatctttggctttgaattgcttactagttgggagaagagtctttttgccatatcttttctctagggaacataactatttcagtttagggatgcattttcagccccccaaagctgaagttaagcaaatgtatgattgaggtagcaagttcatgtctaatctccatacgtcaggtcagacagcccttcctcctgggcactgcccgggcagcccaagaacctgcacaagagagaagaccctgcccatggttttacaataccttcgtgatgacaccggaggcaggcaaagcagtgagggttaagtgagttgtctgggagctctcctgctcctgggcaccacacacactcatcaacacggagctgtcatccagaaggagaggggaaagaccagagaaggaaaacagtacccaatcttgttagctcccaaagcagtccttccctccaggaccactgagttccagtgggaaaagggtcccggaagagttctgtgtgattataagacacccctcctccccttcccgttgctgtatgcacctgtgcgtccatcccactcacccaaagaaattgtctagttctgtcaatcttatagtcagatttttttctctctccttttttttttttttgtttttttgttttttgtttttgagacagagtctcactgtgtcacccaggctgtagtgcagtggcacgatatcagctcattgcaacctctgcctcctaggttcaagtgattctcctgcctcagcctcctgagtagctgggaccgcaggcgcacgccaccacacctggctcatttttgtaattttagtagagacagggttttgtcatgttggctaggctggtcttgaactcccgacctcaagtgattcgcccacctccacctcccaaagtgctgggattacaggagtgagcaactgcgtccggccagattttttgtctttaatgattttcttttcttcttttttttccttttttttttttttttttttttgagacagggtcttactcctattacccaggctggaatgcagtggcatgatcagggctcgctgcagcctcaaatgcccaggctcaggtgattcacccacctcagccccctgagtagctgggactacaggtgtgccccaccatgcccagctaatttttgtattctttatagagatggggttttaccatgttgctcaggctggtctcaaaactcctgggctcgagcaatctgcctgcctcagcctcccaaagggttggggttacaggcgtgagccatggtgcctggcctttaacaattttttattcttttttttcccccctataatttagttatcgttgttttctctgggtgagagaagaaccatttctctcaagtccgttgttactgtgctggggccaatgacctagagcagtcatttctggctattttagtaatagaatccttccttaatatgaatcctgcagagaagctcaatatataaacttatgaaagaggaatcctccctttactgaagtgagctgggggccaacccccaagccacctccttggtatctgtaaggattcccggagtagcattttaaatcccctagttcctgggagaaatcaggactggaaatcaaagtaccctggagatgagcacggtgtttgctttcctgaagacccattcagcatctcgctgtcactcatgcatacgttaagtatttcttttcttttcttttcttttctttttctttttttttttttttttgcaacagtctcgttctgtcgcccaggaggagtgcagtggcacaatctcggctcactacaacctccgcctcccgggttcgggttcaagagatcctagtgtgtcagcctcccaagtagctgggattacaggcaagtgccaccacgcccggctaattttgtacttttagtagagacagggtttcgccatgttggtcaggctggtctcaaactcctaaccttaggtgatccacctgcttcagcctcccaaagtgctgggattacaggcgtgagccaccacacccagcctcatgcatacattaagtatttcttgccctcctgctggatataaagccctgtgtcagatgctgggggcatgggaatgaatacgatagacatgtcccctactcttttgttgaggatagggttttagcctttcagaaacaaaatctggcccggtgcatgaggtcgtttgtgtgttctggtgacaggtcatccctgtgggtgctccctgggcagatatgtcctactcaaattagtcagactctctttcaaagtgtgccccttaggaagccatgagaagcccagtgtgccaagaacactcttttgtgattctaaaaccatccccggggattaggactagacacaaactatgaagactaataggtaaataggagagttcgacagagtgatacctaaggggctctttgcaatgcagtaacaatctgctttctgtgtttatgcattgaccaaccctcccccacttcacccccaatattcttttaagtaggagttgaagggtataaaagctcagcctttttttttttttttttttttttttgagatggtctcgctcagtggcccaggctggagtgcagtggcaccatctcagctcactgcaacctccgcctccggggttcaagcgattctcctgcctcagcctcctgagtagttacagtggagacgttgtttcgctatgttggccaggctggtctcaaactcctgggctcaagtgatcctcccacctcagcttcccaaaatgctgggattacaggcatgggccactgcgcccggcctcagcttattaatgtaggttttcctacacttaaatcaattacatacaaatcttccagttttctcattttaagtgcattcttagaaatcacgaaagaaagcagagtgggcaagctgatcattttattctccatctgcagtcaacttgctaagtagcttgcagttaacagcttttgccacgagagggcgatgattgttggaaaggcagagctgagtgggccaaggttggaccctggggatgttgatgaaatagcaactggttattatgttccgttgatccagggccagaaagaggagacaaaggacctaaaatgctttaggcttagatagctaggtgatattctaggaggagaaaatttggaactgcttcagtttccagcattgtgttatacttttatgtgtaagagcctgaagttgaacagaaaaaaaaaaaaaaagtcggggcggagctgtcttttcttttaaaaatagacgcatggaagcatgtgtttgtttgttcctacttggtgtttttgttttatttataaaatgaaaacagctgaaataatttctggattgttctgaacttttgagcacagactcccagatggtttctgtggtctgggccctcaaaaacccacctgatgggggatggcgcccatctttggaaaaagctatttgaggctctgtgaagcagctcgagtttgtttgttttcccttgtatttgaaaatggaagtcaagcatgctcccagggcagagaattccgcaactgtgaccatcttgcaaggggcaggaaaagatttacagtgttttgctagaccaatcgccacttccttctggggtaaaaatccttaccagcaactccttaccagcgactcctcttctggctaaattggagtagcattttcctatcaaagtcatttaagatacagattattcaataacctgagagaagggtggagtattcatttctaatgacttcacagaattccagtcctctctgagcccgaagagttgttgactatcatcaggtgttaggcctcacatctttcatttgctaacagtattttactgtctatgaaaatggttaactggtcgggcacagtggctcacacctgtaatcccagcactttgggaggccgaggtgggcggatcacttgaggtcaggagttcaagaccagcctggccaacatggtgaaaccctgtatctactaaaaatacaaaaattagccaggcatggtgacacgtgcctgtaatcccagctactcaggaggctgaggcaggagaatcgcttgaacctgggaggtggaggttgaagtgagccaagatcataccactgcattccacctgggtgacagagtgagactctgtctcaaaaaaaaaaaaaaaaaaaaaagaaaaagaaaattgttaactgcccttaaaaatatagtcgttctccttcgacactcaaaagttctctatttgcaaatgaagttcatatgaatttgttaatgattcacttctcagtaattggcaatcccaaattaatcagatttccttgcactaatggtttctttaataaatgatattagatggtaatagaaaggacagtcttggcaataactgcttaaatcatagcatgagggatttagattttcatcagcagcttgcaccagaagcagagtctgactgaatattatctcctttgtagattagatagaagaagaattagggagatacaaagaagcattttctaagcatagttagactctgattttggtgacagtacgaactagggaagttggaaaatgcctcattggcctaaaactggtaacatataataaactaggactggaggcaaaattacagaagtttttttggtaattctcttgggctctttctgggggattcttagtcttatagaattttgctacttgatgctcatccatggcctgtggaatgtatcgtcctttcatgtgggtgtggggagaaaaggactggggcagtgggaaaggggaggccccattgttgccaacaccaagcccaagctttctgtagatgtggctccccattttcaactagaagaagagaaatttttcatgttctagcttgagaagccatgctcttaagttatttgaccctgtacatcctcgacccttcaaaatatttaaattattccacacttcagcgctggcatcacagattatacgataataatttaccaagcttcttttctgcaaacaggtaaaggaggaggagacatgggtggtaatgtaatttctggatagtttaaacctaaaagcctgctattaagagaaaaggggaaaatgactgttcaagacctgtatcttgaaagaatgctgtttatctagtattcaggggccagggagtgtgtctgtgggtaaactaagcaattcctccaagaattctgacgggaaacagttttggggtttgtcatagtttctaatattctcttaaaataatctgtttcccaacaagtaaaagcagacgtcatttcacgtaaagaatttctctgactccaccagtagcccttccatcttctcatttgtccggttaagcttgagtcagaaaaagaacacaacaattttggtaaaaaatttgttgttcttctcatctgaatagccaaaagttattggtgtgtaaggaccacagttcagataagagctactgtaactaaatttagagaaattacttttcagatcgactttcctgttctaaaattacatacttctggttggtctttgctttatcttcctaatcaagatctgaggtcactggaggtcagaaacatatggcaaaaaggaatttaaatattttccaattaaaaaattatcctaaaatatctttattatatttccaagccataaatgatcacaggtgctttgagccatggtactgatcccaggaaagtgtttgcaaacgtttaaaaaatagaatggatcagttgattcatgctttagctgatggcacggtctcttgggaagctaacccactcttgcctcttgcccatggggccaggggaacactgctgtttaatttgtcttaaatacctcttctgagactgtattggtccccgaccacccatttgcaaagatccagcatccgtcaagactatttaacagacgttccaaaaagctggatgctgacagtccaactgtcattttaaccttggcatctcccatgacagagtgtggagcagcaggctgtgacctagaggaaagacacagaagtggtgaggggttgcaggggctgtagcgtggtgagatggccctgtacaatatcaggtgaaggggaagcatttataaacttcctttgttttgatgtatctgtttttccccctatttctgcctatacacctacttgagcactggcttggctaaagttacccccaagaaaatgttgaagtaatgagtcacctacctcacttcatttttttgagacctcactttctttccttcctttctttccctccgaatttatgaatgaaaatagataggtagaggttgaattggctaaggctgtctgttgctttttgattttcccatctccaggggaagagggcagggaacgatccactccaattaggaatcctagacttatattcatttaacaactttatattatccagaacattttgtacaaatacattgtagaaataagttatttctagtgcttggggcatagtctgtgaactgatttgtctgtatatctcgtaaattttccatttagatgatcagagcaggacagaagtttctcgctgtgctcttaggctacaggcaactgttgtcactggctgacccttggttataagtacgtgggaactatgtcctgggcttcacagacaggaggagaagagttagttctgtggtgagctgtgtctttggggtggtgggaagtcaaccccaaagaatgattcttatcattgcttcttttttaactaagttggcagagttttatcttctccatagatacgtggtaaaggaaactcatttgaaccatttgaactggtggttaatctgagtaatatggaatatgttcaaagtgatgacattgtattacttctgtgcatggacaggaactagaacggctaataaaattgttgtcaggtagaagttctgaagagcctgacatgataaaaagataaggatcattttaaccagcacatttgctaaataggtagttgttactgctgtgccaaaaatttctttctattcttaaattatttaaaacattatctacctttgcattggctattaattggccaagcaatgcattcctttctacagataaatgttcagcctggtcctatacaagatatcaccatatcctatttgaacaagtgccaaatgaatgacgtgcattatatatactgagtcttcatccatcaaaataattttatttaaacagtttggattaataggaaaagaatggtacttaaagtagtggttcagagtcacaataaacagcctgaggtgacatctgagaggcagttttggcgctacctggaaggcagaggtgacaggagtacctgttagccgaaggcagtgagttttatgctgtggcctggcctttgctccctgcagtctttctcgtctcttccacatgtttggtgcgtattcaggtttgggcccagcctacgtggtgcaaaatgaaacaccatgtgtaatttcaagggtggacacatcttagagttctgagcaaaagaagaatgagcactttatgtgttgcaggaacgctgcttgcatctagtagatgctcacaatgtatctgctgaacattgaatggcattcatgaaattaacgcataaaacttcccgttagtttaaagcagagcctgggggtctacagtggagggcttgcccatccttatcaagctagacaacttggtaataactacttagctaactctcctaacgctacagaccaagaatataacgcaaggtaggggtacagtaaaagtcatgtgaatctggaatgccggtattccaggcatttgttgtgggtttcctggcattagattgttcatgggtcagtattgcaagagaatgcacattttttacatcatactctcgttgaaggcagggtttccttactggcttactgattatatcactcgcgaagggattagtcagaaggcaatggaaacatctttcgttttcattgttcagagagagactgggggtttgtctgcacttttacattatcagtgggtagaatctccctttgagattcttaacagagggtcatgaattagtataaaccttagctggtctgtatccaggatgaaaaaaataatctattttggtgagccacttgagtcataggctatctaacttacgagcatgcctactctgttaggtccagtaaaggattcagaaagagacttcaggagctgccctgggaaacaagacaataaaacagtgttgaattaggttttctagagtaatggtgctcacccaccttggtagttcagacaatcatagcagagcagaaccaaaatgatattaaatatattaattgatatatctaattaatcagtcattatttattggtgtaccattaggtgcaaggtataattcctactcatgaggactgagaaagaccagttgaagaagggtagaaaaataataccaactttaaaaaactctctctgatgtaacaatataaggcaatggtagaaggttgtcacatacagaataagatcaatcatcagatgtgtagtttaaggattgccgtgaattcagaagcagaagaattctccaagggctgtcttcatttgcaaaggcatcaccaatgagcaggaggataggaaatgcctggcatgtagacgggagagacttggagcagttgcccaaatgcctcagaagtaaccaagagcaagaagtggttgtgatattaaaagagatcagctcaagtagggacttgtgagataccagattgaaatttagattaccaccagacgacaggagctgtggtccttgtgactccaagggtgatccctagactagcagcattgcattacctgggagcctcttagaaatgcaggatttccggtcccaacttagacctgcagaatcagaatatttgggtgtggagtccaggaattatgctataaaaactgtccagttgattcttctgcatgctcaagtgtggaaagcactgctgcttagaactggggcttggttccaaatgacaatggagatgctttgaagaatcattgaagatgctttgaagaggagaagtggcatgtcttctagtgagcagacagaccagggcatttcagagactttcttttacgtggtagcctctgctgtattctcacttacctgttgctcaccacctggaaagtgaaatatctccaaattgccagtcactaactattgaagttgaaattacatgactgttctctgaagtggtttctgaaggctgtcagtaggccttttctggattctgatatggtatgcgtctaaaatatgtttctgtaagtaaggattttttaaagtatatactttgcaaaaaaaaatactccaatcaacaataagaacaactatagggtacttagagtttagaacataaaagtcattcatatgttttctaaccatttaaaaaatcagtttcctgtattttgattccattcatttatctagcacttatcaggaaattcaggtttccatgttacacagtttatatgggcccttataaatcagtataccactttgatggaaaaaatttccaaactaaatcattgcataatcattcatagcaatagcatcactgttataataaaattagcacaaattttaaagtcttggtaaaaagatttttgaatcttattttagtttttcttggcaactttggtgtaacagttggctataagaagggctataagatgttaggattgctattcctgctttaaatagttccagattggcaattttggggcaattctagcggtcacctattcccttatttcctaagctgggaagaatggaattttcttaaggttgaaatcctaacctgaattttactgatagaaccacaaagtggtacctagccgacagattcacacatggtgttcacttctgctgttgagtagcacgtgggtcctggtgctagtgtttcttttcctgctcagaggacctcttctctcttactgatttacagtgacgtccagatggtggagtttgctacaaagcagcccactgtatgaaagacatgacattgtattcacctggactctaggttgactctaaagaaggcaagggtcctttggtcacagggagaactgttgtgttccttcacgaggtagcagagactttgtgttctagagacttgagaccacctctataaatataaccagagcacaggcttcctgtgtggaccctcaatacacatttttgaatgttagcctcaagcaccttcatttttgatgtataaaaaaatggcattttatggctgggcgcggtggcgcatgcctgtaatcccagcacttgtggaggccaaggagggtggatcacgaggtcaggagatcaagaccatcctggccaacatggtgaaatcctgtctctactaaaaatacaaaaaattagccaggtgtggtgacatgcacctgtagtcccagcttttcaggaggctgaggcaggagaatcgcttgaaccctggaggtggaggttgcagtgagctgagatcatgccactgcactccagccttagcgacagagcaagactccgtctcaaaaaaaaaaacaaaaacaaaaacaaaggtggcattttattgacagctctattgaatgatgttgagggtgactcctggagtaacagaaagagcccctggctttgggacagacacggggtcaaattctggctgtgctacttactagttccatggccttgggcaagtcaactcctctgagcctctgtatctttgtgtcaaatgtggatgttaacatttgctttcataattcttgcatcaatggaaaagtagcttatatttgacatataggaggtgctcaataaatgatagccatgattactctttacttgttaattatgtcctctcatttgccttagattatcattttctaagcaaacaaaaaggccaagatggagatggtttgctccaaacagctaggtctcatcactgttctcttaagtaaaccaaatgcgtagagatgcccatgtcctcatggctttcctgcacccagaaaacccacaccctactcattttgacaccttccccctaaatctccactcttctatggaaacttccaaataataaaataccatcgaataatgttaacgtatttcattggagtttctcatctctccaaagagattgtagcctttttgaagtcctctataaatatgtactagtcagctgatttgaaatttgtttatcatggagccataggctgctactgaatgaagactagtgaatgaaaaatcagaactaatattttcctgagcaatttttaaggggtaggcagctacaataaagacaccttattttagttttccatgaagtagctactattgaatctcgattttacaaatagggaaaccagcatttccttttgtccaagttcatgcagcttgttcacgcagctgagctaggattttaacccaggcagtcaggattccaaggccaagtttggacccctataccacaccaatgagaatgaaggatgaggaaagctataggaaactttaaaaacgtccatggaaggagtgcccaaacagggactgactacagtcaaatcatgaactgtttcagttaggttcccaggcatttgtgacattacccactctgtttagataacgaatttatgtgtttagagagaccagcctcctatctgcattgtcagccatcagtctaaatcaaagcttccacccagtcctgaatctctcccttacttggtctaaccacctttccaagtatttaggaacaaaagatttgtgaacagattaaacacaggctgcttttgttccactcctacagctacctatgcctgcttaatgcggactacagggtgtagactggagtctgcgctcgtgtattttaaacacacgcgggaattcagcaccttcctccgacagcacaacaatggttcaacaattcttcacagaagaccccgcgctattatagcaaatatttataagtttatctcaccacactgctcagtgttcagagtaaatctgaatggaaatatggagatcaaagaatttaataatttaaaaaaccctttcacgctttatctgtcatcaaatgaaagtattagtgaagtggtatggaaatcctcttcagcgtgccttcagccaccagctgtgccacttaagatttaaaacaatgtgatcaagtgttcagaatccatgggattgagttgtatgtttacgttagtgtattatttccaagtttccagtttcccccggattagcacattttaatttcggctttattaaagcagtcagaacatgaaaggggatttagcagagtggagatgtcaaccacgctttcttgccatcatgaaatggtttacttggttctgggcagccatgcatatgaatccaacaacatgtctataagactaaaagtcagccaagtgggacaagaaatgcaattatggagtgaaaccacagctatctaaacacggtcgggaccttcaggtcctcaatttgatttcatatgaccctacagttatgaaaacccaacacagcatagtatcaactaaacagtaaatgctttaaatgctaggcattcctggagtggctcacataagcccagtatggtgttaggcattgtagagacatggtcagatacaggagacatggccctgggaactccatgagatacctcttgtaggaagccatggttttgatgggggtgcactttgtccatcagtgtgctgggatagaagactaaaagccactggtccaagaaatgactctttagttagatttaccaacacatgaaattatcagagaaaaatgcagtagaatcaccaaatgttcatgttagaaggcaccccagcagctgcctaatctgctggttcccaaaccccactcatcagtaggaagtacctggggaattcaaaaataaatgcacattcccagggcccaccccagaatcagaagctctgatagaggggcctggaaatctgtatgctttaaaatgctaccaaggggttctaaacgtccaccagctcatctggtccagcctctcagtgaacaaagagtatttctgttcacagccttgcaaaagtgaacatccagccgaggccagcatcccccaggttggaaggaactcattgtagaacaaggcagcacgggtccgatgttgcacagaggattggagttactagaggtttttcttctagtgtaatcaaaggaaccttgctgtaacttctacccactgggcttagtttgaccctttgcagtgacacagaccaaatctccttccaatgtggaaatccttcaaatattttaagagtttctcttcagtttgtcctttgtctgatacttatttgcccattcattcagttcagactgccagtctcctctaacactggatttactggggctggctgttgcacttccctcagctgcttctcggaggtcctggcttctcctcgccctcctgtttgccctcagtcagcgttcagtgtagtgcacagtgtctgacaccacactgaccgtgtggtctgaccagcagaacccaacaggagcagcaggagcggttgcttcctgcattccaggctctgtcctgcttcaactgaagactgttctgagactaatcagggacccaaactgatgcagacagaaatctccgtggcagatcaggaagggaaaatgtcagtgtggttgaatttaccaggcatgagtcacgtcctggtaaatgaatacatctggggatggaagagagacaccgtccttccagtattccaagtggagaaatactgtttcactggatacctgagtaactgctgcacagaccacgctatgcacgtatcatcaggtctgcaagctgaacagatgctctcacgtgtcatctcttagaggtaggatcagtcctggctgctatactcaagcaggaaaggtaagagggggcagctttttttccctctctttgtgtagtgtgagcaacctaaatatttccatctaagcaggttatggttccttcccacaattgaagggaaatattgatgtgcctgtttattggggggtcagcttcctggcctgatttgcttatctttaaaacagtcacaagaactttgcatattcttaggaaagaaaagggtaagaaaagaatcattgtgtcttgacagctggttgtaaagtgaaggagtcagtaaacaggttggtggttttatatacatgagattgaaaaaagttgccttgattgtttttccctgaatcggctggtcattttaatatcgatgtgggcatgttctaatcccctggttagtcagcgagatttctttctaagtagaattaagcaagcaaacaaacaaacaaacaacaacaaccaaaaaaaaaaaaaaaaaaagaaaaacacggatagaaaaaacagcagcaacaacaacaatagcagcaggaggagccacaatgaaatggttcaaggattgacctaccccaggactgcaggttttatttactgcagtattcagtacttgagcctcctggaaatcagaactccagcatgacctctgtaggttttgctttttctgttggtacaggaactgataaggtgactcttgagtttctggaatcagagtggcagccacgagggctgcgtaggttctgtgtgaggcccagctccagcatcagtggttggagaccagggagacgctttgagttcttctttactgagctgcacgtgcactgagcctggacagatggggatctacaaggggtgttttgagcaccagctgttagccacctatgtcctgcctgggacacaggaaggtgtaaatgtgggaaacaggcagagtctcatgcagtccctacaccagatcgtggggaatcgcctgagctcacaagaagagcattggtagagggcaaggcattatgtgggctttggctgggttggggaaattggattagaacaagaatactttcatttctatgctcaaaaatctttttctttttcttgttttgagacggagtctcgccctgtcgcccaggctggagtgcagtggcgtgatctcggctcactgcaagctccgcctcctggtttcacgccgttctcctgcctgagcctcccgagtagctgggactgtaggcacgcaccaccacgcccggctaactttttgtattttttagtacagacagggtttcaccgtattagccaggatggtcttaatctcctcgtgatccgcccacctcggcctcccaaagtgctgggattacaggcgtgagccaccgtgcccggcccgctcaaaaatcttataagaaatatttcataggtcctaaacttcggccgcaaacagctggctactggtggcaacaggtgccagtgagcaacctgttgtttgatttctatttaagttatttcttggctggatgtggtggctcacacctgtaatcccagcattttgggaggccaaggtgggcagattgcttgagtctaggagtttgagaccagcctgggcctgggcaacataacaaaaccctctctctacaaaaaaatatgaaaaattaggcaggcatggtcgcatccacctgtagtcccagctactcaggagactgaggtgagaggactgcttgagcctgggaggccaaggctgcagtgagccaaaatcaagccactgcactccagcctgggcaacagagtgaggccctgtctctaaataaatagataaattattgatagaatcaaaaagggatttgactaaggcatcctcttggccagaatgggcagactggagcgtaaaacttctgcaagatgatcaggacacagcattgggtagaggcctgaagcaaaggttcctgaagccgtccagcttttctgaagtccaggtgaacagccagggacagaggacagtagccagaagccatgccccacgaatggcaattgatagagaaagcaaccagtggggcgaaaccaggaggaagccagcatactggaaagtgatgattcagcctggacattgatgctggtcatgcaatggaggaaaagaaagagtctctgcaaaacagtaccactgtgctttctattggctgggttccccttctaaaaccctcctgattctgtcattttcaaagaggaaactaacaacacaccattcctgcttaactttagatgctgctattgttcgtggcaggagatcgctctggtggtcagcattaacgagatgtagcctagctgggggctgctccatttgtgctgtcatatcatgtgataaaaacttctttttcctaagatgttgatgacccctggaaaaggaaagtgttctctgatctattggaccaaaacttttcttctttcccgtggctttcacacacagatggaagtgagtgggacagggtggcggtaatttgaggtcattccctgggataagcaactctaattagaggcaggaaatgtttatttgagttttattgggtgagtcagtttggcgcagctttaggtcactctaaacttggggtatcctgtttaagtcaaataatcatagttttaagcaactgggaacaaatatcagatatatgtgaatgaaatttttactttctcaaccagcagactatagagtggagtttttaccatttggccaattgtgattgaattaaggcttttctccaaaaaaaaggcatctccccttttaccaaaagtgggatggactctaccctctctggcttatagacaatcattataagaaagaaccatgtctacaggcaatggaatattatttaaccttaaaaaaagaaagaaatttggaacaatgtgaatgaaacaggaggatattatgctaagtgaaataacccagacacagaaggataaatactacgtgatactactcacctgatgaatctaaaatagtcgaactcatagaagcagagagtagaataggttggtggtttccagaggctggtggagggggaatcggggaggtgttcaccaaaaggcacaaagtttcagttatgaaggatgatgataagtcctagtgatttgctgggcagcatagtgccaatttcacaatactgtattgtatacttaaacatttgctaagactgcagattttatgttttctctctgtctctttctcgtgcacacacacacacacacacacacgcacgcgcacacccaaaataataataataataataaaaagaatggacaggaactttgggaggagatggatgtgtttatggaatagattgtggtgatggtttcatgggtgtatactcatctccaagcttatcaagttgtatacatgaaatatgtacagctttctgtatgtcaaccagacctcaaaaagtagttttaaaaaaagaaaataataaatatacagcattgcatttagaaagaaaaggaaaaagaaaagaactaatcatgtgaaaacctattttatatattccatcttacaactggtgtggatggaattggcctttgctataggagtttgattgtgataactctgaatttggagaaagaccacaagaaggttattacatacttgtgtatggctttgaacaatgggagttagcagggggtgaaggcctagtagaataagggctgaaaacatgtgaaaatgactttttaaacatcattaaggtggttatttttgttattattacataggaacattgacatcactaaaaataattattactcagatgagactctttcattctgtatgaattgacaggcaagtccccagtaagaaaaaaaaatccttctttctattacccacactgaccttctagaaatacagagttggaagttctgggacactgactagacaaggctctgcctgtagttcacacatagtctgtctactttagagctggaaagtcccactcatcattatttactgttttcatttattctaatgatggttgtactttctttgtggcttaacattcagaaatggggaaataaatttgatttggtgaagttctccaaagtggctgtatatttattgtgtttctaccaaggaagtgtagtagtgaggaatgaggattgcttgtttatctttttcaaagacaataaaacattttggacaatggaaatggggaagagagaataacttcaggctgccttcttccaatccaccttgaactctgcttccagaagagttttccttaaaatcaacttgatgccattttacaactccagaaacttccaggggccggacgtggtgtcttatacctgcaatcccagcactataagaggctgaggcaggaggatcacttgaggccaggagtcaggagttcaaaaccaacccgggcaacatagcaagactcttgtctctaaaaaaaaaaaaaaaaaaattagctggacatggtggcacatgcgtgtagtctcaactactcagaaggctgaagtgggagggtcatttgagcccaggagttcaaggctgcagtgagctatgatcatgccactgcactatagcctgggtgacagagcaggaccctgtcttgaaaaaaaaaaaataagattttagggttctttacttcccacctatgttctcagaagcacttttctgtctccttcctacctatgtcctggatctatgcactgtttcctaaatgacagtttttttactgagctcacacctaccttcctcattcccacatgtgattttcgtctctgcttacctctgcccttcaaggttgtgcttctaatttgccaggccttctcctcctcccactcacattgttcaagattttactcaagtgtagtctttgccccagttcagctttatctgaaacaaattcctatagcagtggtcagtttcacacaccagttgtactatagaaaatataggagtttctggccgggcacggtcgctcacgcctgtaatcccggcactttgggaggccgaagcaagtggatcacgaggtcaggagatcaaaaccatcctggccaacatggtgaaaccccatctctactaaaaatacaaaaattagcaaggtgtggtggcgtgtgcctgtagtcccagctacccgggaggctgaggcaggataattgcttgaacccgaaggtggagactgcagtgagctgagatcatgccactgcactccagcctgagtgacagagcaagactctgtctcaaaaaaaaaaaaaaagaaaatataggactttccataggactgttttgtgtaatgatcttctctaagtgataaagcctggatgagcaatgattattctctagggggtgctaagatacaatccagatgcatagacttcacagtctgattggatacaggagagtttagcacataattatacagcattttgtgttgttttccatgatttcctgtcttcagtttctagctcttgaaaaacataagccatggcttatatcatcttctatatcccccagccacctacccaaaatctgggcccccaggaaagacctgttgaattgataggttagatgatatagacatggaggggagaagatgtttcagagtgtgaagttaggacccacaatttccttatatggtacattggagaaactgctcatgctgtcaccagcatatcaagtatgggctgttccaagcctggtctttagttggtcatttatgtgaaatcgatgtaagagctataaaatctttgcacgtataaacagctgacaggtgatggagaatctgtgtgtccaaagaaacctaactgctgctaaggagaagcctctggctatccgtcacaccttgaaaggcaaacagggcaggcctagttttctcttcaaagacaggaaagattaacgctctgggaaaatggagcccaatgggaatttcaaacacacgatgtggttcttccagccagtaggtcattatgaactattcttaccctaaatggccatgacacataatctctttcctaattttattattttacttgctatcacaagaccgtaactttttagacattcaggtgagattaagggaggaggaggtggaataaggcttttaaaatctttgattacctcagaaaacgtatttgcttactttaccaggaagttgatgttttgttttgttttgttttctacccatgccaagaggggattaatgagtagctgctgggtttgccagctttcttttgatttcatttacgtaattaagcagttctcagaatgacttgaggttctcaccctgcatcaaaacatgcttctcaaatgtgttagatttggaggtcagaaacaatgcagactcagtagagtgaggggaaatgaaaattttaccttgctttaaaacacccttaatgtgtaaaaaaagagttgatcgtgctttggggtcatgaacatggagctttgttgagtagaaaacaagttaaaactaaagttcaaaatgggctaaagtgagaatagctcaagatgaggttttacaatagaaatgatgtggggaaaccaactctggattacctttgagtttctagcaatctgaaccatgtccatggtgggtgttcaagaactcaggcatttgacgcagacataataggaacccactatatgcctggctcagttctagttgctggactacagtaaggaactaaagccacaaaaattcctcctctcatggtgctccctggagcgaaggttggatgagcagattttgtttgagcacctcctcaggtatggagtttggagctagtattgcttgggattgctaggaagaataagtgtgttcctcaaggagctgaacatctcactgggaagtgaagacaactatccaaagaacaaaagaaccactcaagtccataaccaaatactggggtgttgatatagacagaccctctgaaatggtgagagtgggcacccagctccaggttctgcagacacaggctcacggcagcaggctggcttaactagctaacttaactaagcagtaagaatttgcagttatgcatacacacacacacacacacacacacacacacacacacatttttagaggcagggtttcaccgtgttgcccaggctggagcacagtggtgcgatcacaactcactgaagccttcacctcctgggctcaagcaaccctcccacctcagcctcccaagtagctggaactacaggcgtgcaccacgatgcctggctaactttttaatttttttgtatagacagggtcttggtatgttgtttaggcctcaagccatcctgccacctcagcctcccaaagtgctgggatcacaggcatgagccaccacacctggcctgcagatataaatatttagatcactctttgcttcttatagccccctaaccttttttgttcttctattcacatggtgtttgcttttaaaagagattataacaacttctctttcaggttagttcaattcccttaaaaaacagcaagccagagttaccaacagttcctgccctcatgaagcacacagactacggcggggaggggagaaagttataaattaattacacaaataaaacctcagctgtgctgaatgctacaacagagagtgtggcatgtcacagggggatctgaccttgtcagagaagtcaggggcagcttcctgggagaaaagatggttgtgctgagatctgaagggtgaggaggggagagaagaaaacgttccaggcagaaagaacagtgtgagtaaagccctggggcagagggaacaagcgacagctggaaaggagaagactgagaagatcacacagactttgaagcatattagagagttttccgtttattcctagagtaacagggagactttaatagaatcaagctatagaggctgggcatggtggctcatgcttgtaatcccagcattctgggaggccaaggtgagtggatcacttgaagtcaggagtttgagaccagcctgggcagcatggcaaaaccccatctctactaaaaatacaaaaaatagctgggcatggtggcatttgccttactcccagctactcgggaggctgaggcaggagaatcacttgaacctgggaggcgaggttgcagtgagccaagatcacaccattacactccagcctgggtgacagagcaagactctcaaaaaaactaagcagtggacttagaggaggaaggggggtgggttacaagcagatttctgtttcggcaaggtccctctacctggagcgtgaccagcatttgcaataaatgtggggagcatcagaagcaaggcatctgcaagaatctagacaagggatgatagttgcttgggccataatggtgggcatgatggtggtagagagagagagaaatggacaagtatacagggaaaaaggtacaaaatgcaaagatacgataagtaaatatgacaggacttggtgagggctgagggagagagaggtattaaatgactaaggtttctgaagggtgaagctttgccccgagacctagagaactagttcattggggtagatcgtgaagtcaattttggacatattgggcttgagtgcctttggggcatctggatggagatgtcagaaccgcagttggatgagtggtccggagcttgtgagtcatctgcatagaggtgccttggaaactgggcgtggacaagatcctcagcaagcactcagtgaggatggggagcatctggagcccagcctcgtgggattccaacacttaacagctgggaagaggcgaagcccatgagagaggcagagaaaaccctgccagaaatttaggggggaagcctgaaagccaagggaaacaagtgtgtgttgaaagaggatgtggtcagggaagaaagctgcagagaggtcaaagaaaatgaagacttacgataataactgctggaatagcatctatagcaacagtcatagccaatcttcattttgagacaggcattttaacatataatttaaccttcatgagaattctgtaaggcagcttctattactcaatcatcctgatttttttttgagacggagtttctctctgtcacccaggctggagtgcagtggcgcaatctcagctcactgcaacttccacctcccgagctcaaatgattctctttcatgcctcagcctcctgagtagctgggattacaggcatgcgccaccatgcccagctaattttgtattttttgtatagacagggtttcgccatgttggccaggttgatctcgatctcctggcctcaagtgatctgcctacctcagtctcccaaagttctgggattacaggcatgagccactatgcccggcccatcctcatttttacagatcagaaaactgagcacagagagccaaaggcatttgcctgagtcatttgcagccagtgagtgataaaaccgatatgggaaggcctctttctcatcccacagcccctactcttaaaaactgtgtccagtgttggtagaataaaaagcatccagggaggatgatggggaggggagattttttccccttcagagatttggagtctcctaaacacagtcaaggaaatactccattgttgctaaagtccgagtccagggctggtgactgtggaatgggcacttcagtggctgtttcaggtggtgtggttcagtgttcagtgaatgatccagctgtacttcccatgtgaaaggcttatcctggtgctgcagggcagaggctgtcagagtgttgtccctggcctgccagcattgcccggaaacttgttagaggattcagattttcagactccgccccagatcttctgaaccagatatctgagttggggggctcaggaatccatgtcctaacaagcttccatgtgattctaatgcacaagtttaagagtctttgttcttggaaggaatccttgaaatgacaaaaaaggagaccagaataatgtataatccttatattgcacagatgcaagatacctaggcagaaaccagatggaggagagtcagtgcttctcaaccctggccgcacatgggaatcacctgaggagctttcacaattactaaggccaggcccccaccctcagaaattctgattccagtggtctggggttggcgagagcatttaatttttgaaatgaggatttgagtggagaatggatgattgaataaacagtgggcaaggcagcccatgtacttctgattacaaaattgtactctggggagaaaacgaggtaggctttgaaggtgaagggcaaagtaaatggaagaaaagctggacttaggccctttgtgaataccggtaaagatggaataattctggagactggagtgggggtgaaggtagtttgaattagtaacaattcttaactatggactttattttcaaagagatgtcaatagtaagatagatatgctttgtaaataaagaagctcattggtaaatgttactgagacctaatggaaaataatatgctaacatcctcctggaagcttcacttagactatacctatgtgttaaaaatgtgagccgggcacagtggctcatgcctataatcccagcactttgggaggccaaggcgggtggatcacgaggtcaggagatcaagaccatcctggccaacatggtgaaacgccatctctactaaaaataaaaaaattaactgggcatggtggtgtgtgtctgtaatcccagctactcaggagtctgaggcaggagaatcgcttgaaccagggagtcagaagttgcagtgagctgagatcgcaccactgcactccagcctagcaacagagcgagactccatcaaaaaaaaaaaaaaaaaaaaagaatgtgctctgcctctctggccttttaaacctcaccatttacttcgctaaccttcctctacaactgatctggtcagtttactggcccctaaacttgctcactccgttcccatgtcctggcattggttcctgctgcccccgaccttctttttctctccaggcctagctgcatctaaaatcctccatggcctcccaagtcagagagctcctttttctctgaatctttttagcacctggtgtctttcatgcattcgactcttattttgtttttttatcattttgtccatttcccatctccacccctggattgtaagctccccaggacagcaatggcttgtaattatttgccctcacctagcagcttagcaccctaggagcttagaatataatagtcaagaaacggtgcaaagagaatgtcagtccatcctctccccacatcatcatggattgcaggtaagagggggccacctacaataaggtgtgactgtggtttggccgttctgagggctgccttgcaggaggaaaccataggggatcctggaaggaatatcctccaaagtaaaaagtggccctcacagtgcatgggggttcacagtcttgattccacattgcaatctattggtctcctgggactgcctcaacaaattactgcaaacttggtgccttaaaacaatagaaatgtattctctggcagttctggaagccaagagtctagcatcactgggcctacatgaaggtgctggctaggctgttctccctccagaggttccgctccttgcctcttccagcttctggggctgtctgcatcctttggcttgtgactgtttcactccaatctctgcctctgtggccacttggcctcctcctccctgactcaggtcttcctctacctgcctcttataaggacacttatgattgtatttaagacccacgctggtaatccaggataacctccctatctcaggatccttcacttaattacatctgcaaaatccgtttttttttttttttagccatataaggtaacattcacacattcaagggttaggacctggatatcttctagaggaggattgttcaacctaccacacatataaagacaactggagccccaaaagggcagagacttgtccaagatcacacttccagatgacaacaaaaatcaaagatccaggtctcctttctgtccatttaggcttcttccactagaccgaggtgatgcccaccgaaggcggacagagaaaaagtaaaattgtgcttcataccctaatctgtgtgctttattcgtttgtcttctttatggatcaggtgctaccaggattcacccacctttgaggcttcttcccccttgagtcttggtaaccttacactgagctcacactaagctggcctgtgtgggcagctgcaatcaaatgacccaaatggcattttcttctctcctttcaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacaggtagcctcttctctcctcctctttcctgaaagtgaagaaaataaaggatgcttcagacacttgaactgacttcagctcctgcccactcgtctcttagcaacctgctttagattagttgtttgttccaatttgcttacagaagacttttttgggggctgtttattcctgtgaatgttagtatttgaatggccctgggagatttgacccactgtttgtgccagttttgatttaaagctcaagcatgacattttaaaggcttggtgccaggtgaccttggtgtgaccttcgtttttctctctctcctccaccctcttccttgaacatcagggcattctctttacgtgtttcttctgtgccatgaacttcctccccttcctagtctcttgccacttcctgagtttgtttggcttagttttctccagcagatagaatcagggaaggaggagttgcttgagggactgggggtttatgatcttgggtggggaacaaggaatgggaactagacaatatccaacaggaagttactttttgcagatcatccaatcctttattactgcccactccccttccaagaaacacacgcacgtccacacacacatgcacgcgcacactgattttccatgaagagaacaaaactacaaaggctcttctgtgaggtcaggaattctgggaggagtaaatatttataattagccacaaggatactcaagttccttaaggttttctcaatggctgttaatttcttcacttggtctttgcttcttctttttttattttattttattctattctattctttttttttttaattgggtagaggagtagctggcttcgtttcacctagaacttggtgaaaccaagtatggacatcatcttggtctagtggaagaagcctaaatggacagaaaggagacctggatctttgatttttgttgccaactggaagtgtggcattggacaagtctctgcccttttggggcttcagttgccttatataaaggttggtaggttgaacaatcctcctctgaaagatatccaggtcctaacccttgaatgtgtgaacgttactgacctgctcctgggagcagtgccctggccagatgttcttcaaggcattctggtcaaccccactccaggcttcccttccttctgccatctcttagcttccttagtcagtgatttcctagagcccatataataaagtccatacttcctagcctgccattcatggccctctgccatgggaatcgacgcatttgttttctattgctgcatatccagtgaccacaaacggaatggtgtcaaatagcatccatccattatctcacagtttccattgggtcaggagtccaggcatgacttacctacatgccctggtcagtgtatcacgaagctgtgattgaggaatcagccaggctgcattctgttctgcagtttgggctcatctttcaagctcatgtgcttgtgggtagaatttttttccttgcagctttagtacttatgtggcttgctccttcaaggccagcaggagagcaagtcttttctgccgtaagtctctaacttcagggaaggtctgggccttcttttcaatggccctaatcaggcttacccaagataatgtcccttttgattaactcaaagtcagatgattaggatccttaattatatctgcaaaatccctttgccatataatgtcacataaccccagtagtgatatcacatcagctttgccatattctgttggttagaggtaagtcacaggctccaccttactcaagggcaaaagattatgggattataccagagcatgagttgggggtcactttaggctgtgtctgctacagcttcatatacctttctctcctcacttcccacaccccttgtttcgcacccacaaagtttcttagcttttctcaaactcacctgccaatttccaactttgctgtgcttctgccctcatttgcacctcctctgtccagccccaaaaccccatgtagcactgcctgcctggccccatcagccagagtgagtccctccgtccctcacactttcctttgtgaagaaatcgcaatttgagactttcattgctgcacctgcccctgttcaccttgtggtaggattagacatctatatggatccttcactaagtttcaaactcaaagggccatttcttctttttattaaaccttcaatcttcctttattcttaatctacatgctcttcttgatttgtgcataatgaatatcaaccattgacttcagttaatggtctgaatggccttaatccctatcctcaaagcaatttacaagctacttagagatgcaggagttggatacaatgcacgtacttcaaggctgtgcattgttaggtgccaaggacaagaagaaaaacgccatttcttgagatgccttccccatctctaatacagtgagtacaatcaccaacattttattgcagggatacagagactcaatttaaggaatgtgtccaaagccatacttggtaaatgacagacataggaggtataactgacacaccaactcatgctgcacaccatgacacttggtaccctgccttttcaagtccaactctaaactccttcactaatcattttaggtactccaaaacttgaccttcccttagacatttctgcttccctaaatgaatgccttcctctcaccaacctgtgaccacttttgccctgttggcttctatgagccattctcttctccccacttgccttcccattgtcctaaccattcttatcacagtggctggctccttcatcctctaaatgctggttttccccagggccttcctccctcctcattcttattctacatactgggcaatttcaaccttcgcatggcttcagacaacttctacatgccaatgactcttcacatatgtatatccagcattcctctatatctagccccccattatttccagagccccacacaagatctcttccgttaaacctctccccatcaatgttggaccttcccagccttctcccttcttccctggctagtttgcagtagttactgtcttcactagctcactgccccttggttttctgccctccagtctatccatccacctcccctcaatggctgcccacaattcttctaaaacacagactggttgttgcatgttccccttcttagcagccttcagcccttataagataaagtccaaacccctttgggaaccagaccccttcacgccctggccccggggctgctgtgcatagctttgtagtttgggcccagcagaagtgaggggcacaggccgcgggttggggaaggcatccagcccctctccacttgcatggggagcttcagccctcagcaagagatgcttttctgcccagaggagatggagttttatgcttctcacaaagacaccctactgttaacagggccccgatggccatgatgaccttttggcccttatccctattgccaccctttaggcactccaaattacttgccattatcccccaaataccattgcctctcacttctctgagactttgcccccattgtccctaggattcccttgctcctaatctgtgtctgcatcagtggttcccagtttgcatccaagatctgactgcctcagggtctctggtttaaaaaaatacagatcctataatacttggggaggggaaataggtaaggggatgggtgaaaacagaatggtcatgagtaggtgattgctggagatggatgatgggcacttggagttcactattctgtctacttttatgtatgttttgccataatgatcataaacacagattccagagtaatactcctggagctattgattcaatagatctgatatatggagttcaggaatttgtattttaaaaaaagtgttctctaggtgattgggggaccgtagctcaagagaatttcatcctcaggacctcaccaagcactccagctgtgagcggcctcccctgactccctcccctagtgggatcatgcctccctgagcaacatgacagtctctttattgtgcattttgcttgttccctctgccacccttgggtttttacttatgatacctcttctgtgattgagaactccacctgagagtgcttacctagttgatctaagacagtaccctactggcagtagatgatcaataaatatttgttcttctagtctctcctgccccagagtcttctaatccagtggattgctacctcacaggtatatatttctccagtctttgtttgaagcatttctagtatacaagatatttttttctgtgaccctagaaaacaccccatttcctcttatcttttattttatggatttatgaggaccctgtggtctgtgttcccatgctgcctttgtatcaagctgcaaaaggctctgtggggaggtctatatgaggttgatggagaagctgtacatatgtgtttctgcctgtttgcttctggccattctgatccaggcagagaccatgttttatgtgatacagggaatttatgtgggagacaggcaagaccaaatttaggaggacaagtgtcattgcttaagttgagatagaattttccagccttcctgttggaattgatatacaaactaattagcagctaattggttcatgtccaagaagtaagagaagtcatttctctggctcacacttgaaagagagcccaaacagatagacacaatctccttttcctctggtttcttttccccctagacagcagagggtgctgtctctgtgtcccctgctggacacggggttggggaagcagggggagggctgggtgggggttcctgtcccttgtgctgtagtagaagaatgcattagatcacctgtttccacttttcctaattatggcatttaaccacccgccctccccatacacttgtaggcactgtgggaggtttttgaagggtgggccttccgtccaaggttgattcagggaaattcctcctcctcaacatgctgctcagtgcttatgcatgttagtctccgagctgctcaacagcagcagctgactttcagagaatactccctctgtccccatgtcatgaaggagaaattttgtgatgatgcctcagacagtgaggggagtagaggggcctgggaatggagctgaaggcttggcagccaggaaggtatctttttattcttttgtaatccagaagccaggagcgctgtgcagcagagggtggagaaagacgtagattccatagccctgaccaagtgtccccatgttttctgcctgcatcctcatcaataaagtagggatgatagttatacctgtctcacaaagtcgtagggatttcatgagtgaataggtctaagtaattttaaataaataccacctgccacagagtaagtactcagtaaatgttagccagtcacatacctcgaatttacattactaagatacagtgaaagaacattagagatttcttatccatcccggtctccaaaaggaatgcctgaaatcactttagagaaatgaattatttcttgtccttttttcttcattcttcccttctgataaaatcgaactctttcttttttgaaatgataaagtagtagtcataggaaaaataaaaatctaagcagtgaagaaaggtgtaaagtccgtttttcttcatcaaactcataactacccaggggtaaacagtttaacagtttctagagaactttctgagaaatcttcgtgagcaacttacaaaacctctttgtgactggtctccacttgtgaagtttagatagtacctgccttgtctctttcaaaaggtagctgagagtgattgctggaagtcagactgtgatagaggatatgaaagccagtgggaaatgacagagcgtcttatctatgtcacatatcatgaataattaacatttgtcattttgagcattaaaatttggtctttatccaccagcagagaaagatgtaagttatagactcttcctccttagattctccaagccttttgatctctaatgagcccttatcatcattccctgagagtcagtcttgccttagtgcctgtcgtgtgcccggtgccagaattgggcagaggggagacaaggagaaaggaggtgcctctgccttggccaagcctagattcttctgtactcaggaggtacttagaaagggctttccttgttgaccatgatgtttataaaaagtcagataagaatcaagagcaaggaacaaaaatccagtcagaacctcagtgcaccttataaacctgtcttaactatcttgttctctccagagctggggaacaaagcccaaaggagaggcttaggaggggctttcctagaagaagctggggttgtactgaggtctctagctgtgccctccaaaccaggcctccgtatggaaaatgcatacgaagttgtgatgtaaattttagtcctgccatcctgctagtcagaggggaaagtgtgtgccttaatctctggaatcatatcctgccattggcacacagttagggatttgctgacatgaatgaaggtctttagttaaacctgagttaataactggaaggtctaacgtgtagtctcatcctcttttaatacattatcaagttatttaaagctctaatacaaagaaagggaggagaaggtaggggcatctctttttgcctttgagtcttctaggacctgacctttagaaagtcactgagggtacttggggatcgttttccccagagagcatcgttcttagctgtcagcgttaccccatccattatagaaaatgatattttgacataaaattcctaaggatctaagggccgagtctctaatggaaggaaatcagctaccatggcagaaatgatgagttaaatcagggagggccttggagactgcataatccatctccttcgttttataggtgcagaacttggaaaccaaaattgtggaataactcacccgagtttacacaatgagatagtataaagcttagatgttacttcagtcaaagatatacatacagatgaattagttctacatggtgttttggttaataaaaaagcagttttttttttttgccttccctcccctcaatttccccttccaaagaagcaaccacattcaactcgcagctgggtcttttggtatgtacctctgtatttagaaataacattatcttattgtacttttcttttttttttttttgagatagggtcttgctctgttgtccaggctgccatgcagtgttacgatgatagctcactgcaacctggaactcttggatttgagcaatcctctcacctcagcctccctaattgctgggattacacaggcatgaaccatggcacctagccttattgttattttaaaaacaattattttacacattatctagtgacctaccactgtggaaaatgaggttttagttccgtttctcacccactacccacctccacagccctatcacatacgcacacccttcccaacctcccatcctctcaatatggtttactgtaattttggttaaatgaatatatagtatacattattataactgtgaaataccatttggaattcagttatgtggtatgctatagttacttttccttcccagtgcattttttttgtttattttccctgaagttaataaatatctctttgttttctatgtaattattattgattcaaccacaaactctctacaaactgtccatatctccttttagcatgtttaggtataagcagtattctatcaatttcatattcttggatacattctttgccaagccttgtaaactattccagtctaaatggttaccttctgccctgtgtgcctgccgcaaagctgtcacgctgggatcccacttcactttcatcctaggcttccttttcccactatcctgtgaagctcctggttccagtatcccctgccttcctctttctttgtatactgcatcaatttggtgaagcacctttagtagatttctgagaacaaatatataggaagtgaaatattgagactttccttttatatctaaaatcatctttattttactctcagacttgataaagagtttgactgggcatagaattttagattaaaaagaatcttcagatgagatcatgtcctttgcagggacataggtggagctggaagccgttatcctcagcaaactaacacaggaacagaaaagcaaacactgcatgttctcacctacaagtgggagctgaacgatgagaacacatggacacatggtggggaactacacacactggggtctgtcggggatggggttgggagggtggggagaggggagagcatcagaaagaatagctaatggatgctgggcttaatacctaggtgatgggatgatctgtacagcagaccaccatggcatgcatttacctgtataacaaacatgcacatcctgcataagaactcagaacttaaaataaaagttgaagttaaaaaaaaaaaaagcattttcactcaattttaaggtatcattccattgtcttccagctctcagtgctgctgtgcagaagtctgaagtcaattgaattctcaatcatttgtatggatctatttctcttttccagaagtgtgttaaagctttgtctccattattctaaaattattgaatgatgcgatataggtctgttttcatctattgcactcgcccggcatagatctcttcaatttagaaaattaagcccttcagttctagaaaatgtattacttatttctttactgattctttctcttctgttttctctttctggaactatcattcagatattggactagtcaacttggggttcactgtagactaatctgggtggcccacttagttggggaacctcagactatcactatttctaggcctttcctcttggagtgcttcgattactcccagagtcctgcctaaagggagacggcctggtggccagcatcgcagcaaccaagtgaagccagattagaggacccggcttccagaatacacatgtttatttaattctcctgtgttcagtactataccctcatgcccatctacccccactccatgcttagtctagagatcctgtttcacttctccagagaataaacctctagggacagggaaggggccgtgccaagaagaaaagagaatctggatttataactagttttcaaccaaatctctcttttctctcgctccacatcaccctcatctccagagtaactgttactgcatatttcctgagctttggggataggaagatggaaattctgcagcaaaaatttgattgctcttgaccttccccattgctggttcaggattcagttttcttggatctactaattcagttaccactcatccgtttactttcaagattccaacattgtgttgcattcttttcttactctctccatctttgtgtgtaattttgagaaggaaagtaaaatagtggtgaatattcaatatctacggtctttatccagaaatgaacaagaatcgtaataacagcagcaacaacaataatagcaaaacacttatttagcctttgtgtagccagacactattctaaacactttgcacatgttacttattgagtcatcacaccaaccttatacagtagaagctcttactgtccactggatttacaacctttccaaaaaggagatgttgccacatcctaccaccatcactggcactgtgtcaggtcaccctgtcctctctgttgccagtcacagttttacatgggaagcaacattgtatgttggagacagcacagagtttgaggtcagaagaatgaggctgaatcctgggtctgcctcatctttgttgtgttttcctgggtagaataattaaactgtttgaaatgcagttttctcagtgttccatgggaattataatgcaaacctctctggactgctttgaaaattacatgagaaaacatttgcagaagtgctgagtgcaatctttgacacctagtaagctccattattattggttggctaaacggagaacacagttctggagtcagaaagtgaatggactgaatcatgcccccaacccccagattcttatgttgaagctccaatccccagtaccacagaatgtgatggcatttggagatagggcctttaaagaggtaatgaaagcaaaatgaggtcattgggtgacctaatccaatatgactgatgtccttaaaagaagaggagattaggacacagacaagcacaagggaagaccttgtgaagaaactgggagaatacagccttctgcaagccaaggagagagactcaaaagaaaccaaccctgccagcaccttggtcttacacttctagccttcacaactgcaagaaaataaattcctgttaagtcgctcaatctgtagttttttgttatggcagttctagcaaactaatactgagaacctcagttcaagtcctagtattgccacttactaactgtgtaatgctgggcaaatgacctcatctctctgagccacagtttcctcatctgtaaaatggctccactaatgtatattaaaataagagggcaaggcctgcggacttggcataaattgtaatagttaaataagctactgggcataaaaatgtctctggggttgtttaggggctcagccagtgcctgaggagttacaggtacccccacgatggtggcagtgcagtaacactgcagtctgggaggagcaggttggtggatatgtgagtctgtgtctcttttacaggctaagggcccagatctcacaaccaggtgatattttattcttgtggtcactttgggacccagggacaggatatattgatactgataaacgtgcatgatggtaaccaatgggctggaagggctgacagatctgcttgcattataaagctgcaaagtcggcagggtgcagtggctcacactggtaatcccaacactttgggaggccgaggtgggtggatcacaaggtcaggagatcgagaccatcctggctaacgcggggaaaccccgtctctactaaatatacaaaaaaaattagccgggcgtggtggcgggcgtctgtagtcccagctactcgggaggctgaggcaggagaatggcgtgaacctgggaggcggagcttgcagtgagccgagatcacaccactgcattccagcctgggagacagagcgagactccgtctcaaaaaaaaaaaaaaaaagctgtgaagtctgactttggtgtcttgacttccctgttgggctccctttgcacccagccaccttcatgagaacccggcccaagccctggtccctatgtgacctgcttcagcaaagaagctgcctttggaaatgtgcactttagttataaaagtcattctgtccctctcccatgtcatatagatgaagagtttgtcccctactaaaggaatgccaaataccagcatgagtttttcaggagtcatcacttttatatgggtccaaatctacttgaggctgagactatctttatcccaaactgattccatgcagtgttacctgccaatgacagttggggggtgaaagcattgtgacctaacaaaggggaagggaggaggagagaggagagcctgagctggctgggatgaaagccaagtttacattccttggaggaagccgcgttattgctgaccagcttagaagtagaattctgactgcctttgacatcagaggtttagagcaaacaggaagtttggaaccaaagggaaattcctgattaaatttgagtgtttcagctagtaatgtgtgttcagagcaaaaattatgagggaccccgtcatctcttatttttgtgtctttcatggtagctcatatagaactgagaacccattatagtggttaagggcacaactctggaacccctggtctctaaccctgcctctgcgctcattagatctgtgatgttgggcaaagaacttaacttccctaaacctcagttccttcatctgttaaatggggttattactccccccccaacccacacagaaatattgtgagaatcaaatgagagttagtacaagtaaagcagtaacaactggttctagtacagagtaattgctcactaaacattaattaatgttattattatcattgttattttgcaagtggctgagtgcacagttcataagattcactttgtccatctcaaaaatggggatgaatgtatcctgctagttagtaaactgatgaaaacactttgtctagttagaggcctccaaacaagggctaatttgaggtgttgggacctgtcctatataggggaatttgacatcaatatattttattttatgactatgctgtgttctatagaaagtagatgccttggaacaattattgctgcaatatattcaacagccagtactgaatgctccaaggcttagtcatatgatttttgtttcttcaatgcctttggctattgaatcattagattgagctactaaaaatgagaattgtttcagcaaacaagtggcagctttgccgtggtaagcagagtcctgtgtgaatgtttgaagttggtctctgtggtccctcccagttggccatgtttgtttcaagatgactcagtcgggaggtggggtgaggaggagagtggtagggggtaccatagtgagctgaggcagtggagactacacttaattggctttgcttccctctggtcatgcagcagcaagctaaggattcatactgctaattgttgccaccttctctctccttgcttctgggtctcttcttccaacattcttggccaattcattctggtaagcaaggagctgggttgctttcttgctcagaagcctgccatgactccattatcccaagacatccccactcttctgccacttactcaaagccacccataagctgaccctgcccctaagcttcctctctggggtttatatactgatctctttctaccccacaagatgacccctttctatctcctcaacagcttctccagccaaactcctctttgagtcactacttgagcctaacagaggtgctcattgacaggcctttgacacacccatacacaatgtgcatttattaccaagatcttaagcatcaatagtcacaatacaacatgtttccaccaccctgtacctttgcttaggaataccataccttttcctggaataaggtatggtattttttttttttttacgctaacttttcatcctttgagattcagcttcagatcatttttcctggctgttagttatttcttccagcgaagttagttatttcttccccctgttaacattgcatctgctaccttatattctagcacttcttatactgcattgcaactatttcttggttgactgaccctacagagtttccataggttatgataaatgtatagttatacccagtggcccatgatttcttgactaacctatttacatttatcgagaaaactccagggaggtgaggggattttctaagcatatttggctgcaggatatattttctaatggacttctcactggaccgctcttcccctgggctcctttctgtgtgcatggccctatttcacctgtctttttagtcttcacaaggtctggttggtgagttgctgcagtggaaagaatacagagttaggaattagggactagaactctaataaagctcagtcttagttgggtgtccttgggcaaatgacttctccttgctgggtctcagttttcctacctacaaaatatggtggccagactggatgatctagctctgtgatcctaagattgtttggtctgggaatgccttgaagagcatctgaaaatgaatttctgaaaatctgtctcaaaattacctcagtgaggctccagaaggtaactgatcccaagtaacaagagtgcccctgaggaacattcagagatccaggcccacaattcctgtcattcctcggaaggtgagacttcattggctggtggtcctgtgctctgctctcggtatgtcaaatcaccgtctgtgggttttcctccctctctaatttacccaaagtcctccctcttaaccaaaacaaatagcttttgggggatctgatgttgccaagttgtatttgctcctgtggcaagcagagctcccgcaaggggctgtaaccaaccatgtaagcaagaactgctggccgaggagcagggatgcttgctcagaagtcctagtcctgtcaggattgagaatgccacccctgagacaacaccctctcggaagtggggcacctctcatgaagtcccctcccgtgttggaaatctgctcatgcaaaagcattcatcagaagggggtttctttctagatttgtacttttgtctggggaagcaactaagaaaaatatctgttgtttgaagagcagtataatttaagcagacattcatttattcattcaacagacaacgagtaagtcatttttgctgtgccaggtataggactctaagatgccatgacaaggaagaagagcacattctgtctctaccttctttctgaatcttccttctttccttttcttttttctcttctcttctcttcttttctcttttcttgatgggatctcgctctgtcacccatgctggagtgtagtagcacgatctcagctcactgcaacctccgcctcccaggttcaagcgattctccctcctcagcctccctgaatagctgggattacaagcacccgccaacttgcctggttcactgttggatttttagtagaaatggggtttcactatgtttgccagctagtctcaaactcctgaccttgagtgatctgtccgccttggcctcccgaagtctgggattacaggtgtgagccaccatgcctggcctatttcttttttaaaaaactgataaccagagagacagtctctgcccctttggcacttgaatttaggtggggatggcagacaataaaagaagcaataacaataagagttatgatagaaaaaaatatggagttgccagggaaacacattacagggatacctcagccagtttagaaaaagtcaaggaaggctttctggaggaagtgaccactcccggagagatccaatgggctaagtaagagttggccggagaaagaggacatggaagagtggcccaaggagtgggaatagcatgtgcaaaggctctggtggagggagagggaacaccaaatgggtctgtggctctacagaatttgtatatgcctggaactcaaagcacaaatagaggccagggaccctagcctcagaggctgtcgaatgactgtcaaagccctgtaagtgcacggtgacatgacctcaggttttatctggaacaacatgtgggaactgaaagatgatcctagtatttaatagaatttcagaggtgggagaaaacttgggagtttagtcctccaattcgctgttttatagatgactaaactgaaactcagagacgatgtggcttgtccgaggacactcggtctcatagcaacacagacagaaccataagttgggactctagtgttttggtggtgtatgctgataaactggctttcaaaaaaaaaaaaaaaaaaacccaaaaccctgatttgtagcattaactgatttctatggtataaatattctccctggggccagtttcaggctatccatgttgaacaaccagctcacaaaattcctgaaattttaacaatctgctcttgtgagctggtgtgagctagctacaggtcccggcgggaaaggtgattgtgcgtgtctcttccccattctgtgttcagtcacattccattggtagcttgaaatcagccatgatggtagtacttataccatggaaatcagcaagggttttcctcattgtaaagccattgttaagtgcttgccaggacaccactggagtatacagttttcaggactagtaatcagagactctcttatgaagataagagaaagcattccagtgtgttaacaggcctacactgggttcctttacatctctggccttgatttcctcacctgtagaatgaggataatgtcaaagttcaataaatttcagatgtctttaagatacaccattatttttatttaaataaactttttgttttagaacagctttagatttacagaatagttgcaaagatagaacagagagttgccacacaccctacaccaggttcccctattaatgaactaatactgacacattattattaactaagcccatattttattccaatttcctaagtttttacctaatgccttcttgtcgttgttccaggatctcatccagaatatcatattacatttagttgtcatgtctccttcagctcttcttggctgtgacattttctcagactttccttgttttatgaccttcactatttgaggaatagtggtcagttattttgtagaatatctgccaactgggatttgtctgatgttttcctcatgattagactctgattatggattagacaggaatacctcagaggtgaagtcttattttcattacatcacatcaaaggtccatactatcagcatgacttatcattgatattgacctcaatagtcaatatcaaatgtttgccaggtttctccactgtaaagtttctctccttttccatgcccttttccatactgtattctttgcaaagaagtattatataaagcccacacttgaggagtgacaaattatatttcacctctgtgagggcagagtagcaatgtaatttatttagaattcttccacccatgtgcattgtctcctccaccattatatatgtatttgctcatttatttatatcaatatgaactcatagatagttattttatattttgggttataattcaatactactttattttgttgctcgaattattacagatctgcttattgggagctccattaggtggctcctgtgtctctttgacatacccccatcattgtggagtggtttggttttcagcactttcttactttctggtattacaaaatgtatatttcttgccccagtcctagaatcagccattttcctaaggatccctggcttcttttattggagaatggaaatagaaaccaaaatctaggtgcgaagtgtgctagttgctgctgggatgtcatttcttgtagtccctctcaaaggacagaacaaggaattgtgtgtgttctaactcatgaatacacacatacacataactcatgtataatacacatattaagtatttctacagtggacccttgaaaaacatgggagtgagtgagcaaatataaaaaacagttgaaaatctgtgtataacttttgaatccccccaaacttaactactgatgccctactgttgcccagaagccttactgataacataaacagttaattggcccatattttgtatgttacatgtattatatactatattcttaaaatgtaagctagagaaaagaaaatatttatagaaaatcataaggaagagaaatatatttataattcattaagtggaagtggatcatcataaaggttttcattcttatctccacatttgagtaggctgaggaggaggaagaagatgaggggttggcagagatggaaaggaggaggtggaaggggaggcaggagagactggcatacttggtgtaacttcacaggaatacatcataatttctgtctgcctcttttgccttttcatttctctaaaaatgtttctaaactataccaattcttccaccgtttgctttattttcagtgcccataggattaaaaggtccatgttctgaaagaagtcaaaagcaaccttgaataatcagaatcctctgccagattgcctaatgtcagtttttattctggcactgctgctctacttcttcttcctcatcatctggcattgctttggaagccttcgtctccatcaagtaaccttctgataattcttctgatgtgatgtctattagctcttgaattaccccaagatccctatcttgaaacccttcaccttgtactttttttttttttttttttgccatatctgcaatctctttcatgattttcttgattggtctgttgtaaatcctgtgaagtcatgcacaacatctcaaaagttttctcctacaggtatttattgtttcaggcttaatggctttcatggctttttctagaacaaggatggcatcttcagtgatgtaacccttccagactttcatgatgctctctctgttggggttcttttctgtagcattggcagtcctttccatagagtactatatacaatgagccttaaaggtctttatgatcctcttattaagaggctaaattagagatattgtgtttgggggcaagtagaccactttgacttctttgatgttcaacttatgaggttccagatggccagggatattgttcaatatcaaaagaactttaaaaggtagtcctttactagcaaggtacttcctgacttcagggacaatgaaaccaattgtccaatgaaaccaatctagaaaaagtgttcttgtccaggtccttttgtacaaccgaaagactggcggctggggtttatcttttcccttcaaggctctggggttagcagctttatagataagagcagtgttgattataaacctgattgcatttgcacaaaacagtggagttagaatatcccttcctgccttaaattctggtgcttggttctcttccttactaataaatgtcctctgtgacatcttcctttttttttttttcccagaatagagcacttttgcctgcatcaaaaacctatttgggcagatgtctgttcttctcaatgattttcttaatggtgtctgagagtttgtccgctgcttcttggtagacagaagctgcttctcctgttatcttgacatttttttaagacaaatttttttctgaaattatcaaaccatcctttgctggcattatatttttcagctttagatccttcaccttccttttgctttatcatataacttcccttcttgaatcatattagagtctatagctagggctttcttatagcaaccctgagcccctgtaaaagctgcctttcaatacaaaattaaaaggtatttcacaaaaagtgcaaggttttcatgcctgctggcatagctgcaacaacaacttcacaaattatctttatctttccttttttttttttttcacaatagtgcttacgtttgattcatttatcttgagatgtcaggcaaccacagatgcatacctcaatctgtggcacgtatcaagaaattcacctttttcttctaataccatgacttttgggaacacttccagcatcactagtgaatggcactacagtattatactaaacacaatgaaaaatactcaagaaccaccagagatcactttttgctgtgtgtaatacacaatttgctggagagaggaactgctcatatggaggtggttagcatcacatggccttttaagcagatactcacaacacttgagcttaccacaatagcaacaggaggtggctacaaaattattatactaatacagtatgcagtacagttaatttatgcagttatgactacatactgcatcattacattcatttacatttttcatgactgcaaatggcaccaggtatggttggtgtttgcataagttttgataaattttaactttttatgttagatttatgtatgttttatagtagtaaatgataaaatagactactatctacatatgttttattattcatgacatacctaacttgtgcttaactttttcaatatttctaggctatgtggtttgtctgcaagttttttcaagttgtcataaatctgcaaacatttttccaatatatttattgaaaaaaatccatgtattagtggacctatgtagttgaaactcatgttgttcaagggccaattgtatatgtaaccatctgtgtctatatgaagctatttgagctcacaccgatgtctaattctaatctgttaccatatgaatcattctagcctcttctcattgcttatctgtgaactcccactctggcattaagaaacctagctcccaccacctgccacccatttacttaagtgttcattcccagtatatatgcatagaattgttaacccacactgctgtgggaaaaactttatcaactagagtactgcaatagtttgcttgggctgccataacaaaataccacaaactgggtggcttaaacaatagaaatgtattttctcatagttctggaggctggatgttcaagatcaaggtaccaacaaattccaagggccataacagaagtatctgttccaagtttctctctttggcttgcagaaggctgctttcctgctacctctttgcatggtcacccctctgtgcacatgcacacctggtgtcttttctgtgtgtctgaatgtccacttcttatcaggacaccagtcagattggagtaggaccatcctgctggccttatttgaattaaatgacctctttaaaggccctgtctccaaatacagtgattttctgagttatggagggttagggcttcaacatacaaatttttgcagaacacaaatcagtcctataccaagtattgtgcttacgcttaggtcagcacctttcttccccacccttcaatgaagttgtttcatacatttataatacagataagttattttgtcacattttgcactccatctgggatttctcagcttcctaaataatttttcaaatttgagtgtattaagtttcactctttgtgctataaagttttatgggttttaacaaatgcatagcatcatatatcaccattacattgtcatacaacatagttacattggctgaaaaaccccctgtgctttacctatccaactctctcctcctccctaaacccctgataaccacttacctttttttaccaacactgtgatttttgccttttcagaatgccatttaattggaatcagacagtgtgtaaccttttcagactggcttctttcacctggcaatatgcacttaagattcatctatgtctttttgttgcttgacagctcatttcttcttatttttaaataatattccggccgggcacggtggctcatgcctgtaatcccagcactttgggaggccgaggcgggcagatattccactttatggctgtaccacactttgtttatccattcactattgaaggacatcttacttccagttttggtgattatgagtaaagctactataaacactcacatgcagattctggggtaaacatgttttccaatcagttggataaatacctaggggagcaattgctggattatatggaagactatgcttagcttggtaagaaactgctaaactgtcttgcaaagtggctgaaatcattttgcatttctatcaacagtgagtgaaagttcctgttgttccacatcctctctagtaattagtattgttagttcttggattgtagtcattctaataggtgggtagtggtgtctaattgttgtaatttgcaattcactaatgataaatgatgttacacatcttttcctatcttatttgccatctgtatatctgtatatctgtaaaggtatccttacagatcttttgcccattttttaattgagttgttttcttattgttgagggttttgtttttgtttttgttttcttctaagacagggtctcactctcacaagactgcaatacagtggtgtgaccctagctcgcttaaccttgaactcctgggctcaagctgtcctcctgcctcagtcacccaagtagctggggctacaggtgtgtgccattgcgcctggctaattttttagggtttttttgagacagggtgtcgctctgttgcccaggctggtctctaactcttggcctcaagcaaccgaaagctcttggattataggtgtgagcctccatgcctggccttatttttgagttttatgagttctgtgtatattctgaatacaaatcctttatcagataagtgtttttcaaatattttctcccagtctgtggcttgactttttattaagttaatagtgtcttttaatgaaatcatatcttttgcagtaacacagatagaattggaggccattgtcttaagtgaaacagctcagacacagaacaacaaatatagcatgtcttcacttgtaagagggagataaataaactatgcatgcacatgtgagcagagtgtggaatgatggacagtggagactcagagaggtcaaggggaatgggtgataggaggctgctcgatgggtacaatgttcattgctccagtgatggatgcactgaagaccctgacatcaccacaatgcagtatatcaatgtagcaaaattgcatttctaccccatgcatatctacaaataaaaaagtgtgttttgtggagcataagttctgaattttaataaagtccaactgatcaattgttttacttcatagattgtgtttttgggtgtgttgtatcaaaaacctcatcaccaaacccaaggtcaccaagattgtctcctgtgttttattctagaagttttgtagtttagtgtttgatatttagatctatgatctattttgagttaatttttgtggaaggtgtaaagtctatgtctaggttcttttttttttcaatattgatgtccagttgttcaagcaccatttgttgtcaagactgttcttttttattgcattgcctttgctccattgtcaaaactcagttggctgtatttgagtctattttgaggctttctattctgtttcattgatctttgtgtctattatttccccaataccatgctgtcttgattactatagctttatagtaagtctcaaaattggttaatgtgagtcccccaactttcttcttcttcagtaatgttttgggtcccttatgtcttttgcttttccatacacattttagaataagttgctgatatctgcaaattagcttcctgggatttggatgggtattgtattgaatctatagattttaagttggggacaattgacatcttaacaatattgaagcttctaatccatgaacatgaaataactctttatttatttagatcttccttgatttcttgtgtcagtggtctatagttttcttagttttctacatacagatcctatacatattttgttagatttatacctaagcatgtaatttttttgtgtgctactgaaaacgatatatttttaaaaatttcaagtctcaattgtttattgcaaatacataggacatcagatgacttttgcatattaaccttgtattctgcaaccattctattatgtttattaattacaggagttttttgtcgatgattttggattttctacatagacaattatgtcatatgtgaataaagacaattttgttaattccttcctaatctgcacaccttttattttcttttcttgttttatcacactcactagaactccagtacaatgttgaataggaatggggggagaggaccttcttgtctgttacagatcttagtgggaaagcatccagctactcaccattaagtatgatattaacagtaatttttttgtagatgctccctaccaagttcagaaaattcccctctattcctaatctgctgagaatttttataatgaatgggtattggattttgtaagatgcttcatctgcattaattgatatgatcaaatgatttttcttctctaggctattgatacggcagactacattgattttcaaatgttgaaccagccttgcataccttgaataaatcccacttggttgtggtatataattctttttacacattgttaggcttgctaattttttgagaaatctttgcatctatgatcatgagagatattggtcagttgttatattttcttgtaatatctttgtctggttttagtgttagggtaatgctgacctcatagaatgagttaggaagtattcattttgcttctatattctggaacagattgtggataattggtgtcatttctcccttaagtgtttggtacaattcaccagtgaaactctctgggtcttatactttcttttttgggggagattattaattactgattggatttctttaataagtagaggcctattcagattatctatttctccttgtgtgaatcttgatagtttgtatctttcacagaattggcccatttcatttagttatcaaatttgtgggcataaagttctttacagcattcatttattactgttttcacgttcccgtgatcaacagtgatgacactgcttacatttcttatattggttattagcgtcttctctctttttctgggctagcctggctatagtcttgtcaatattcttagtctttttttttttaaagcggcttttggttttattaatttttctctattgtttttctgttttacatttcattaatttatgctctgatttctattatttgtttgtttctgccttaggtttaaattgctcttcttttctagtttcttggggcagaagcttagtttattgatttttaagtttttcttgttttttaatgtacacattcaatgctataaaattctgtttaaacactgctttcaccgtattccactaattttgataggttgtattttcattttcactaagtttaaagtatttttaaatatttcttgagagttcttctttgacccatgtgctctttaaaagtgtattgttttatctccaaataattagatattttccacctatttttctcctgttgatttctggtttaattccattatgatctgaaagttttttgtcaattttaattcttttacatttgaggcagtttttctggtctggatgtgatctatcttgatgaccattacatgcaagcttgagaagaatgtgaattcttatgttattggatggctattttataaatgtcaatttataaatgttaagttgattgctaatgctgttcaggtcaactatatccttattgattttctgcctgcttgatccaccactgaaatagggggtttgtctgtttctcctttcagtttaatcagttttttggtaacagcttcattgagatataattcacatactatataattcatgcatttagagtatacaaatcaatggtttttagtctattcaagcagttgtgcagtcatcaccacaatcaactttagaaaactttcgtcacaccaaaaaggaactccgttccttttaacaatcatcccctagtccttccatccccttaccctgagccttaggcattcacttacctagtttccttttagatttgcctgttctggacattttgcacaaatgggatcacacaatacatggttatttgttactggcttcttttatttaacattatgctttcaagatccactttgtagcatgtattagaacttcttttatcactgaatgatatttcattgtttggatataccacattttgtttattcactctcagttgatggacacttaggttgtttccacctgctgctgtaaatattagtgtgcaagtttttgagaagactgatgtcttcgtttctcttgggtatatacctaggagtggacttgctgggtcaagtagtgactccatgtttaactgaggaactccctgcgtgttttccaaaaatggctgtaccattttatattcccaccagcaatgtatgaaggctctagtttctccaaatcctcaccaacacttgtcgttatctgtttttcttattatatacccacctggatcatcacatcccacagtggttttgagttctatcatttcttgcctctgtcagttttgacaccctgttgttagttgtatacctgtttaggatatttagatcatcttgaggaaccgacatctttatcattatgtaatgccctctttttgcctgataattttctttgttttgaagtcgtctttgtctgaagctaatataggcactccagctttcttttcattaacattagcatagtaattctttctctatccctttactttgaacctgtctgagcctttatatttaaagtggttttcttttagaaaacagatagtggagtattgtggatttttggtttgttttggtttgcttgcttgttttgcttatttgttttatccactccatctctgtcttttaattgatgtatttagaccattcacatttaaagtgattattgatatagttgggttaatatctactctctttatccctgtttttgtttttttggttttttttttgtttgtttgttttttgtttttgagagacagagtctcaccttgtcacccaggctggagtggtacagtggcacaatcttggctcactgcagcctccaccacccgggttcaggcaattctcatgcctcagccaccccaagtagctgggattacaggcacgtgccaccatgcctggctaatttttgtatttttagtagagacagggtttcaccatgttggccaggctagtctcaaactcctgacctcaagtgatccacccaccttggcctcccaaagtgctggggttacaggtgtgagccaccacacctggcctctttatcactgttttctatttgttatattcattttttgttcccttccccctatcttttttgttgcttttttactaaaaagaaaaatcaccagttgtaggttgcttcttaatttcagatttgttaaaatatgaaaaaagtttgttctagaatctataacatattgtcatagtaccctcctcatagagagattgtgaggcttaaataggacaatgcatcaaagtacttagcccagtatttggtttggcagtgagcactagatattaaccattaatataattactgtattagtgctgcccaaatactttatggacctcacagctgatttagacaccccaattctatcactgcaccaaggctaagaataattaccctaaatacatagttctgactgcttttttgtggtcagttactgcaagtgtgttctctttgcatgtgtattctgtggtctgtagttaaatgcagaactctaaagtcagacatccatgtgtttgaatcccagacggtacttacagatatctgaacttaaagaggtttttaaatctctttcaatctcattttagtcacctgaaaatatttatactaataccttcctcacagaatgtggtcaggacctagcaggggcccaaatcatagatattattattgtcatcagttgtcctcatatctcttcctcttaacaaggtgctccctgtggctcagtctccctttttgagctggaaactctggggagaagtactttggacctgacgaaggcagaggctgcatataagaattaagcgttagcagggagaatgtcttgacctatggggaaagatctctgcaggtagagtttgcagtccctggcttgcagtgggaagggggatgtgctacatgctcacctgcctcatgtaagggctgccacttagccctgggtaggggtagcttttaggcaaaaagagattcctgagggatgaatgtaacaggggtggcatgacatgtgaccccttctcatacccatcatatcataaagcagtgactcctgaacgaggaccagccacttattcgtctcagtcctggctgtggtggggacctcagacagatgattgggctttgtctctacagttttctcttcaagactattcaagatactgctagttattcatcttcctttgtttcattattttcctcttatatttttgttatctgactctgcagtttgggtttaacgggaaggaaacactgcctctctcttcactccccagacacatttttaatgtctgaacatctaccaggctgggcctttggacccgaatgagcagggagaagcatatccacagaagaaccctgcggttcttggctctgcttcacagcagtggtgggtatgtcgagtggcacagaactcgagggttctgtataaacttcgggggtataaacctgtgcagacctcagcctgccatgagaggacatttctgtgcctgtcttagtgtccagcgatcaggggggctttgtggatgatttttctgagttaagattacagtcttcccagagattgggcattgcctgaccaaaagggctagaaataatattgccctcccagagtccaaggcttttttttttttttttttttttttttttgagacagagtcttgctctgtcgcccagcctggagtgcagtggcacaatgtcagctcactgcaagctccacctcccaggttcacgccattctcccgcgtcagcctcctgagtagctgggactacaggcacccgccaccacgcctggctaattttttgtgtttttttagtagagatggagtttcaccatgttagccaggatggtctcgatctcctgacctcgtaatccgcccgcctcagcctcctaaagtgctgagattacaggcatgagccaccgtgcccagccccagagtccaaggcttttaagagaatctaaaaccctttccctcaagaaagcccgttcactgtgccttatgatttagtgagaattctaatatactgatgtgagtttaaaataggtgtgtgtgtggttgaatagagcaattgtctggattacttaagccaagaaaaaggcaagatttagagaaaaatatttgagacctttataatatatgtttagggatctttcttatgattatgtattctaggaggtcccaggaactcttgtgccattgacctgggctggtgaggacataccaggacagtcccatgaaggtgtccaacctctcctgagtggccctccacatgaatcaggctgctatagaattgttccatctgatgttcctgcttgatcacagtgtagcgcaaccgtcagttctaggcactggcagcttctctttggattaaggtggcagggaagtagtatttcacaagtatcaactgtgcaaagaacagaggtgctaagctcagcctgtcaccttggcctcttgccatctggtcttctgcatttccataggacagacattctcagacattgctgtccatcctgccaggtccctgtgaagcagggggagtgattttgctattggcaggagtctaaaaacctaacatttttttgtacaaagagatgcacatctcataaaacccaaattcacagtgaaaaattttcatttagtctatcttgctcagagatttgagccaccaaacacatggctggaaaaataagctgagaggggtgtaaggaacccagaagccccatttctcttcaagctcctcagcattctccagtggggaagcctttatcatctaatctcatgctgtgtatatacaacatggtatctggccattgctgcatgcagcaggccagattttgaaaagatctctatgggcatcagtgcttgcatcaaagctcccaagttctttttgtgtatttgtctaaattataaatcagtgttttagatggaagcaagattcagaggtataattaagccagcttggaaccagacacaggctgctttccccgtttgtaattagcaccccatcacagagggtaccaggtaccccggggaactcggctgagagagagtgaccccaccctttgccttctgttttatctttgtatatgactcttcatctttgattttctttttgatataagacatacaaatttccttacttttagatgcctgtgtcaaccaagggcctaaagttacagaggaaaggacttgctttataatgttacagggcaggaggattggggtgaggtttctccataaggtgaatgatcattttcccagtggcttatgggattttggagtgtgggtacagatgtaatgcttgcttagtctcgaaatgtttcgtttttattagtcttgtctccccaaccaaattgctagctagcccttggagatcagagaccatgacctcaccttctcttggatcctccaaggtacccagcttagggctgtgtccaagggaagccaacttcagagagatgaccacactcctctatgttggagaatgtcacgtgagagttgctttctagaacttcccaggaaacagtgtgcacagatgggcatgagctgccttgacactgcaatatacaggattctaaagtaaacatccctgtgaccagtaataagcaatttggtaactgtgacctggttgctttcatcctagtttcaaataattagatgattaagaaaaatgtgaaaggagattggagaaactgctgaggtcactgttgacactttgaatcaatgaggaaatcagaaggctgggttaccgtgagtatgtgctccccacctctactgtccgcccttaactgaaatcaagtgggtcctttgattgatgggatttggtctgtgtagccttcatttgcttgttagccaagttcatggtttatacatctgtccccaccctcctctgtggctggccagagacgctaattcagtcatcacacatggtgctgttcctgagaaggatgcctgttcggagaaaaaaaagccccttgaaggtctggctagagaaataggaggagtaaaagcatcctatactgaaatgagggaaaggagaaagagtagcactgagagtgtactgcagcggttaggtctgggaggggaaaaaaaaccggagagcaggcatttcacttggagaatctaaagaattgcagggtggtttctcttgctattgtttgaagggaagccagcagtcaagaaaattattggtcaaatttcacagaagaaggaacatgacacagaggattttagttttaatagctcagaatcaaatctgatgtttcaaggaaagtgaagagaacaattgactatcaaaagtactggagaatctgccactgagctcttcccaaaagcaagtgagggcaccagaggggtgggagtttctgtcctttgccataaggaaatagactgacttttttaaaccaacataccagagtttacacattcaaatgagtattgtcctctcctttaactgtccttttgggagacttcattctcagggcaaaaatactgcttttacattgaatacatctacatgcctctctaggtttttatttgactacatagtctcttttgtggctaataatcctgctttgggagtagatctgatttctgaaaatcattttgtatccaaaataatgtaagcctgtaaaggaaaaacctgatttttctgagttggctttgaaatgatggattctgaaattaattctacatgaggtccagaaatcacatgggcagagatttccgggctccccatggtaccttctggggagccagaagttcagccaagctgggtgattactcacctgtgagtcagacactcctgggatgggatcctcccttcacatgtgggtcctaagccagttctttttaccttctgatcctcaattttctcacttaaaagctgggatagtaatagtatctacctcacgggattactgtgaatattaaatgaggtgatacttgggaaaacacataggaagggcttagtaattgcttattattattactgatcccttacattgccataatgtggagccaggtacatagtaggtaatcactgaatctttgtcaactagttgcagggttgttgctaaggatgtcaggttttgacttgaaagtacacctgtatttaaagagtggggtcatctgaggtaactccaagactagaaaaacatttctaatcctcaatcctgtaaaacacttcaaaatggcatttgttcacctctaagatctaccctagctctaatagtccatgaaatcatgatgctgaattacataaaacaaggggattaatgtgaacaataagaaaaaatgttgaccaatagcatggataattgaagaataaatggtcagaaccaggcaactctagaggaaaagcttagaggacagtttcgtggaattatcaactggagagactcctttgaggttgtttaaaatgacgacatcattgtttaacttgagcatgggaaccatcaccaggaggaaacctacctgaaattctacactcagaagagttggcacttgggtagctgtgggacacggtggagaaagaaactacccaaagttggccaaagagcttgtcactgttctacaatgatctcaaattggtaaaggaggttttcacagcttttccaaaggtttgaaaaagaaaatagctactggtggctgtgaaaacactgcattggctgcaaaaatcagtgtgatctggtatcagaagcaaggtgttaaatattatccaaaaaatgcagacacaatatactcttcatggaaagccttggactaacaaaagagaaaaatggagatgagactattatatgataatcactgcctaacaactggcttcaataaggaggctccccatgctgttgtaaccacagaatacagagcatgaagaaatggacttaagttacagccaaagagatggaggatgagacctaaggaaaaagactttcttacccttcttgaagataaagcataagaatgaagatccctagagatggatgggagtcgctgtggaatctggcagtttgggcgttgacctgtccgatagcaaacccagagcaatgaccccagggagtctgggagcctccaagaaagcagagacttcacccaagagtctcattcgaacaacctgactgaatctcagcctgcaacagatggagcaaaagttccatcttaggatgctggagactaaatgggttagaagtagagggggaagtgcacgaactcggctccaggaggaagagagcaaatggcccatggaagttttcctatctctggctccttggaaccatggagtcaacacgataaaattagcagagctaagtaggcagatttgtggggttggaggcataattggtcctgtttttctctagtcttgacctaactgaagttcactgggtatgtaatggaaaaaaaacaaccagcttgatataaaaatacaggaaatgcctgcaatcactgctgattacagtagcagctttccttctgttatttttgtgaaagagaaaaaaaaagggggggttattagggtgtttttttttccctttcctaaactttggaaacaacttgggctattagttctttttagggcattctttactctagctaaatgatgtcacttaatctttataaataaagtgggtggggggagacattcaaattcttatcataaataaaattcctgagtataaaatacatacaaatggttctaaatatggtttattggccctaagggcttgtgttttccgaattcccctaatttctaatctttctaggctgaacaggataaattgagtttttagtgtagtgcctcattttgcagtatggtttgcattagtgctaggagaggaacattgtttccagcaatttatctcccagaaaccatctctgcttagcaagtgaagaaatatttgcaaagagactctttcaactagtgattgagaaacacgcattgttccggcagcagagagacagtacgtagattctcactaaaatggagcttgtgaggaacactccacccagtgtgttagtatcactacttatatcttaattttggcttcaggattctcaactcccgttgctagaatttagatagaactgttgaagtctgtaatgataatgtgtcttttaaaatgtcaccttggaatttgttggattctcctggcttttagttggcgggtaccctgggagtttgtagctgggaggctccttgggcaccttttggagatgctatgctttgtctgttaagccctggggctcctttgttcataagttttcaaaagatgctgtcattctgggacttagaaaactcttctccccaacatgaagctcagataaaaaatagaatttggtttttaagcagtagcattgctaagaggaaacgcactgacctcatgttcagacactcatcaaccatagtctcttcacctccccagtgaaaagtggttcttgatgttcctctagcataatggttctcaaccactagtggttattttacctccagggaagatttggcaatgtctagagacatttttggttgctgaaacttggggatgggggccaggagagtgctgctggcatctagtgggtagaggccaaggatactggtaaacattctgcaatgcacaggacggtcctcacaacaaagatttatccagcctaacatgtcagtagtgcccaggctggaaaacccactctagatgcaaagttctctgctcatgtgactctgaaggtttgggggtagctgtgagctaacaggtctcttgttttggctagtaagatttatacagattttgccatggtgtttaggtagagtacagccatatttgcaggtttttcagaccctggagaaatcagatgtagatgatgtaggcttttttaactcttctgaagataggagaaggcataaggggagagacttccatttgtcatttcacttcctttctctactcaacacgtttttgtaacttctcagattgtattgacctttctttcaaaggatgccacccatgtttcaaaaaccagaggcttgtcttcttttcctgtcaacgttaagtcaagaagtatatttaatctatccatactgtaaaaactagaatagtctgaatagaatcctgccttcttaccgatgtattaatatcagttttccaccactcacagctgttacgtttgttcaccatgaatctgtggcacttgacctacatgatcaggaagatgatttttaaaaacctaactcagtcaaagctgtaaaatttattgtctaagaaagcataggagccttttggactacttggattcattcccaaagtaaaaccctttcttttgagataaattgtgtttcaaccaaaccaaactttttaaaatgtcactttaccatcacagctccatctaaccagagtatcttcacccaccctttcagcaacttttatggggatgtttatgccaataatgctttggcattcttggggttaataagcttaagaatgcacaggcagacaattttcatttccaccttggtgcacccgttgtaaagtaggcgttgtattgtttatggcctcttggggccagactgccttgaatgttttatggcatgagatcagtccccatgatctgaggtgggccccaccctgcacactgagagatgtcccctggttctgttctctctgacaccaaggtgcctggcacagtcattgcctgtctttgacatacaggtacctgcaactccctgcccagtctgtacagcatcacacagtggactctgagatattatagaggggcccatagggaatttacaggacccggcatggtgctgggcttgtaaaagatggctaaaagatattgaccaattggtggatgggaattctgggttgatggtcaggctcaccaaattcaatgcaaagatcataaacgctaggctttcagcacgtgtcagtgagcacatttgaactgacaacagacaggtgtgccagccctaaatgcatacctgcagggcctcgtacacctaaacatgtactaaactgatgctcatgaatgctgtggacaggagtcaagatctgatcatggagaaaagacagcactgttctttcttgccagtcagctcactcagctggatttacagggaacttaaaaggagtaaatcaggccaagggaaatcatttacattcaccagtattcttctctttttttcaccctttttccctccttccctccttttttcccattgagatataataggcctacagtcgagtgcacagttcttagatattaatgaatttttacatgaatacacacctatgtaacccaaacgaagatacagcatattcccagcacgaggcaggcttccttaggctccttccagtcagtgctccccactgcccggagaggtagccaccattctgccaataggttagttttgtatttaggtctctttatttgtgttttttgtttgtttgtttttgtttttgttttgtttttttgagacggagtcttgttctgtcatccagggtggagtgcagtggcgtgatcttggctcactgcaacctctgcctcctggattcaagtgattctcctgctcagcctcctgagaagctgggattacaggtgcatgccactatgcccagctaatttttgtatttttagtagacggggtttcgccatgttggccagctggtctcaaactcctgacctcaagtgatccatccaccttggcctcccagagtgctgggattacaggcatgagtcactgcacccagcccacttataggtctctttaaaactgaccttagtgatgaaatatgtaaatagtcctcactgggcgaggttacatccctctgaccttacccaggtttgggttgatagatgaagttcctcgcttttatgaagaataataattattattgaggggttaaattgggcctgacagtaagtgttttctgtacattctttcatttaaccactgggaagatagctgcaaggtagatagcattgtccccattttacaggtgaagaaactgaggcttcaagttttaacatgaagcaaaaaggtccaatggtcaggaagtgggggcgcagtgttgaaacctggctttttctggcacaacagtctgggtttttttttttttttttttttttagcagtacaccaaccagcactagtcaccattataatcaggagagtcctggtgaagccaaattattttttatgtaaaactgagttatttcctccctggtaaaatctgaggaaagatcctagaaagctttaccagatcaccttggtcattgtggcaatattactgcccaggggccatggtttctgaaatctgtctctgaaatgtatgtttaaactttaagaggaaagttgactgaagttcactagcaaaaaaaaaaaaaaaaaaaatgtgcaaatacaaggaaaggaaaagctttacaaaggaaaacacttgccttttttttttttttttttttttttttttggtctacacacagcttaaaggaaactcagagtaaagagataagcaaagcacatgctttaatatcttaaactattccctgcaattgtggggcagtagctgacaagtagtgaggctgaaatgaggatcatttgggggaagtcaaatgcaagggattacttttaatgaggggatggatgatttgtcgtgtttactcttagaatctttgagatcacatagaacaaaagcaaactttatgggtttctttcttcctttctttctttttgaagacagagtctcgctctgtcgcccaggctggagtgcagtggcatgatctgagctcactgcaatctccgcttcccaggttcaagcaattctcatgccccaacctcccaggtaactggaactacaggcgtgcaccaccatgcccaactaatttttgtattagtagagatagggttttgccatgttgaccaggctggtatcaaactcctgacctccagtgaccgacctgcctcagcctcccaaagtgctgggattataggcatgagccactgtgccctgccaagttttatgttgtatctatgtcttcttcagctctcagaagtttggtggtaaggatttgtaccattccaactgcaaagaaataaagttgcctacaatgaatgaagaagcaaatgtttacaaggcatgcactgattgacaggggtgctaactcaaggcagtgctgagtgccagcagttggcatgtgtcaaacaatttcaccaagccatcctgggttgaaaagtgattttaaaatgtttgctttttaataaagagatatggctgggtatggtggctcacacctgtaatctcagcactttgggaggccaaggtgggcggatcactggaggtcaggagttcaagaccagcctggccaacatggtgaaaccccatctctactaaaaatacaagaattagccaggtgtggtggtgcatgcctgtaatcccagatacttgggaggctgcggcaggagaatcacttgaacccaggaggtgtaggttgcagtgatccaagatcgcaccactgcactccagcctgggcaacagagcgagactgcatctcaaacaaaaaagaaagagagatactagtgttgagtagctgacactattcctatttctaattttaatcgtgttgctgccttccgagatgtaataaggaatatgaatagatggcaatctatagagaattttctcttaatgaatggttcaattttatccactgatactaatataaataagaatcacctcctctgtgaaacctcgtttcatgagtttccttgatactgccctatcactttgtgttcattccccagttagagaccccctccttctgttaaaaatgaccacataatccatggctctgcatttatgttcacacttgtgggcagaggaaagggatcatattctttgtacccaacacttcactcatcgatctacttgtgacaaactacaaactctttgaagactgggctcattcccagtcttctatctctctgatcttctaatatatccagcaaagatccttagtcactgtggggaatgataaggatgatggtgctgtatggttataaaatatcacgtgccccaaaataactaaaaatatttctccactagcaacctccacttaatcgatgaatatggtaagtcttgaaaggaaatttttagacacatttaaatcttagctggaaaaagggatggcctatctcaaagtggcacaaataaagagactttggtatttatttgcaatggtgtcttgccttgttcagccactgattgcccagtactttctccctgtagccatttctcaaattcttctttactgccatgcttagttatatgtctgcatgtaagctttagaaaattggaatctaattgatttacagttacacttctctaaatattagtagagaagtctttgggaagagcatttgggaaaatgaattgatggtcagtactatagttcatccagtctgtagagctcagtaatacaaactgataggaagggaaaataggcgtcatccccggtatgtggttgacaaggaggactgtttgtttgctgatgtactgtgcctctctagaaactcctttgtacccagccaataacagtgactttggggggacattttaggtaacagtgactggatttaaaataaaagtttgaatttgtgggagtcaatttatctgaaaaagagaaatattttctcaagtcggtatattggacaagaggtggctgttacatgcaggccttaagaagaggctgggggaggatggtcggtttcctagatatggttaaccatacatcatcaggagagaaatgaactggtcattgacttcatctagccaaattcaactgactgatggaatttttccacttttcagtgtctttgaataattttcttctcttaaattcatgcatgccaataaatacaggcataaatataccttcacagtatatacagacacttagtaggtacataagtgagaattctgagaaaaatcagtgttctgcctatgacaatgagtcattcttaattcatattagaattaaataagcatgaaaatcaaagtccattgcatacatgattactgccagagcagaatggagtgtgaatcaaaatccagttgtacgtgtcttcgttctgagtgaagtacctgtttaaaatgattaaaagtgatttaagacaagttaatctgctccaacagcatggcagatgtaagcagcaggcttggaccgccaagccagagccctaatactccaacaggtcagttcttgccgagtgggctcaggcagtgttgttttaccagcctggcatccaagctctggcacaggtaatgctgtttccagaagaaaagtacttattggatgtttctttggtaaatactccaaagtgcctgttgtcttagaagcagattccattcaacccacagagatctctctgggtctcttcttaacccctctgttcattcttaaccatcagatatttactaagggcctattacatctcaggcactgtgcagcgtgctggggggatacagtggtaaacaagactcagttcctttgtcccctctttgtagacctcgctgcctattgggggcattcacattttcttgtaatatatactacaccagaggaggtatagtgccttggaccccttaggaggggcactgaacccccacatggactcccatgggggagtccatgaattcttcttacagaaagtgatgggagttggccagagaaggcattggcggatgctgttacagacagaggaaacagttcatgcaaaagcctgaaagtgaacacttaataggcatagcttttatttgatatttactcataattaaatatatatttcccatttgaatatcagattaaaaggcttttcctggtggtaattcttttttagctttcttgtgtctccccataggacctaacacagaaccgggtctatggtaagggattgacaactgtgaatttcctcctcccttcccttgagcagtcccatgggagggtgaatgctaccgtcacagcccttactgggagctgatgagtgagggctacaaagagcatggagccagtagatgctggaggcaggacaagcatgagatgaggaaaggctacagacagcaaagacccacttcagcggtttacagttttcttaagacccaacgttaacagacttgtcctaggtgagctcctttgaaatatgggtgttgttgagcttaaaaatctagagtcagtgagtgctattttaagcctccagacccttggcctaggagttcaggggcaaatgcagaaaaaggaaagcttgagagccagaaagcccacagatttgggccttcctggttagctctaggggaattctagatgcttcagtgtccattctatgtttagcttccaggtttgttcagttcaaaattgttgacccttgcccttaaacaatttatcattgatattttcttcacgtcactaaaatcctggattcttaggatctttttaatacagtgtcccgcacagtgagtgctccaggttttagtaatatgtttgatgtgttcttttattttgaagctggagtagaaacagctgtatagacttgtttatatatataaaagagagagcacgccctaaaccagcatctgatcctaacctctcagcttccagatgttcacagtcatggcaatattcatccagtagctaatttttgccccagccttctcttagggcatagaagcccactgcatttgtaatgctggtcatattgcacttgattacttttcacagtattggtctctgctatcaaccagtgctgtgcacttgtggggaacgtatgatggccagcagggcctctccacactgacttggatcttgagatagttctgagttggtaaatctttgacagtgagtggctgtcactgtgggcagcctgttaccattgaggatcaaggggtagactgtcctggaacttgggagtttggtcagagttctcagtagtatgcatagctctgcctaacttgcatggataaagaatttgctggaaagacatgagacagctcacagatacagtaggcaaactggaaaatcaatgggaaaatggacagggactggggctggaccacagctgtgtttctcagacatggccgtgggaaaacacagtgggtcagctcacagccagtttgccttcatgccactgcctcaaaagtcacaggagtatcaggaaggccaagccttggtgttccatgttcacacactgaggtacgccctttgtggcagacagagtctgctacagtgggcagtaaagataaaatgaaagcaagcaggtacagacaccaggttacaattcctggacaaattattccaatgatatcctctttctattccttacctggttccccctctagtttttgttattgtcatttgccattgtgttgttcccttccagcatcacttgtaatgtcatcagtcaacaaaaaaaaaagagtagatattcgaatctgtttacatgacagtgatttttttagtatgtgagaaaggggtaatgaactcgtggtttaaatggtcaagtttggaaactgctcatgaagagcaattggagctaacatttgttaagcacccactctgtgccaggaactggtataaaccctttccatattacctcatttaggcatcacagtaagcctttgaaatgagtactgttatccccattttatgggttaggaacctgaacctaagtgagactaagacattgtattcacatagtgttaatactaaatcagagtaatcttcagacttaggcctgggagacgtcacgttctcctgctcaatctcaggcatctctgtcttgctattccttaagtagcatcataggagctccctgttttggtaaacgttccctaatctttatgtcttcgatcttttaatcagttttccagtggccccaaagatagatctgtggttgaccattaaaaataaggttgataagccaatgaagtgtcatcactgagaagtcagggctggataaccacacacctaaagaccttctgcactggaaatgttggtgatcctggggagagaccaccagagagtgaccaggcagtcagtatttctggtcctgctcgtgggcacttgactctggagcaggtgctttgaacttgaggaaaatatggatgccatagcagatgtgggtccttcttggaggagctcagggcttctcaggacctcctccaccacctagcctagacactgggtggttaagagtttgcctctgagtttcaaatcttagtttcccactcctatactagctgtgggcccctgagcaagacgtgcaccctctctaggtctcagatttgtcatctttaaaatgggagtgatgatagtacccatttcagagtttgggggagaattcgaggagctcctccacatgaggcgcactagtaaaggctcatcagcaccgtcagtgagcacagggtcttcatggttttctccttgtttcacatgtggatggcagaagccaagtctcagaatgatacctcccatccaaggaaggtgggggcccatggcaggtgctcagtacgtagctgttgatgagtggaaaagaaacaagggcatggaccagagttaatctcagcatgtacgttcacagcacttttactcctcaacgttattttattttttttatatgtgttgattgtcgctttccacactaggatataaatgccaagaggacagggaacgtgtttccatagtgccaagaacagcgcatgtcacgtggtagtcactccatgaatatttgaatacatgagtgtatgggtttttttctatgaaaaggagcaagctgatgaggagcctgtgggcagcctctgccctggaacctcctgagccctgggctgactgtctcattcttccatcgggcactccaggcagcctcgtgttcatgctggctgaaggctgcccacaggaagctgcctgtgcctgttccttgccccagcaaactacagggcccagggcagagccttgcagattggaagctgctgagttatgttgtaagactcgctgggaaatgctgccattccgatttattattttaattgttttatagtttatacttatgccctgcagtgattttccattaaatcagaacacttatgttttcaaaaaagagcaggtatggttgtgggtgtatatcttaacagctaatctctggcaataaaagctgtttgacagtcatcaacagattaggaaattagtatttgtttaattaacctcccttagggactattagcacatgaaaatagcgagttttttttaacctgataagatgacagattttgttcttgtgtattcttaaggtttcaggtataattgtttttgtggttgttttcatttttattagcataaaccattgggttggtaaaaataattacaaaattggaaagagacaaataacacaaagtataatctaataagttacaattaaacttttattaattttatgtcatatttacactatatgtatatattataccacataaaatataaatatgcatacatgaatatactattacatatattaatcatactgtatactttatcatacatactttgttatacattatatatactttgttatatataagtatatagtatgattaatataacatgacatagatatatagaaacgttgagagttacatgttgtctgcgtacagtctcacaacacatgttaattatctttttagttttcactgaagtttcaatttttgtcatagcacttgctaaaataaatttttaagtcatgatttctttatttcagaatagactgcttaaaggatttatttgtcatagatctgaaccaccaacaaattccacattcctttcttcagtttgttcaaagcacttgctttctggctgagaaatattccttccgcagacctcattgctctgtttccacttggtctggctcatttgctggccagctaacctacccacacgtagcttcattagaaaacacattaagatatgtcctgtacacaggtagaaagtgctgcttgttttggacccttagagtagcttgagaagagtaaaactgcaaatgccaaatgtgggtctgctgtacttcgtgtgcgcacccttgtgccatcaggatacttccatgacctgaatcataattgagagacttttgcttaaaaactgggggtcactttttcccaaagcagagataggttatcctttttgagcacctgtcttccttgaatgtaacttactaatatttcatccacatctatggccaaacaacctgctctagtgtgaggataaatccggctggtgaccaccagcaaagtcagggattgaacagcactctgaattttagctgaatggcctcaggaaaatccaaatcttgctccaagtagagtctttgggttaaagaaggtaaaaggaagcagttggctggggatggagtcagaggcaggggtgaggctgtggccttcaggagggccctggagagggaactctagactcttcctgccaggatttgagaagtggtcttgaagctgtgccccatgccttatcacctctgctgactctcctggatcttctgatacatctctgcaagttccctgggggaagttacatttcaagccataagggtccaccttagctcaatgacactgagcagatttgcaagtagttcagaagggatcacagtttagggaagggtgatttttaaaaaggaggaagtaaagaaatgtccagagtatgggcaccccttctgatgggcctggtggagtggggaggaaagagagggcccaggaacactgagctgatttgggctgggtcaccattgccccaactaacctgctcctcagggacagcctaggattggcaaaggagaagctgctggatccttcttggttggaagactggaaggcatgtggagaacatggaactctggtgggttttctctgaatagggttcttcccacatgcagactctactgccttgaaaaagggcatgtctcccagtgtcactccaagagttattgcttgctttctttttttccccaagtggaattctggaactctccttctttcccattggcaggtttgaggtttacagttactttctttactaaagctattcactgggcagaccctgatacacaatgcctctattagtctggaaagtcttttctcaaaagatacaaccaattattatttttattattattatttattatttctaaatcagagtctcaaagcataaaaagaaaaaataaacaaatataagtaagggcacgtgactttatctgcctgggcctcagctggataaaaagacctctgaaccacccaagttcagagcccttcactgactgaccacgctctttgtttgagattctctttttgggtttcccaaacaccaaagtcctcggtggttgctctgtctcaagtcccaaccatcaagcgttgtgcttgcttacagatcatttccagccttcttctcttgtcacactgtatgtgatccttttctcaaaaaatctcacccacattcattcttttcctccagcccaaaccttcacatatcacacctagtcagcatgtccagtgaggtgcttccaagggaccaataatgttcagcatgcacgagctgaactgctgctatcctcctgcctccctccaaagcctgggccttcctggtatgtcataagtgctcagtagatgtccatcacatggagaaatggaggctgtctttatctctaatcacctttgattttgtaaactctaccagattatgtcctccctgatgaagaggaggactcttcttaaccggcctcattcgcctgagcctgtgcagcctcgttgtccatcaaaccacaggtctaggcccataacagggcataagcacagccctgtaccccttcttattggcatatatgcatatatgcacacgtgcgcgcacaaacacatttcttagccgttggaaagcaccgcatggtcttaaagcaaataccttccatggccaaattaaacaaatacaaatgtaagacttcttttttaagaataataaaatctgttttctgtcccttcagaggtcagtccattttcagcctcctaaccttgaatgaggcctctgatatcctccaagtaacttgggtgacccccactttgcaggaagacgtgccttccctacatccccgtcaaattgtgtggagttacatttgtgtttcctcagctctttatctgggctggggtgacctaaaaggggctaaccaatctcctagcacgtggctccttatgtggctggacatggaagacatacgcctactagttttggcagcttctggtcctgacaaaggagcttgaagtgcggttttctggccttcctgtccgggaattctggacccggtattgggttctacggtccacttccgccaggctccaagaacgcccccagaaaggttactcttggtcctttagctggagtggccctttctgtgatgacagagtgctggctggacttggagctacaaatcactgggcccaaaagaggtgaaaccagcaatccttgccttctaaggcagtgatgatgtcctgtttctccctctggttttagaacttgccatcctagtactctggcctcatgtccatctctccttctagaccctagacctctccttgaaaacagggattgtgtctttcttccctctccctatcctgaaacagactctaagtagaaactcaataactattatagaattattacatagtaggggcaagtagtcaatgaatatatcagtgattgtaatcatgctgccaatttgatggacgctaaaatggacttcatagagaccctgcccatcatttcgttctgacattcagtgaacattgaatactgggtactttgcagggccctgaggaccaatcatcatttcgttctgacattcagtgaacattgaatactgggtactttgcagggccctgaggaccaatctgtgaacacgaaggcaccatgtctgttctcctggagttcatgtgaggaaaccaataatgctcaaggcaataagcaaaataatgacaagttgtcattgttgtagaggagctgaccaaagtgctgtgactgacattaaaggaagggttgggggtggtagtgaggggctgcttcaggtaaagtggccaagagaggcatctttgggataaaggcagagacctcacaacaagagggtgttgcttggttctcttcctgagtataatagggagaatgggttggagagtgcaagagaatgttggattcagctgcctctgatggttttggccttagttttaataattttcaataaaaatgttttactcattccatacattatctggaaatgtgtgttcacatcatctggctgcttggggccacgatctgtgaattcacttttctgctcttattccttcatccatttgaccagtaggtattgagacactgggatgcatcagacactgtgggaacttggagaccctgccctcatggaatggtcccttgtggaggatagacactcatagtggaacaggagacagggaccatctgaaggttcctctggccttctagccttttccatcatcatacactctcctgatccaaactggatggatgaggctagaaggccatgggggaccacaaagggcctctcacaccatgctaacaaccctgcttctggggtgccattgaagaatgcaagcagcaggggagcatcatctgatttacatttcgtgtaaaaatgcctgctggcaaaggtttgctccaaagtggaaagggaaaacatttggtgtgcaacagccaggactgcaagttcaagcaagttctttcacgggctccagctgccttcgcttcctggatcttagactggaaaggcccttggggattaactcatccagccgtcttatctcatatttgaggacagtaatgctcagaaaagtgacttgcttgtggtcactctgtcctgggctttgcccaaacagctgttttgatgaccaagttgattggcctggagagagataggggaactaggtgtaagtgtcacgacggatcgtcaggctagctcacccacatgctggaaacacaaggcaatgcctgcttcccctcagcagggatcaggattttatccatgaatattaaggataagaatgtactttcattattgtgggttaaaaaaagtaattggatgatcatgcaatcagataagcaattctgtagtgattccaaggcttaatgcccaggtacagccacaggctgtttattattattttttctattggcgggatcaaccaggtaccaggctatttattttggcttcaaaccgagatgttgtttgacacctcaggcttccagctgtcagtgtagtgtctaaaagtcttctctctccagttgagaggacatctatttgatcaaaatagcattgtctggcttatctgttacatcttataagcatgtttccatgagttagaaacaaccaccaccccaacaactacaactgtgttctctatcccatgaaagggcgggcgtgtggacacgatgtatatttttttctcctcaaacaacacagtgaagtgattcagagcatggaagtggggtcaggcagggtggactctgttgctcactcaccacctgtgtgtcctgggccagtcaagtaacccctcaaactctttttcctcatctagcaggtagggataataacagtcttaccagattcacagagcacttgtgggattaaatgaagtaagagatagaaaagatttaacactgagcttgggatacaaaagcatttggaagaagaaaagtagttaattgtgttgctcctaaatgattgaattttcctatgcaaagacttggagagattttccctggagattggcccagaatgaaatattatctttgactctcggttatcagcactgcaatggagaacttgaaaaaaatttaccttgggttcagaaacaaattatgctttttttttttttttttttttttttttaatgtaggggaagtagacacactttgcttgtctttgtgtttggcctctggtggtctttgagggacttgcttcctgagagtgatgggaggtgcctatgtagagaatgtcaggaagagggtgcctgccagtcatcaacatttgccacaatgttgatctggaaaaaacgtctttctctcaagtgtattgttaaatttatgaaggtgctggtaccatctgccagaagaaccaatattcccatctgattgaccacagtcattctcaagtctccactatttgtcccaaaacaagcaggatttcttcataatctccctcgagggcctgctctaggacatgaagtaatttttctaatctcttatcttcaagtaactggaggaatttgctgttatttctgcagcactcaggcctgagctttgtggaatttgcatgccagggaagtgagggcattggaaaacgagcgaagaataaaggagcattacagggctcttctgtggtgaattttcaagtcaagcataaaagaattgtttcctattctttctgatatgttaagggcctcacgcgtgctaacgctttgctagatgctgtatggtttacagaaggagagttttctggctgttattcttagggaatctaccatcaatatagaaaaatacaattttccaaatgggaaatgataaattcagatgagatagctgaggtgcagggtaaagaaaacaggattccaccaaacatctacagttcaggtcccagtcacctccctagccttgtttactcacccccaccccacctcaagttctttatctgcaaacctatgatgatacccgctgcccagggctgttgtgggaaggaaaggaatactgtctgtgatagcacacagtggcagccagtcctgagaagttgaagggtctggaagctgtcgcatgaatcctgttgatcaacatctgcacagcctcacccctacctgtgagccccactgtctttgctttcttccctgggaactttgtgtttccgtgcacagtgtcactccccagtcccggggaaaggaatcttgactttctcaccgggctatgctaaaagtctcagtcagtctcatctctgttccacatcatttgtccctttcccctaagttacagttgcatatacttcatatgtttcatcccacagcatctatctcagtgctttatacacataaaagaccttaagtatttttcaaaaataaaaggagttttagggatttagtgacttgcactggcagggaatgtgtattttaagaaatgagtgttagagacccctggaggaggcagaatttctgggatatcatggatcaggcactgtgctagcactttcgcagaggttacatcattccatcctggcaatcctatccccagttaacagataagaaaactgagtcttaaagatatgttggaccagcccaaccttatccagctggtaagtggcagagttgggatatagattcagaactgcctcacttcttgtctgacatcgggaagagaaaatatggggacccacccaacatctcagatcacatgtaggcacaaacaacttcttatacataaattactatacacagaattagatacatgcatagccaaacctgggaggcaattcttagaagccaaaatatgtgtttcaaattattctagacacattgctagagacatgaacagtcagtttgtttgctgggcatggtggctcatgcctgtaatcctagcacttcgggaggccaaggcgggtggatcatttgaggtcaggagttcgagaccagcctgaccaacatggtgaaaccctgtctctactaaaattacaaaaaaaaaaaaaaaaagatctggacagtagtggtgcatgcctgtaatcccagcaactcaggaggctgaggcaggagaatcgcttgatcctgggaggcagagggtgcaccgagatagtgccactgcactctagtctggacaacagagtgagaccctgtctcaaaaaaaaaaaaaaagtcagtttcttgtcaagttagaagtagaatttgacctaccactggtctcatcccatctccagcataccagcatatatcttgatacgacatcttctttgcataccagttctccctcagtcttagaccatttcttccccaccttgcagcaaaatcacattagggatctgtttgtactcactgatgcttttccattttcctaccctaataaattagttagtatagttagtcttagaagtcaaactttttgtttttcccctgagactattactgctaggacttatttctttcctgctcagataggttttatagaatattttaaaagtacattgtttagggaatttcctttcttgtcatgttgtgattttctggaagagatcttcactcctaccgcaggagagccttcattgtgccatcctgccttgaagtgggtctgccctggtagagtctgtgatcccttgtgctccatgttctcctcaccacaaagatttcttttcccagcccagaggaattttagtccaagcatcaaatagagatttccaactcatacgtctgtcattttatctaataggtggtcacgggcagttatgtagggtcagcccacgctgcctcttaccagccatgtgacctcagacaagttaccttttctgagcctcagtttcctcatacatttaaacatgtgggttgaggatgccaattagcagggttggtagagtcaggattcccatctcctaggaataaaatggcagaggatgtaccaggcgaatgcaccctttccttatagccaggatgtgctttccaaatctctgtctggcttagtgatccgggccaggccgtgttagagccctgatcactgcttaagactcagattagagcagtggtcgtcaaccagagggcctgcaagggacacttagcaatgtctggagacacagttggttgtcacagctggagagggggcatactaatagcacctaatgcatctaatgcataacatctcatagcatctaatgcgtagagaccagggtgctagtaaacatcctgtagtacacagcacagccccccacaacacaggattatccagtcccaaatgtcaatctcgtcccagcatgccaaggttaagacacactggactcaagggaagctgaagagcctggttcttatcaccttcctatagcccacatcccagttggctcttggcactgggggaggaagtggggttccatggaagttctcgtaagtcttcagtcgagtggagagtaaagtagccatctatccaggtgtcaggcaacaagggctatcgcaaaggcattcaggctgagggggaaatgctaggagtggccctcctaaaatcagggaccaccaaagatgctatcaccattattacttagcattgttcttgaggttgcagtcaacacaatcagacacaagaaatgaattagaagtataaatactaaaaaggaagaggtaaattaatcattaatagcagacaatttgaaaaatccaggagaatcaactggaaaactgttacaaaaatagagggttcggtataatggcagggcacagaatgataaacataaatcaatacctagcctatacatgtgtgagcagatagaagatataacggaagaaagcccccatttaccagaagaatttaaaatataaaataatagcctggattattttgaagtggattccattgcaattaacacataaacccaaaacaactgtgctctaaataagatacaagtttctttctttttcatatgaaagttatctgaaggctgatggtccagttaccattcctaggacttagtccttgtctttatggttgtaggtggctgctactactttaggcattatgtcctcattcatgcaatatacagaatatatagaggaacatatatatatatatgcgtatatatatgtgtgtgtatatatatacatatatacatatacatatatatctagagagagagagagagaatatatagaaggaggaaagaaaaagaagagtaaggctcttccttttaaggagacttccacatatctgattgcctagaacctagtcacataactacaccctgctccaagggcagcttttaattctagttcatggctgcgtagctatgtgcctggcttaaaaaatagaaagtaaatgttctcttacaaaggaagaaagtgagaatagatattgggacaaccagaaatctgccataaaatgtcataagaaatttataagatctatatgagagaattttaaaatgctcctaagggacacagatgacatgaaaatggaaagacacaaagtattattggataagaagggaagactcaacatcataaaaatatcaactctccctaagttaatttataactttaaacatattcacaataaagacatcaccaggattgttttttaactagacaaatgattctaaagttcatatggaaaaataaacaggaatggccaggaaattttgaaaaataataatatgtagactggtactaccaagtgttaaaaggcattataaacctgcaataattaaaagagtgtggtatagagtgacgttatagaataaaagatacaggaaaaatccaagtgcacatgaggatttagtactagtatttgataaaggtggtatttcaatcagtgaggaaaagatgacctattcaacgtaagggattgggacaacttactaagtttctgaaaacaagtgaagttggatatggatcacacatcttttatcagaacaagtcccagatatatcagagacttacatttaccaaatgaaaacataaaagtactgggagaaaccctgggagaatacttttataactttgaaatgggtaaagcctttcaaattaagacataaaatccaaacccatgatataaaacatcagttcaattacataaaaataaataatattggcatgacaaaaccaccataagcaatgccaaaagtcaaacaaaaaactgggataagtatttgcaattcttatcttcctgtatgccctttcatgcatgaagtttgtttcctaatatagaatgagctcctaaaaatcgataaaaaacaaacaccacaaaagaaaaatgggcaacaattcatggaaaaaaatacagatctcttttgaatacatgaaaacatgctcgaacttacagagaaacttaataatataatgagatactgttttcacctatcaaactaccaaatcttgataatataccatgttgggaaagatatcggaagcaggcactgtcatatattgctgatggacgtataaattgttcttccaccaagaagggctgtttggcaacatccatcaaaattcacattcttgtagtacctgattcagaaatttcttttctaggaaatgtgtatagttaccttcacatatgtgcaaaatgtcctatgcagatggttatccacagcagcactgtttgtaatagcatatactagaagcaccctaaatgtcccccaataaatacagtggattattatatagccacaataaagaatcagaaggctctttaagtgccaagacagaaagagcttcaatatattttaagtgaaaaagataaagtctaaaaaaatgtgtatggtaagctcccatttagttaaatgaggggaaatgaacatataatcatattttcttatttatatgtaaagtatgatcaagagaatacacagggcatgaataaaaagaaatcgcctgtagagagagaaaagggtgactagggaatggatgcaggagggagaatttttactgcatgccctttcatactttttggttttttgaacacatgaaagtattacctattgaagaaaaattgaatgaaactttaaatagataaatgagtataggctagtcacattggctcacatattgggaaagaaattttgctggattttcccccctctattaaaaaaagacccccctccttaaaatatgtcccattcctcaaaagtaccctggccttgtatttgaggaccaagtacacagggactaatatctgggcagttgtccctctttgcaaagccgtcagtctccagcaagtttgatgagcacttgctacacgcctggccatgtcctgaacactgaacaccatgggaactctcaggagaatagacagcctgcccggttctgccctgccagcaggaccccaaagtaggcaaggctgggaaaccattattcccagtcctcctgcccagtaaggtctacaggtccctagcaaagaggcagcactgaaaacatacaggcaggagactcctggggcaggaatgaggagtggaaattcagaggtcctggggtagcagtgctggtaagaaaaccatgaaggaatctcttagggaaggactagctctttctcttcctaccaccttccacctccactgcatcctgcccctacacccacccctgagccatcatggccctgggcttccctgagctatcccatccactgaaaccctactcgtgaactgcttgccactgagagcccagtgccaggcaagtttagtcccagaggtgtgagctcttttgtttataatggaaccgaagacccccagagaaatagaaagtcctaacaatcgcccttctggctcccggaagtctttggacccactcttaactttttctgtcattaaggaaaggaacttaagtccctaactcttcctggacttggttttatatggacagttagagttttcaggaaatacagagggggaattggaggaagtgaccaggggcgggcttcaggcctcagtggcaagacagcaggaagaagcattttggtcagggcctcccccagtcatagccaagggcagctgctgcatgctgcctgcagaccatgcttggctgtggcagccaccctggaccacctttcccctggggagaagaaagggtagaaagcaaagggagggtgagcatctggggccagtgcaggggcaggcaaagaagagcaggagctggggagcagtgaggacttcctccttctttgccccacctgaggcaatcctgggcagaagaaaaggcggagccttgcagcctgagtcagaaaaggggcaaggttcaagctggcttggaatcttctgaatccattcaatttatacaaaattagaagaagtccttcctcagacataacaaaggctttaaaaagagtgcttaggaggtggcatttggggtattttataaagttgggcttggtggctggcattggaggaagtcaaccaatgtgaaggcaggagggcagaggagcgcagcacacagggataagcacactggcttgcagagcagatccaccaagccttcaccacctgtaatcacctaccttcttccagcttcctttgacgtatttctgtaagggtagttgccacatgtgctcctcctaactcacagagctatgcaatggaactgtttaatggaattcacagtgctgagcgtggatcatgaactgggaggtgcttcccacacataaagaagcatcattgttgttccttttccaattagtatcaccattgtgctgatcgtgtgtgtcatgggggttggcagcactggatactacaaaatagggatagaggggcatgtgactcagtggggccccagctgtcagcttctcaaggactcagacatttgcaagtgggcagatagttcacccagttcccttgaacttggttccttcatgaagaaagtgagtgtgacaatgttaaagaccttctactttcacgcacatctcattagtccttcaaataagcctacaagcaggagcgtgtcattctgattcaccagataaggtcacagaccagcaaggtgactttaccaggacaaggctacaaccagtgctacaaactcaggccctgggtcctggcccagtgtttgtctcactgctccatcacccacagccagagctgggccttgaccacacacagtggccagggtgggggtgggagaaccctggtcccaggggctcagcttggttgggctcactgttctttctgtagttcatgagcatttgcttacagcagcatattttatatgctcttttttctcaagaagtcccagctgtaagtggaaacggggtcgtgggtacaatgcaggctggtcctaaagtgcttcctgccccacctttgcactcaggcctggatccctggcgatggccggagttcacatcttgacgccagcagacccctcctgctttctgtgtgcagacaaatgggccttctttgcaagacccttcaccctgcatcccagcatggctgttgcggggagcccaaggtggataccaccacccagtctgggttcttctaccgtgtcagggctgtgggttccaggcatggtggcaaggaatttttacccagaaccccaaagtgtaaaacaggccccaagggagctgcactgtttgagactggcatgcccctatggctcttgcttgctgcacagaaccacgtgggctctgtgggtccaggtgattataagcaatgtgccttccttgctgcctccagacctttcccccacccagcctgcttgcccctaggaaagtgatcttacaaatgcattgtgctcatgcaggcaggatgcttattgctgttagcatgcatttcaaattctttttcctagcattccaggctctttgagcaaaacattcctgtcttgcttcaccattcactagggcccaattctctggcctcctcactaccttttgcatcagctatattggccttctcctctctcccatcttctctcctcacagtgtatcgaacccttatcttctaaccatgtttctcttgaggggcgctgtttcctggaagccctcactgcctgcactagctgtttgtggtctcccgctctgacgcacattagctctcatagtgttctataaagtagtgcctgactcttaggtggttttaaccgtttcgttgatgtccctatgtgtcatgctgggaaccccagctgatccccatggttagttcatgagggacaggggtagatgcttctttctttcatagcaggatctcattaatatgaatgtgggtgcatagcagggcttctatatatacctactgacttagctctattaaaccacagcagtcttgatatattcctggggttacagaagttcctccctcttgctgaagaaagtggaggtgccgttaggggctgactaacatgagagagagcccctggactgagatgggtttcaagaaacacaagcttctttcaggacttttttgctggagatttccctaagataggcacatacctccaactcaggaagactatattggggtgagtgacgtattgacattatggtcctggcctatcttgcagggatttgaaactggacaacatccttctggatgcagaaggtcactgcaagctggctgacttcgggatgtgcaaggaagggattctgaatggtgtgacgaccaccacgttctgtgggactcctgactacatagctcctgaggtaagacctgtgtgcaaaggttcacctcctcctggtgccaggaccgaggcaggggtccaaacccatgcactggggtcatctagtggtgctgggggaaggctctggaaatccaggatggattctaggaaggagggagaaaaggaaaggaaaaaagtttgctgattgatgtctgtcaagaagtcctagtgttggggagatgatgagtgaaatgagagtaacaggctatttcccaaacccgggcaagttcacactgaacatctctttcccatcctagtccagaaccaccaataaatctaggaccaagaaaaacgtgttgacttttattattgttttcatgtctttaaaatcagaacagggtgggcacagtgactcacatctgtaatcccagcactttgggaggccaaggcaggtagatcgcttgagcccaggagttcaagaccagccggggcaacatggtgaaaccctgtctatataaaaaatacaaaaattagccaggcatagtggtgcaaacctgtagtcccagctacttgggaggctgaggtgaaaggatcaattgagcccagaaggttgaggctatagtgagccataattgcaccattgcactccagcctgggtgacagagcaagaccctgtctcaataaaaaaaaaagtaaaaaataaaatcagaataaaggagcatcattgatcatgggagcacttcactttatcagctacaatttgctaacagtaaaactaggaactgtttgctatttcctgcatagtggcagttctatgctgtgagtacacaggatggagcaggaagaggagagtgactgtgcctcattatatacagatatcagagatgttcactgtgaaccactccaataggttgcctttcctgaaagttgtttgggatgttttgctcagcatgaagtgtttgtttgccttattcctgcccaaactgagagataactagtgtgatgtgattcagatttaagacatggcctgtcatagacaatcaaaatgatcttcatggttctgagacatgtaagataggaaagaagtaccaatccccactaaacatcgcccatggcggataggtattagcacattcagagctcatttctttcagtgggcattgtttgagcacgtgctaggcacaaagcaatgtggagataaagaactgactgagacacttgtccctattctaaagaagcttttggtctaaagggagtgatagataagtaaacaactaattaagcagaataaataggcacataaaagaagatggtatcctcagggatcaggaaaggcttcttggagcacctggtggatgaattgagttgtaaagaatgaggatttcctttgacggaaggggtggggagggtattcctgaaaacaacaggattggaacgggggcaggacaggaaaggaggttcagtgtccctgggccctggatcctttgagggcagggtctgtgtttctaatctgggtactgccaggatccggcacacaaatcaggatcttagaaaggtttgttaaaaaatgacaacttatgacattccaacatgagcaaaggccaagggacaaaaacatcttggtcttttccaggacagttaaaaagtgtagctagatcatagggtttcctggtgctcatagtaatgaatgagattgggataaagacccagtgaatgtggctttgatcctgtaggatctgtggacccactcagggtttcagtggaggagagtcctagtcagatccatcccaggaagaaggaaggccacagctgtgcagatcagaaggcagggagtgagggactgatggtcaggaggcttcacagaccacacaagacaggggaggcctgaggaacatctcgaagtgaaggtgatgagtaataggtagtttccctttagaacctttatcttctaagagatctaaagagtagggatttcagtctttctgcaaatgtatttccttagcaagaacactaggaattcagccttcaaggagcaacaaatgaaagcaagagctttcgacagggaactgcttttctcgtgttcttcgttcattcttcattgtcagaatacttagttccagttcctctctaagttgatgccatcattcattcttcattgtcagaatactcagttccagttcctctgtaagttgatgccagagcctaacagttgacagcccatgttatagttaaggacccaacccaagacagaacattcactttataatgaacaaaatagccactcagctttcatgaaaagcagtccattggtgagactcacaatgaacaactctgatctctgttcacaatgaagcacagacactcttccttcctgctctggccttcgtgcccaccgtgcagaaacatctctgcactggcaatgacaatccctggtcttgctgtaggcaaattacagctgataaaggtattgctgccttcatcgagggctactgggaagattaaatgagattatgcctctaaagcattagcccagtgcccagcccacagggagtgctggctaaatggtggcttcatggttatcatcattgttgggttgtgtgatgggataggaaacgcaatcctgagaattgagtcttgagtccagatttgaccacaaatgtacacatgagcatttgatgacttgatgaagtcacaaaatgtttttgagtctcaggtttctcatctttcacatgggagccataactccttccctacctacctcatcaagctgctttgagaatctaatgagattagagcatggaaatgcttgagaaagcagaagcctccattcaaatgggagaggtggtaaggtgctgagctaacctcaaaaccagagacagctttggaggcatgaggtctgccccaaggcttatcttcctgccacatgatatgccccatggcaccccctctgctttcccactcccagcccctgcttcccaggaagtggccaccagcctttggtaatagcatcatcagggccaatgccttctcccttctcccttctcccgagctctgacgcacttgaggggttggctccaggtgacttcccgtgacatggaagccttgcccttctgcccagatccactgccgacagttaattaggaagcagataattagagccaagcctaaaaggaatcttacaaaagatgccacccaaaatgagaaggctgtggaaggggcctggagtggggtggcagggcggctctgtggtttccacagcaccatccagtctcagcacacacaagccaccttctccccaccccctgaaggcacagaacccagctgcctccttccgagaagctggagggcagccactgtagcacccagtgtgccctgaggctagaagagaagggagcatgcccagtagatacacacagtggccatgcatgctagccagtcacaagatgttgactgtctcctggatgatagaacaggctggccacagcactgggctcagtagcatgttacagctcctaccctctggtaccttatagttgcactggggagaccgctggccatgaaaaaataactaacgacgtagtggtatgtggaaagtgagaaagtgcctgcaactcgtaggaacaggcaggggtcttaagttgggcgctgtgtcttttgaggttgagggaggagttggcattggctttggagcatagcagaatcactggctcctcaggacagtggagcccatagctttgaccttacagctcaaggaacactaaccactgggcttagaccaaaggtattagctaaacagattaccagccccaagtaatgtagagttggctgcattttctcaaattccttttcattccaaattcagaagattctaaactgtgagtgttttaactgtttctaaatgcttcttctatccaaatctttctagttcatcctaagcaatttgtaacctctagaagggtattttgagcagaccacagaaagtccagatacttgaattcagcctcctcttccctggccaccatgaaatctgagaactaaattggagccttgtccccagcctgagatattatctgcccaaggtgtcccatgggctggaatgactaggcatgaactttgcctttttttttcagggtcctcaaagtgttcccccttgcaggatatgcactccaaccttgtttctccttccctttttaaaattctttatagaattatggacctggataggtcatctcatccaccctcctgtttctgggcagagccatgcctaatcccactctaataagaagagaaaataattgtggaatgggaatgtcacctcatgatctcttccttgtagagtggacagctcagcatttatttttcctctgagccaaacacatcattgatctgctacatatttattttatttatatatgttatattttaaaggcatactgtaaaatacaaagctctatacagctgaaaggtgatattaaattctagtcttttctattggatgtcatctccatatatatatatatgtatttttatatatatgtatttatatatatatgtcattgacatgctacatatttatatgtgcgtgtgtgtgtatcatgtatttatgacatatgtgtatggagagcagatcaaatagaatagccaatcagaaaagatccttttttttttttttgagatagggtctcactctgttacccaggttgaagtgcagtcgcatgattatgactcactacagcctcaaactcccgggctcaagtgatttttccacctcagccttctgagaaggtgagactacagacacgtaccaccatgcccagctaattttttttaagagacagggtcttaccatgttgcccaggctggtctcgaagtcctggactcaagtgatcctcccacctcagcctcccaaagtgctaggattacaggtgtgagccattgcgcccagccagaaaagatgtcttgtattcagtagcatcatgtcatacatgcatttaatctaagtgaatttgactctacatatttggctagaggaaaaagagagacagcatagataagacaagtgaccattgtcaaagacaaaatgcaccagacaatcaaggagatggttcgattctggctattgcaatagggggttcattagtgaaggtggccccaaaggaagggggcctacggttttgtagaggcaggcaaagtgggggattcttcagtggatcttatgggaatcatgatgaacaatagagatgggttttttcttagaatatgcaagagtatagtggtcctttatagggagaccattacagggtgggggagacttattcattgcagtttcctctccaggagcacagggctcaggtaaattgagtgttgcaccatttaaagaagacctctgctcacctttccactcaggcagtgagctgtgccctggactgtgtgagatgggagacctgacctcgctgcactctgagtcacttacagcttgttctctcagtatgcatcgtgctcccctgaccctgattttagtgtcaaaatatgcagttttttaaaatgtggccctcatgccagtcaggaactttatctggtgctcaaagaaataggaatttgttcccactggaagacagactgtcgatgttgactttggaaagatgatagctggcccccagcatagtgcctccaaactcaactgtcactgaatttgctgatttagaacttctaggactaggactcaactgtagggaggagcaagttggaattgaagtccttcccatgggcgttcgtagcacgggtgtcactggggtgggagcctttgatggtgcctgacattgctggtttcctgaacagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctgtgagtcactgcccctcacccatggctgtgctctcctgggctcctccccctacacacacacacacacacacacacacacacacacacacacacactcccttctccctttctctgtccagctttctccctcccacctctgctcatcaccacggaatgggaaggattaagggcagttgccactgggagttcaggcacagtgcagaggactgctgccaagagaatggggcctgagatgacttgctcttctggtgggaaaaggagcgcatgtctgtgcttcctgagatgaggcactgtgtacatctgtgtcctccagcatttcagagggaacagaagcaactcaactgtgctgacatcacctctgccacttccataccttccttacctgtggcctgtcttcatcagggacctgtgatggagaacagagaggaggggagggagggtgggcaccgcccacctgtgtccacgacagcatcactgtggctcaagagccaatcagaaaagatctggtacactggaaattcatgcagtcctgctggatttagatacataatacagagactgaccctgccctaggaatcatccctcacatgggaaaaccccttatgctttctcagcacagccatctctacgatgtaacaatgcttgtactgtgtcaagcaagtgatgttacctgtccccttttgaaatccgtgaaagctgaggtacagggaagttaagcaagcagtctgcccagggtcacccctctgagctaagataggatgagggtgacaacccagggaccatgacttctagacttggcttcttccactcatctgaatgccccaaaattcaatcatttgcacattatagtcacaaaatttgccatcttcaagtgtcttctgcactattactagcttttcttgttcttttaatcaacttccaatatttacctgattatatgtattttacaaagaaattttttttttttttttagacagagtctcactgcaatggccaggctggagtgcaatggtgctatcttggctcactgcaatctcctcctcccaggttcaagtgattctcctgcctcagcctcctgagtagctgggattacaggcacccgccatcatgcctggctaatttttgtatttttagtagtgacaagatttcaccatgttggccaggctggccttgaactcttgacctcaggtgatccgcccacctcagcctcccaaagtgctgggattacagacatgagccactgcgcccagcctgtattttacaaagaaattttataccattatcgtaggtagaaaatcagtatcacttgccataatgaattaatgtaattttttttcaagatggagtgttgctttgttacccaggctggagtgcagtggcgtgatctcggctcactgcaacctctgcctctcgggttcaagagattctcctgcctcagcctcccgagtagctaggattacaggcgcccaccaccatgctcagctaatttttgtatttttagtagagatggggtttcgccatgttggccaggctggttccgaactcctgacctcatgatccacccacctcggcttcccaaagtgctgggattacaggtgtgagccactacaccctacctaatgtaaattattgtataaaaatttttgaaagatctaaaaccattttgtaggtatctgagggtgcatgtaccatgttttagaaaactccacatcagaacatgttacccttttctgtagtttttttttcctccttcctttcctctttccctcacctcattccttctctcccctctgcccttactctcctccctctctctttcattcattcattcaatgaactactatctattgagcacttccaacatgctaggcatggtgctagatgctgaataagtattggtgagacctggtctctgccttgtgaagtttccaatcctgtggaattatttattatttttaataaattaaaaatatatcaataggtagccacaattgggataagagaagtgaaggaggcaaatagagtatgttcattcatgcattcatttattaaacaaatatttattgagcatctagtaaagactatttattcatttattctataaatatttattggcaggcactatgccaggcgctggtgatacaaacaacacagtccctgcttacagactagtgaataaatgaacagacaaatgactgtatattgtactaaatggtaacaagtgcaaaaagacacatgcagaggctcaggaaatgaggagcaacaggctgcatggggtgctcttgagtctggaaatgcctgtcccatgaggggacactaaggcgaggtttcagtcaggtggctactgggggaaagggcgtctgttcagaaggaagagcaagtgcacaggccttggactagaaaacatctgccagggtggacaacccaaaaggagctcagggagagtgggcacgaggagggtgacgggatggcggtgtctgagtatgcagggctgcttcttcttcttcgtcctcctcttcctcttcttcctcctcttcctcttcttcttcttcttttttttttttttttttttttgagaccaagtctcgctctgtcacccaggctggagtgcagcggcacgatctctgctcactgcaacttccgcctcccgggttcaagagattctcctgcctcagcctcccgagtagctgggattacaggcgcccaccaccatgcctggctaatttttgtatttttagtagaggcagggtttcaccgtgttagccaggatggtctccatctcctgacctcgtgatccgcccgcctcagcctcacaaagtgctgggattacaggcgtgagcctccacgcccggcctgggtatgcagggcttcttatgccacgagagcttccattcgattcccagtgcagggctaaccctcggaggaccagacaggggagggacctggctggtacacctagaaggtagctctggctgctggggagagcgtggtctggagggtgcctctcctgccagcctccaaaagtcctccacccttgccccaagccagtgaggaggcctcgggggtactagtcttatttagggatactagtttatccaactttccaaattcaatgtgtgttctgggctgggcctctcactccgagaatggttcttgctactcgtggaaattacttctgttgcacttctctgccttgatgtcctcacggccctccccaccccgccccaccccccccaacccccccgcccgccgccgcatttctcctcggccccctgtggctctttgaagctttcaggacccctgccttggagcctcccagccacattcactggctcagccaagcccctccgtgttaaagtcctccttgtcctcgccctctgggactgggtctcctctggcattgggcggctgcttctccatctcctttgctacccctttctcctgctgccctcttagtgccaacattttcataggttgactcagtagcattttctcagtgaggcttttttttttttttttacaaaaaactaaaccttgtccccttccctatccacctttatcctgctcagttgatacctgatagcagtttccactttctaacccactatatatattatgtattaggtttattgtctatttccttccacaagactgagcttcgtgagggcaggaacgttttccagcttatttctcagacgcgtcccaagggctgagaacagtgccaagcacattgtaggagctatgtaactgtttgataaaaaacagaaacagctcttagctctctgttctttccattttatcacatatttcaaagttaaatgcctgcaagagcccagcaggagctgtggaaggtgaacaggactgggtggggcagggtaaacggagacccctcatgatcccccagcagcaacgaggacttcacctcaccagatctggctttccaagagaagcacgaaatccagatttttatgtaaaaatctcgaaacattaaatgattataactagttcaattaaatgattacaactagttcaactgagagccaaggaaaactttgacctgggtgcctcttgggtgaatctttgatggaccccttcaaggagctcttctcagctccttgctggtgtcactcgcgggcccctgttcggctccttcatgaatggattctggtcaccgcctctcttgttcctcaggcctgggccccgggtcctctgggtaccctgtgctctcccctgcacagcactctcccacttcccaccctgcactcagggaggggtatccccagccagacccatcttccagcctccatgcctgtgtttccagttccctactcactttctcccttcagctggccaggggtccctcacattcagtatactcccaaacagctctggatggtccccctcaaatctgctcactctcaaattccttggttcagtaaatggcaccctgtcttcctttctaaacagaccagaaatggggtgcaatccctctctccccatcacagctagtcatcaagtccgttccccctgctaaccttttccatttgagttacctttctccatccttctccccactatccccattggagccaccaccgcctctcccttggtgaactgcaggacctcctaacgggcagcccttcttgtctccttctcatctctgtacgtctatcagagtgatctcttagtgggtgcagcgcaccagcatggcacatgtatacatatgtaactaacctgcacaatgtgcacatgtaccctaaaacttaaagtatatataaaaaaaaaaaacttcatgtacaaaaaaaaataataaaatgtttgttacgtggaaaaaaaaaaaaaaagaatgcaaatctagccatttcgcgcctcatcccctacttaaaactcatcacattgtgattagataaagaccttctcttccacatagcctccagggttctgcatcaggccccgcctccccctcagcccttccccgtcatctgctgggctctggccatattggaccactctcccctgtgcccttttttcctaggtacattcctccttcaggtctcagcctaggtgttgcctctcagggaatgctttgccaagttccttgcccatcacactgtcagagcctgctgtgcttctctcagggagttcatcacagtctcagctaattgattctctggcagttacgtgtttcttctcagcctcctttactcttctacatgccccgtgagggcagggaccgtgtctcatcactcaccacagcacttggtacagaatggagactcatgtgtgtgcaaaggaaggagagaagggattttcaccgatgagtacagggcacctgctaggcaaggcattcagcgagactgtctgcatccaaaaatggctcccagcctcttccatcctgaccttcctacaggaaagcactttaggaagggcacgtcacccagtgggaaggagccttgcttagggggactctgttgtccaacttttcaaattctgttttgttcagtttatatatttaggccttaaatatttcattatttgcttgctggtttgatcacatgctatttttttaaaaaacacaaagcataaaatcagatacagtgaaaggtctctgtctcatccttgcttccatctgcccacctcccacacactctctacttatgttttgaggcttttatatatccttctggaatttctttaggtatatacaagcaatacaaatataacttcttatttctttttctgtgttatacaatggtaggaatgctgtacacgtatctcattttcctgtcgatggtgtatcttgctttttccactcagtgagatcttgcaacaggcatatcttcattggttctgcctctacttacactttggagctgcaactctgaatcactgcagaggactctcttgggtaattaacttggggtggacatgggagcttttgtctcctgattcccggagccccatctcttcccaagtcagatgagtaactaaaggaaaacctcagccgcacccgagtccaccagaacaccatgcccagcagagctggccaccatcccaggccccaacaccagcccatcacacctccctgtgagtcccctgccagcataccagctgagcccttttattttggaggccttagagcagtggcctttaactaggggcaattttgtcctgttcccttagacattcagtaatgtctggagatatttttggtgctgctggcatgtagcaggtagaggccatggaggctgctaaactgcctgcaatgcacaggacagctccccccacccaccctgcaaagaagtatccagtcaaaaatgttaatagcatgaaggctgagaaaccttaacctacagagatccagaagttagaagtcgtgcctaaccggttaaccagttcgtgagggtgagacgttcatgagaagagcatcttccaactgagaagagcctctggctcaggggcagcttcttaagatgcccaaacctctatgtgtatccctgaccctgatacttcccctcccagaaaagggaggacgggaggagctgaggaagtgaggaatctactacacccttggcctcaaaacacttcatttcctcacactgtcacttgactgcagggccaggccaggatttccatgactctagccactgagctgtgtctccgagggctactgcctatgtgaaggtgatgcagaactttagagaaggccatttgtatcatagaagtatgcagtgcacaacctgtgcaacaataagcggctgtgccacagtctccctccctcagtactatgccctgaggcccagcctttagcccctcactccatcatcacaatttgctgagtgtacagtgggaaccaggcactgagccaggtttggggcagataagacagattcctaaatcatagagctcaccaaggggaagagatgtttagacaaatcataatttaaataaaccagaagcctggggtctgagatatcaacagaggagggaatgtggggaggcttcacagaggaggtagcattttgactagttcctagaggaggcctagggactggagagggacattcaaccagagggaagaaagaatgcaaaaggacagcaaggtagacagggttcaggctgaggagctcctgtgtgccaaactaaggagtatggacttcatggtgggggccatccaaggtgttaaagtgggggtcaccttgctgacttgtagatgagaaagatgaggtgcactggtaccattcctgactcacacctactctccacccctttcactctttatctggggctgccccctccaatcgcattgaactcgaggccaggtgctttggttccaagggcatcaggcaagaaatagttagaggctctctcccttgctgatgaagcctgaaattctaccaaagatgtattcctttggattacagtttattctctcaagttcctctgtttagatagatattcagccttcacactatgaaatgtgacattttgtctctaacactcatgcacatacaatacatacatgccattatttcgggtagctatcagaaatatttccacctactggcactttttttccccaaggttttattggtatacgtgtgctcaattaaattaacgtttaccctcaggactgactcatttaataggaataacaagttcacctgggtgtgtagggatcgccagacaccacccagaaaatataaaacacatcaatgtgattttcacctacaagcattgaaaaggaataagcctttctttttcttgttttttatcttttgaccttcatgggcattttgtgtcaagattgcaaattcaaacataaaaacagtggagaggggctgggtccaggaacaggaaaggagctggaggaggcattagtacatttgatcatttacctggtccttattccttatctcaaaaaggactgttgacccctccatgtaaatgagtttatcagacctcagtctccctgatgagaagacctgagaatctgagggggatcacagagtcagtaagagccagagtgcataatcccagcttggtcccttactagctgggtgactttggccaaattagctgacctctgtgtgcttctagtgcctcgtttataatatagagacaatgatagtacctcgtagggcattaggatgaaatgagttgatacatgtaccatgtctagaatggtgtctgggacatagtcaattctatgtaagagttaaagaaaacccaacagatgtggcccttgaaagtgcaaagaacagacttgggaggcgatgctgaagatgctgctttggctgacctccatctgtcccttatagcctgtgctggccaggcctttgtcactaattccgactctgtcctcatccctgcagttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattgtaagttggtccccgtgcacgttcagcaccatgggtcgggcccaggtacttgcaggacaggctgcgtgcacccaggaagagttggtcaggggatgcgtattacagtaaaaatgacaaagaccagaggtggctgaggctctccctaagacaatgtctttaggccccaagtgtttactattgaaaacatgtaacctactacagcagcacccaagatgatgatttacgtgggccacagaacaccttttgtctttacagagattcaatttatttattttgattgaaaatgacaaatgatactagttttccatgtatggtagagacataaggtttctttatgaagaactgggtttgttttctaaatgggtcagtttaaaggaaaatattaactaaataatagccgtggtcattccgtggaactagcacagagcatgaagctgggattcactgactggcagcaggaaggatggtgctggggggagcttctgggaggcccactgcgtaaaagtgcatttctgtgagataccctctcccttctctgccgcactctcccttctgccttccagattctcaggcctgctgtgatgccagttggagggggcatgtaacacagggcagttgaagctcagagctttcagtctgggctcgactcacaaaataaagaccacgtcctggcagtggccttctgctggaatggggcgagggtcatgttgcagtccttaaagttacagcgtgtgttatcttaattctgttgtgttgtagcccgttgaagcaatcaatcattcagactgaaaattgaggtagccggctggcaggcttgctgggaggtgaagggggtgtgcaatgtaagagtttattaggcaggagccccagtgctgtggggctgtggaactggggtcccaggcagggaggatttgccatcaggcagtcagccctcagtcacccagcatactgtcagatgagctcctgctccccttctccaagtgcagaaaagaccttcctgtgccttgtgaaccatcagagaggaattccgttctattcaaggagattttctggggagccgttattgacaatgttgtgattctcagaaatcttccacggtgggagtgggagtgggggtgggggatagtgtcagtggacgggtgtggtccaggcctcaaccagactcgagcacgtggggttgaacatccccggatgcttggtcccgttaccactcctcattcgcttcctcctttggttttcatgttttcactggatagcacaagcttgggacagcccagatttaggttcaccttctttctttgtaaatatcacttcctcttcagcccatctccaccacagctccaggcccaccattccaagccaggagggcgtagactctaagctccctgggttaactgtcccctgctgccacagggctccctgcacatgccagcctgccccattgctgggggctgagggcctctgccagtcacctttaaggaaaggattaactgtgcccctggtaaaataggggaagtaggaccccagaggcctaaaaaaggaggaggagaaactaaaggctcagatggtagggtgaattttaacttctatttaatctaagttaatcaacccaaagaaaaattagaagtagtgctaagtgaagaatcgaggcccaactaacagaaacacaggatgagactgaagctgaggggattatcagtgcagggctacaagatgacttaaactcgagtctccaggtctcagcaaaaccacattaaaccaggcttatggagcaccaggccccagctgtactggcagagacggaggagcagccccttcctgcttggggaagagtggggaggacaagtgaagcccagggggaaccatcagcaaggggtgtgaggagagagagggtctggggtgtggcagaggaagccagggggtttttattgagaggccacgaggtgggaaggaagtagggaagaaccttaatcataaaaggcacagaggaggttttagagtgtggattcttgaagaatcgtctctccctgaggtatagcagcttccagaacactgccaaagcccttcccgtcacaggaatccctcactgggactcccaacttttagtttgagactttgagccaatgaaagtgcaggccttctgagaggcatccctctttgagcagcacatggcaggaagggtatgaagaacaggggtgaggtgaacaggtgtgggtctgagggatggggaaaaacctagacagaaaggaagagagggaaggacaaaccgggagggaggcaggcacgtgacttactccactaacacgcaggcattgccttgcctcagacaggcagggagccccttaaagctctccctggccagaagtgaaggtgttcctgtgggcaggggtatgagggggtctgggagccagcaggaggaaatatatccctgggtcaggggtcaggcaggagtccacctctgcctggatgtctagagcaaaagggacctgtgctttctgtccttgggcctcttgggagctcccccttgggactaaagagccagaaagaccctgtttgctttcttttgcctggagggtcaaggaagctttcagggtccttatcaccccctgagaggatggcaaagagaaaggatggggctgtccaggagctcccaccgatttcaaaactgcctcagtcagacttcttaaagactgacttcatcgttgccttgaagtgatctcctgtgcatgttcccactctccctgcctccccagaccttcagagttaacctcaatgctcagtgctgtggaggggggcggggtcaggggagagggtattgattaggtaggtttgaattcagttgggaggagagaattagaacatctggaaaaaggaaggctaaaacggaaagctgacgttgtgtaagaggtgtttctggccacactttgagctgagtaatgttgatccttagagagttctcagctgcaggtctttaaagacttcttcaagttatttaaatgtctgacatttacaaccttggcactagagatttctctcaggagaaataccaaaattggggaaaaaaaataaacgagagtggtccacatctagttagcaggttggaaaagtgacccaaatctgtccctaaatcaaaagctcttttctgaaaaatgtcaatggcaccagcccgagtcatccgtgggcttgtgtagaaaaagcagaaataaataaagcccaaggattaaagcccatggcagtgatgcacatactgcatttctcatctcagaaagcctcaaaagactagtgggaaaactcacttgaggttttcatacgccatcgcgcccctgtaaccaactcagggttgaccccggggatgtgggtgcctgcctagctcaggtaccagcagtgaggacaactctgtgctgcataagcagagtcagccttaccacaggcaaaacagatggccacccacagaggccactggagagccatggggaagtggaggggcaccccacagagggcactgagagacacagggaagctgaggtgcatccccatagaggccactgagagccatggggaagctgaggtgcaccccacagaggccactgagagccacggggaagttgagcttcatccccacagaggccactgagagacacggggaagctgaggcactccccacagaggccactaagagacacagggaagctgaggcacaccccacagaggccactgagagacacggggaagctgagcttcatccccacagaggccactgagagacacggggaagctgaggcactccccacagaggccactaagagacacagggaagctgaggcacaccccacagaggccactgagagacacggggaagctgagcttcatccccacagaggccactgagagacacagggaagctgaggcacaccccacagaggccactgagagacacggggaagctgaggcacaccccacagaggccactgagagacatggggaagctgaggcgtaccccacagaggccacgggaaaggtgaggtgcacaccacagaggccactgagagacatggggaagctgaggcacaccccacggaggccactgagagacacagggaagctgaggtgcaccccacagaggccacgggaaaggtgaggtgcaccccacagaggccactgagagacacagggaagctgaggcgcaccccacagaggccactgagagacacggggaagctgaggtgcaccccacagaggttgtggtgaggtggcttctattcagggggcagattgccatcacaagacaggatttccttgggcttaaggtatcaaataacttgaggacatgtgagatgccttcctagcagagctgggaaagaaagggctttgacagagggaagagggaaaactggtttagatcccgacattgggaaaaaacctccaagttactggatcacaagcagccagggacaatgtgcagttgttggtcctgggtctttgacagactccaggtcaaaggcaagacactgtgagaagggaaaggatcaagtctgtgagcaaacaccatcagccttgcaatttgatggtggcctcaaggagacattgggcgtgtgtttaaacaagcaaggaaggcagctgtacaagtgccctaatctggtaaaactgaatacctccaaggtgactcagtcaagtgcctgaagcccctgagggagctccaggtttcctctgtcgtgtgttacctccacttgcttccaagccatgcccttttggcatcatactagaatgacaccagtctccagaaacctgaattaccccactcctcagctggccatactgaatctgggtgacccggggcggggggtgccctgcctgtctgatacaaggaggacctggttttgtcaggtggttggtgctggaggtgaggctgggagaggtcatgtcacttacaagagccaggatgcagtggcatatttttgcagagctcctgaccctctccactctcactacaaggacagagccccttcgtggaagaacctgccaggcacaacaaggctgtactctgcccaggctggctcgctagaggctggggacccctgggtcaccaccacagaggccgaggatgcaacagcacaacagctttcaggcctgacttccattcctgcacaggaagcctcgcccctctgaagctatcaccaaggagattgtccagattcatagctggaatttggcctctggtcaggttccatcacatacctcagttggcttctattccccccaggcttttgccttcttgagatgtctgctaagctgagatttctgctcccccggctcctaagcctcccttgtctaacccctgccctgactcaccagctgtcactagtccaactgggtttcctgactacaggccaacatccctttgtactaacccccacccagtgcagttttcagtggcctctgcttcagcgtggagactttcctgtctttcgttctctcagctctcttacgtactctccctcctccactttcccttttgtattcctcttgttcaccctctgtccacccacataatgaactgagtttgtgcaagtgatgtgccatcaacaccaaaccaaagactttgcaccatcatgtactcaagtcaattttccgggggtggcttgcttcagagcaaggacacacagtggggggctgtttggtggcaaatactccagcactgaggggttggggagacaggaaagccagcaaggctggagccaaagccttcgatgctggagaaaatctccaaccctagaattcactggtctatcccattggggatttcatcccaagatgatggccttgtctaattgccaataacagtagcacatttcgcttttgtgttactgatgggcttgccttctctggggactggaggggcagagcgatgtgtttggtgtggttgaagggcatcatctgaccttgcagatcttggggatgttctgctcactcctggcttctccgctgtgtacccattccttcccctcaaaagcgttcagctctgagactctggctcccagggcttcagcactggaatggggggaagccagcgtaggagggagagatttgcctccccagaaacctagttgtcctcagtgaaagccagaggcaatgagggaaatgctggccaagtaaacttctctttgtgtacatgttctcttttttcaagtttgcttcagtgtgaatgtccctctttaaggtaaggcctccagagtggggagtctctccaggtaggtgagccctcaggcccggtgacatagaggcccctctcaacctcatgatccgtttccatccagccatccgcgctgcatggcgggacccccgagggaggcctctcctgcatgctcctgcatgactgggctgtgctgagagaaaacctgggaagtgggctcgagacccgcacacttcaccaacttagcgacctgaggaggagccctgttgaacaggcagccccttcccctgaagccagcccacctgcctagggaccacctgataacatgggttgtgatgatggaggccagtcatgacaccatcctcatcctctgttctggcagagctggggcaggagcaaggctgagttctgcagcccctcacgaggacatccccctggactgtgtccaccacatccaagcggcttaccatccaagaggctacaagagccctccaagagccaggactctgatccagggctggagggcatgggaaaagtccagaaacctgtttttggtggttgacccagcgggtggcatggtacagtggacaggatactggctttgacttctgagagacttgggttggaagaaaattgctctcacaggaaagccatgtgacactcagaattcacctcacccctggacctctggcttccttgagcctccttatctgtaaaattgggatactatgagaattcttcactcatggaattattaacaggaatagctgggtactgtggttcatacctataattccagcactttgggaggccaaggcaggcagatcacttgcactcaggagttcgagacaagcctgggcaacacggtaaaaccctgtctctacaaaaaatgcaaaaagtagccaggcgtggtggcatgcacttgtagtcccagctacttgggaggctggggtgggaggatcgcttgagctcaggaggttgaggctgtagtgagccatgttcatgccactgcactccagcctgggagacaaagggagatcctgtctcaaaaagaattataaacaggaatagaataagtctaagctactttgtgcactgtagattctcaatgaattttaattcctctctctccattcaccacccctaccctggcctttgaacttcttctcatccccaaactccaagaatcaagagttaagaattgcaggaggttggtgtgatgtttggaggctgggctttggaatcagatgcaaccaggttctaatttgggctgtgggatattgggaaagtcaccacttctctctgagcctcggtctgctgatcatagcatgggggttataaatatctaccacctggggttgctgtgaagcatcaacaaacctaattgcctgaaatgagtagcacagtgcctgatacaggtgaacacttggatggtgttgatggtgttgatgctgttggtgaggaggacaacaggagcctgaggccaagggaggctggactggacaacactcctgtcccaaaggggctgacgggccaggagttcagatgaggggatggcaccatctagcaaggcaccagccattacagggcagaaagcatctgaaggcagggaaggagcacagttcagaatgctgaggcgcctgcaggggcgtcattccagcacagccactggtatgagctggggagtgccaaggggagggaggtactgcgagggtgactcaccccaggtgccagcattcccagccctttttgcctcttaggatggcaccccaagttctgccacattttctcagcaccccccaccccgccccccggtcccctgcttttactctgtgaccatgcttaccacgttgacgttcgttgacgttccctgccttcattctcagtagtgtttttgctgggtacagctgtgcggccctcagcaccccagccctgaagtggtagcagtcaccagtgagaccctgttccagcacagcaggctcccaaatatttctaagcgaaacagcctcagtggagcatctttgactctggacaagtgatttcgccattttagaattctgattgcaggaattttgccatttgagaattctgatggcaggaacaatgatttcaccattagagaattctgatggcaggaacgttcctgtggcctgggattgggagggccatcattttcatcccctacccccactccagggaagagtgtgaggcctgggctggcctgggctttgctgggcactttcataagctcctaagcttttctttgtgtcttaatggctgttactttggtatatgccttcctgggttcatcagactagtgtttcttgaacttaatctcctcccagacccacctgcacttgaagtaacacacatacaactcacctgggagcatgggaggacttcctaggccacgcctgatcaaaccagaggacagcaggaggaatcagggaatgtttcctagaggagctggaacttgacagaaagctgggagggatcaggaagaaagaactatctgcgaaaggcataaaaggagaaagggaaaggcaagattcaggtcagttatattcaacaagtgtttgttgaacatgtcctttgagccctctgtgaagccctgaagccctagagggagaagcttgacaaaggcaaggaaagaatcttctgccatcaccctaacattgccaccttgaaaagcttcgatggcagaagacttgataatgcaaaatacttaagggataacaggcagtagggtaaaatccggcacctgactcctaacaggatgctcatttggaagaggaatttggagctctgcctttcaaggtttgaggacagagagaagagggcctctggggaggctgggagccagcgtttctgtgggtcctgagagcctatgtcagcccccttctcatcttgggtcttgcagaagatcctatccaagtgggtctgcactgctggataagcaatgccctcctgcctatctctgcggagaggactaaaggatggtctggctgccaggagggacaggggtcagagcctggttcgtgtgtattgaagtgaaggcagacagagcctcaaccctccctcacagaggggctcagccctccagccagaatttgttccctgaagggtacaggcaccaaggggcactttgcaagctgactggggggctgtgttctgcccacatcaagtggaggacctttgatctccagaggcatatatgtcatggagaagagacactctggggaatccagttttgcacttgggggatcagtgccttcttaccttcccattgtttgtgctggggagggggatggtaacagaattaggtttggcctaaacttaacattccattgttattctggaattctgggatttgactaatacacagtgggtttgtgaaggttcattaagtttccacatcaacctcagtctcctcactgtgagaaggcctggccacatagcagcagcccttcaccctccatgttcctctggctactcctttctggacctatttcgccttaacagcagctttcttggagcacagagcttggagatcaatggagtatttcaggtgtgagagcccagctaggcgtggaagagggtggcaaatggctaggccagggaactatgaaatatatttgccttaagtaaggagatggaaagataagccctccagagtagggcttatcaactgagatgacttcgaaaataaaccagaccctgacctaggactttagccgcactccgtcccccctagcgcagcagctgacatatcagctagtgttggcagtaacaggatttgcagacttcctgggag

SEQ ID NO: 989 - DNA, 1661 bp, Homo sapiens
agcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccaccagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattgtaa

SEQ ID NO: 990 - protein, 554 aa, Homo sapiens
  VARIANT (1)...(554): Xaa = Any Amino Acid
APKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIVX

SEQ ID NO: 991 - DNA, 42339 bp, Mus musculus
  misc_feature (1)...(42339): n = A,T,C or G
tctgacagttactgcgtgacttcccggatgagctgcgtgctgacattgctatgcacctgaacagggagatcctgcagctgcctctgtttggagcggctagcaggggctgcctgcgggccctctccttgcacatcaagacctccttctgtgctcctggggagtacctgttacgccgtggggatgccctccaggcacactactacgtctgctctggctcgcttgaggtgctccgggacaacatggtgctggccatcctgggtgagaacccccccctacctcacactgtccatcctaagatcttctccggaggccttgggggatagcctggggttctgggggtgggagacctctaactagtacctagaatgcctactgagtattcttccttaatcctttcagttccccctaggcccttcctcccgctctgccctactgtttggccaccctttaacccacgggccctccatcagtggctgtcattcactccaacgcctccttttctattgcatcatcttccagttccattgacctgtccccaaacgactctaaaacctgttggcctttactgttcaactgacccctctgaccattctttattgatcatccaattctattggtcgtttctccagcactatagacatcttccactggctgctgcccagcctcacctaccactctccataggcctcttacaagttccctgactccctcttccaatgcactaactcccttcaaccatccttaagtactctgaccatcatctctcagatgtatggaccatctcctaccgatattcccttcatcccagttgactgtccctttcctctacccacagggaagggggacttgattggggcagacatccctgagttgggacaggagcctgggtcaggggcaggccccagctgtgtgctgaagaccagcgccgatgtgaaagctctgacttactgtggcctgcagcagctgagcagccgagggctggcggaggtcctgcggctgtatccggaatatgcagctgccttccgggctggcctaccccgggacctaaccttcaacctgcgccaaggttctgaaaacaatgtatgtagacgacatatggctgccaccccccactgaggttccttccttcagaacagctaccctcttacagctctctcctccctaaaaacatcaccttaactccaactacctccttctattgcttcatatatactatcttcccactccactccacttgggcctcacccagccagcccctggccaatctctcacagccttctactattgcctggtacctcttagccttgtcttatctttatgaatgaccccttcttttaggtctctttctgaagtgatgcaacaacacaccccccacccccaccaccatcaaagttcctttcccctgctattgtcccagtggttcccactcttgttttaggctgatgtgatgtgatgaccttaggtcttttgctactttgggggctcagtttgtcattctgaattcctctgaggtggagtaaggtggtcccatgtactcaatctcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatatcacacgtgttccctgcctcctaggagtacacagttaaactagatcatgccaaaagtaacatacaaccaattcagatcctgccaacattttatccggggggctaggggtgggggcagcaatacctgtgcacacagataaacaactctagaattctgcgccaagttctacaacagggaggaaggagagcaagactttgtgctaggactggttggctacttcttaaacagactgcaaggagacactgacatggtccaatggtaaagcctggttgagtgtgatccctagaacctgtatgatggaatgcgagatctgatttctgaaagtcgtcctggcatcatgagacacacctgtacacagctgtaaataaataagcgtaattaaaaaaggacaggagacgggcagtggtggcgcatacctttaatcccagcaccggggaggaagaggcaggcagatttctgagttcgaggccagcctggtctacaaagtgagttccaggacagccagggctacacagagaaaccctgtctcaaaacaaaaaaacaacaataaaaaggacaggagagcgtggcactttggtaaaatggaacaactgttcaaagatctaaaggcatgcacagaagagacactgtgtttgaatgccaagaagctctgcctagaactggagagtggcaggcatggaggaagagcagaggttgggggagtcacagggccacaaacccagcctctggtgtcggctacccctcctctctgaaggaccaagagcattctattccttgccttggcaacagagaagtgtggggacttggggattcacgctccatggattcatctgtacctcttcgccccattctgcccgcaggccccaggctcagccgggaactggccacagaggcagcagaggaggtgaaggaaaaggtctgcaggctgaaccaagaggtaaatttggcttggctcttcccctccaatcccggggaatattgtcttggggtctgagaagagcatgccatgttctagagctatccagagtcctgagttctgttagtcacactagttaaattactctgggcaagtcccacagctatgctgggcttctcttaacttacctaaaagttagaaaaataatctgtcagtgcttgggtggtggtggcgcacgcctttagtcccagcacttgggaggcagaggcaggcggatttctgagttcgaggccagcctggtctacaaagtgagatccaggacagccagggctacacagagaaaccctgtcttgaaaaacaaaaacaaacaaacaaacatcccagcactctggaggcagaggttgaggctgacaatgtctgagtccaaggtctacagagtttcaggacaggtaaagggctaggcaagaaaagacagacagacagatagatagacagacagatgatagaaaaatagtatgtccttcccagaagtgtaaggataagagtgcacacacatcaggtccgggtccgactgcatcttgagtattcacttaaaacctccccctcctgcgactgggtctccatttacagcctggaaccgtccaaccaagtacaagtctgatgcacaaagcttaagtcctttctctttttacctttacccagtcttgggaaatgtagtgtgtgtgtgtgtgtgtgtgtgtgtgtgcatgtgcgtgcacttttaggcttagagagcctatgcccttatggctgaatactggccaggaagagaccatattctatatacttagactaggctaggcaccgcctctacttcttccccaagggatcccagtactgtctgtcgccacacagctaccacactcaacccctgggagtcaccttccctctgttctgataaacagcctgcagcccagagaggcagcatctgggccagagcagggcctagagctctctcccattcaaggttactggcaagttctccttctgcttatggcctcaggcttccctcaactccaggccagtgattcccatacccaggtttgtatcagtactaccctttaaattacaagttccctggcttctgtcagtttggaatgtctcaggtggggccaagaactctgcattttaacaagtttctcaatggattccgtactcactaaaaatcactcatgaagatacttgggtgacaggctaagagcaacgctatgactgagcatttttattctatatttcatacaagagagagagagccaagtgtagtggctcatgcctgtaaccccaaaactccagggatagaggcaatggaggatcaagaattcaggaccattcttgcctacatggcaagtttgagaccagcctgagctatctgagacagtctcaggaagatggcttaattggtaaagtgcctgcacacaggcgtaaaggcctgagttctgacccctagtgcacactgaaagccaggcatagtgctacatgtttgtaacactggtgatggggaagggatttggacagtcacatggacacatgtcggtcagccagtctaagtggctggtgagctccaagttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaagtagtgcacacacacacacacacacacacacacacacacacacacacattaaatacataaaaagccagggaatagagacataggaacagcagtatccactgctgcaaataacgttttggaaataaattggggtactcataggctattatagctcctgctctttcttcttcccaggtggctgtgagccgacagtggttgaagaattttgtaaactgtagcgtgggggatgaggggtgacctggttactgctaaggcatccatgagacattttgctatgttttcaacagatctcccgtctcaatcaggaagtgtctcagctgagccgggagctgcggcaagtgatgggtctcttacaggccaggctgggacccccaagtcacacagctggtccagcttggctcccagaccttccttgcccccaccagagactaccatgcatctctcctcatatgtctggaccaccacctggtctccagaatactacactcgctgtagtccactgtccagccagtgttgggacagtggagataggggccaccccctcagagctgagaccttccacgataccaccctatccctcggaacctgatcctctgggaccctctccagcgccagaggctcctcccctgaccccaagcctcctgaagcacagcttccagtctgggtcagacacattccactgaccctggccttgggcccaggcctgtctggggtaggctttaccacctgccatccagggaggcgctgggctccttggcctcttgccttggggtcagcagctgccagctggactggttggctctggattctctggactttttaaacaacgaatggccacatctaaccccgttccattttctaaaccatcccccatcctcctcttctgggaggggagtcacttgaagccatggaatccagcaggcatgaaatggaccatggcgccctgttgggctacgcagaggagatgtcttactttctcccgaagacttggaggtaggtatggactgggaacagaagaatggtcaagagcaaaggtctaacctagtaaaggaaggcttgaggttagaccaggcagggtctagagtgagagggctagatgacattatagtactatggagctcttctgtcccagattctgagtcctttgcagaggatcctgagaataatgtcaccttgaggagagtgagtttgagattctagccatcatttgagaagcccaggacatcttaggcctcctgccagcagccaagctgaaggagttcacttcaccccatggcacacacaaaaaacaactgagagctccagatgtgtctttggctctcagaacacttcttttcttcttcaaactctgtgttagttaccagcatcgaactccagatagaaccacaaaatattcagtattctaacttctcaagaaaaaaaaaaaaaagacaacaatgtctggctatcaagagccaacattcatctgaaatagtccccatttcttcagtctcctgcttgttgatcatttcttaatgtccaattggcttgccttatttgtttggtccctctgttttcttcagtttgcaatccctgtcttagagtgggcgccaagggggtcctaataatgtctgttcgtactcttgacttgggcctgtcaacatctgtttctgtctctctacaggctgtcatgcaaggtggttccttctgctgtcagcagctcaaagcattctagcattacccttctgcaggtcccacctcccaacatcagccaaacctgcatcccctccctcccaacatggtctcaacctcagggagggtctgggcaactcccaagccctctctggtttccagccctcctttctcactcaatgccccacccaggcgcacttttggataaaaaaaataaatccatatatttttgtagaccttgactctgtctgtttctgggggttagtctgagagccccagggctttgaaagagctaacgcaagcagacacaccccactgtaccccagggccctattgctgtctctaggtagggcaaaggcgccagctaatccacttggcaccatgttcacgccaccagggactcctcggataaggggagaaaccttaatgagtcgctaagggcctgttacattccttcctccctaccacccagttacaaccacaaatacacactatgtgggagagacgtctgatcaggatcatttctctagccttagaaagaaataccaggaattttcttaccctcctgaataaggaactcttctttcctggataggtatttgatattaagctaggtatagtgttgttatagtgggcaggtcggtggagaaaagagctggtcaccagttaagaacctgctaagaattcactctcccaagctctgtcttctcttagcttacatttctgtgtaggtctgtgcatgtcatatggtgcatatgttgtaggaaactggcaccttggtgataaagatgaaattggatgtgggcacagctttgtggcaggctgtcccagacaggtctattcttcagctcaaactttcagggtatgactgatgctgttccatgccctaggcattacatggtctctgggggtgggctttgattttataaaagttttgagtagtatccccgggagagagatgcagaaagaggccagtgttggaggttgaggttaaacagaagtggtcctaattcatgccgggcgtggtggcgcatgcctttagtcccagcgctagggaggcagaggcaggaggatttctgagttcgaggacagcctggtctacaaagtgagttccaggacagctagggctacacagagacaccctgtctcgaaaaacaaaaaacaaaaaacaaacaaacaaaaagtggtcctaattcatacagaaggaattagaagcaacagaaacagaactgacctgtggtagaagggttagtggttttcatctatagtgacgggtagagagaacacaggcagtctttgaaggagcgctaattctgactgggggcagagtgagggagatgagggggtctggtatatttgggaacagagcctaagaaagaaagcttagtctgtcgtggtggttgcacatgtgtttaatcccagcactccagaagtagaggcaggaggatctctgtgaattcaaatacaacccatctacaaagtaagttccaggccaatcaggactacatagtgagagcccatgtgaaaggaagagagagtgagagcaacccttggcagcagcaggtctccttttcaaccatttagtatcctctagacaactccttctttttaaaaaaaaaaaattacatttcttcaagtatttagcgggagggagggtggatgggtggttgtcaaaagacaactagtgggagtctgtcttactccatgtgagtcctgggcacggcactcagtcaggcttggctgcaagcatcttcacctgtcgagccgtttcgctagcccccagagagcccattctatagagctctcagagatttcatcaccttttttttttctttcttttttctttttcttttcttttcttttttttttttttaaagccaggatcttactacataaccctagctgttactcacagagatctgcaagcctctgccttcggaccgagccattacacctgactccatcgcctttcctataatagaatgtcctcaacaatcagcctcctgggcgggcttggcttctccaagttgccgagggcacacgaccggtctgcgcggctacgtgaacatcatatttttcctttctcaattctgcatgaacagccctctgtctgctctcttggaaagctcagccacacgccttccctcgcggcacttggaactggcagtgacgcgataagcaggcctggaccggctccgccccaccggcagccggttccacccaaaacccaagtgccaggcagcccccggctcctccctgtgcggagaactacaagtcccgccatccctcgcgcgcactctccctcctttcccgcgttgattgtgggtaggatcggagtgtctcccattggtctgttctttctgtcagtcacctgggaatatagagaggcggggcagagctgaagatccggatccggagcggctgaaaggcggaagtggaggccggagcctgggacaccgccgggggtgggggggagaggagcggagtctgtggaagccccggcccaaagtaacgctgctgcccggagccgcggtgagtgtgcctgtcccagggccagtgtctcacttgtgtggtagcctccctggggtaccctttcctcctgcccaaccttagcttagggggacactgacccctcccccgacccgtagccccctcttaggggctcaccagggcgtcaggccaaagggggagctcctctttccttcgctaacctgtccttcgggagcctttgggagtcttttgaggctctcctctggcctgtccagtccacttgtgggagagagggactcttaagttccgctccccaccccctcagctttcaaaatcaaagagtctttaccaggtgcgaaggaacctgtcccccttctcttttagaggtgacggagagtgctgtctctcctggttttcctttcctgtgttctacgcctcccactccccaatcccaaccaaaaacccagttgtccccctgcagccctgaaattatctttatctcgatttcctttcggagatgcggggatggggggggggggtgtcggaatgagagtgttgtacacgcacagaagtgtttttgcgcgcttacagttccttacttcctcttgagcttacgaggacctcagcagagtttgaattctgggtcacttagacggaatggcagtcttctccttggactgcacgttatgcccccagccctgtcttaagttctctcagtgtgtgttcgtcttcctgcctctaaagaatttagctgagctctgctcaatcctagggacagatcacagatcagggaggatctgcccattcattatcttctgtctcccctcctccttcccccctgcttcaggcccagccctgtccttccagagcatgtgagtggtttccttagagagactgctgcctgcttatctataggggtggagaatagaccaaataggagtagtgtgaaattgaggcaccatctcttaaccaccctgaatcacacaccactatacacttgagcaacaggtccattcctcaccagagtctccactcccctcttggcttggactttttcacagagcagttagtccacatcaccgtggcaggtatagttttcgtccgtaaaggaattgcttatgtgtgctggaaagtgccagttcccctactgtattgacacaggatccttgtgttttccttgggacttaagtgtgtgaaatggctggtatctctgaccaagctggaaggttctcttgttatgcggccaaagtacaggttagagactgccttcctgaggagtagcctgattctgaagccacagctgacccttgctgtcttgcagtggaggaagagtgggaaagccattcagtccttgggcatctctgatcaactttttttttttttttttttttttttgagatctgatcaacttaagatgcttttcttactacacaaaggctaaacattttgctttgagatctttccaacctacttctggacagtttccggtgttcagtcagtataacaatcaatcaatcctctctctctctctctctctctctctctctctctctctctctctgtgggctcagagattcagctagcctagtttctctgatctgttcaacatgtgcctctgagggagagggccagtgacccctgcctgtttacagggattggtttctgctagacttaccttccaaggagtggattgtgattcctggggttctagctgaagcaagggaaccttctaatgggcgtttctggcatttgtccggacatctttccagctctgactccaaagcgcccttttgcggagaagctgtctgtgagacaggaggcactagagttctgcatggttctgcagccacttctggctttcagaaattgtagcggcccagcagaagtccgttgctgatctgccgggctagggagggcactccagagaggaagtccctcctctctaaggctgttctccacctcccctcttgcttctcacacctcgttggcctttctgcctgttcactcctggaggagggcaagagctcgtgaagatagaaagcccccagagtgctctcagtgcctattcctcacaagtgtcctggagatggtggtatttgtatgcccaccttagagacggttccccccaagcatacagttagaagtggtcagacgctgtgcttggagcgtggcttcgggtgtagctttgtcttttctaaaagcaggctccccctgtctgcggggcttgctgagtaaaggcgcctgcagggagaatgaacagggacaggagtacagactcttaagtccgccgtctctagtattggcttttgcttccctctctttcccaacattctaccctctttctttgccgtggactccatgacagttaagaatcccaagcctgtactcttcagggcctaagagtttgctaatgtctgtgtgccattaatttctccaaaacttgactcatgatagctagaaaatgaaagtaaaagtgaaaggcagagaggtcccccaggcagggttgaaaggccatgccttctgatttccctctgataccctgatgattctgagacagggtcttactgtgtagccctggctgtcctggaacccatagaggtatgtccacttgtctctgcctcccaggccctaggattaaagatgcccatcaccatgctcagcttcaaattcagatagagctccactaagcaagcattccttaaaaagaacctacacgtattcatttattttctgtctgggtgtgcgcacacacacacacacacacacacacacacacacacacacacgtgccgatgaacacgtgtagaagagagacaacaacttgtgagagtcagttctctactaccaggtggggcctgggatagaactcaggtcttcagacttggtggcaagcactttcccttgctgagtcgtctcaccagcccagaaagaacctttttaatgggctgaggatatagctcagttggtgagtgcttgcttaagatgcatgagtctcatctctctgcactatataaaccaggtgtgtaggcacatctgtggttgcagctccttggagatagaggctagaggatcagagttgagagtcatccttggctatatagaaagttggaggccattctggattacaggagactcttgactctttttgtaaccattgctcagctatcagaagggcagtgtaggtggaaggcagtagaggcttaggcgcagagacttgaattcccatcctcagccccttgcttaccatttgggtgacttgggctcattgaacctgttttcttgttttttgttgttttttttttttcctcacaaaatgggaatactagatctcttgcagagatagaaataaaagataggggctggtgagatgggctcagtgggtaagaccacccaactgctcttccagaggtccagagttcaaatcccagcaaccacatggtggctcacaaccatctgtaacgagatctgactccgtcttctggagtgtctgaagacagctacagtgcttacatataataaataaataaatctttaaaaaaaaaaaaaagaaagaaagaaataaaagataaaggagccagtccagtgtcatggttaggatagatccttacggtggcctctggtgggcaggtggggttgtgaaggtttattataattcatctttacaattctaatcaattttagggtcacaatctgatataccagccagtgtttggatgatgtcccgtgtttgctcattccatagctacttagcagaattgatacaggctgtagctatttttttttacaggagtgctggggatggcaagttcatggctttaatcctagcacttggtgggtgggtgtgtgcagaggcaggaggatctcagtgagttcaaggccagcctgggccatagtgagaccatggagggggcagggggaggcagacaaactataagaaactgctaaggtagtcactgtgattgtccaattgggaatccgtgttatttcttttatttttgaggcaggtctttttctacttggctctggctatcctggaacttactatgtagaccagactggccttgaactcatatcaatccacctgcccctgcccctgccttcagcgttggtacttaaggcatgtactaccattcccattattgtacctttttcttcattaatgggattttcctaggagatgagcacagtgttactgatctgcatggccacatttgtttcaggcaggttttatagactaagatgtcccaaaatttaggttctgatgctttcaagaccttggcagagccctatggaatcctagcagtttgggagactgaggcaagaggatcctgagttcaaggcctgcctttattgcatagcatgtttgagactagccagaataacttagtgagaccctctctccagatataaaacataggctgaggctatctcaaacaaaacaaagaaccttgaaataatcttttaaggcattttgtgtattgaaagtatggcatataaaggattggctttcaaaccaccacatctcctatacacaggggtagtgataccagttaaagttcaacttattttgttttgtttttgagacagggtttctctgtgtagccctggttagcctggagttctctttgtagacctggctgaccttgaattctgagatctacctgtctctgcctcccaagtgctgggattaaaggtgggtgccacagtatctggctaaagctccgcctactgggctttgttgacttgtaccaggcactcttctgagctctgagctcactcatttcatccctactccactggaggaaggcccatgtcccagtgaggaactctacagtgagtgacaggacaggagtctgtgttcattccattatgcagtatagcctctcctctctaggctaagtgtctaccccacctgcctggaagtgactgcctccatcctcttttgagacttgtcttgcaagtcattttcctggtgaagcttctcattagcctgaggagatactggctcctgtctttgtctctacatgatcttgcttctcaatgctggctccctgctagttctatctcagctagatgagcacctcaggccacagatatggtcatgttgtaggtccctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgtaggtccctcattgaagctgctaaaggaaaagcagggacatggaaccctgcctaaaagtacctgcctgccggcctccttaacactctccctagttaaagctgggatctgaacctagccccagctcattgctagcctgagccctctcttcagctgctcaaacatagacaccagagcatacaggtaagtagagtagttgatactgcaagccaggcaggctacaaacaaatttccagaggatagagctctccaaatctcaatttcctgtgaggattttagtatgagaaggtggacatgtctctggctggctacagagtgcccccaccccatctgcttctacagagtgagtaaatctgatagcaggacagaatagtctgtactttctgcacttgtgtgtgatgagacagtacccacccaggcagcacttagcgaagtgagtttgactctggtcggtgggtgctagttttgcacagggtgacattggtcttaagcactagatgttctggagttagaattcaatacaagggtgcatgccttgcattttcaaggctccagttctattctcaccaaaagaaaacaaaaagcaccagtgagggcagccccctcatcagcatcctgctgctgtggccttgaaattccctgctctagtcttagctgccgtgttgggtgtgctctctcacatgcagcccctcttctccctgttccctctcaggttagttaactcatcttcaagatctcatcttgtctcagcgtgagcccctgccccaccctgccttttttttttcctttaagtgaacttttcagaagagtagtaaagaaattctgagggtagtacagttcctcacaagccctagaccctgttcccctgttagtagcatgttacattagtgttgatgtgtgaaagtctgtgctccactcacatttctgtggatgacacccacctgattgtcctgtctccgctgctgtcacctctcctcagactactctcagcttcacagactacactcgttttcagttaccttgatggtcttgaggtcaccagccagatactttgtgtgatgctagacatttttctcgttgagtagactggggttgggagtgatacgggttagtggagagatgtaaaaataccatttgcatcctattgtatgaagggccacacaatcagtgtgatctaccactgtcactggcagcctgaccacatttgttctctttggaagaatgtcatgtgtagcccacactgaagagtgactggtcaggaccctctcttggagggtggagtggtcacgtgaattattaagactctcgctcgattcaagagatctgcttattctctctcatttatttattcaattatttcatccgtcgatattggctctcaggtacctaattttacactttagtgtgtaatctgtggcttttcctcacattgcttcatctttgaccataggctgctctttcagctccctttgaccaacctatcattgtgaagttttctgattttgtattttgagcatttccttactttttggcacaagatgctctttgtgtatttcctgcccaggccctggaatcagctacccttccaaagcctgtttagcaaacattttctctccagtgccttgctctggagtcactggcatgaattcaggttgtcccttttggtgatggttggtgctcctcatatctgggtgaagtggcagagcaagcacatagtgagaacccctccagtcctagcagttggtccttgcaacagttcctatgaactgttcaccagttcatagtccccagctgcctgatgctgcacttgagcgaaatagtgggcacatttggtgtctactctggagtttactcagagtgtggagaggtactggctgtaatcattgtctggtttgggtatttagagttctctagtcaatcctttctggactttgggctgagagtccatgtcaagtcccaggtggtctagtcacgagtcttcctgccattcatacacagacctctccttcagcgaggcttcagttgtagcctttgtggctctcggcaggctcaaggcagactatcgcttggagctatgatcctgaatcattgactagcttaactccttctgctgggcagtcaccctctaaaaatatgtaacttaagccctgagctagcctttgcctctcttcgcaggtctgtgagtgtccctttcaggtggccttgtcagaagcatctcaggcttgaggaggctgtgtgacgcctcctgcaccctgggtgttctagtcactacgaagctctctgagctgctcagactctgtggccatgaatggtgccaatttgcaaacctctaacaattgcagcctgatttttaaaaggaactcaactctggttttgtcatcaactgccctgttctctcacccccaccccagctgaatcacttcttccccttcctgagaggctttgcaatggaagcaagggaatgaggtcttcaagatgcctcttgttataggacttttcttagctttaatttttttccaaacttaatgaagcagagtcaggatttgttaaagtatttcaatatagacttaaggatgaggattaaaacacaccccagagcacaggtatgggcttctcacagaagagtcacccttttttgttcttgaaaggatcatgataggttttagtaggggaggatagtgatagtttggatagattggatagtgatagttcgttcactcagtggcatcaagacacctctccagggaattcaaagttggggctgttgacagaacattatgagtcttctaggaaatcaacccttgttccaggaaactagtgaaagacttcctctttcaaataaggggcctcggaggatgaggtcccgcaaaactgagttgaaaggtgtctgggcaggggtaggggtggtgggttgaggctccacttgcttcctgggacttcgagggtggggcttgccctggcccacttgggttgctgactggctttgttgttgggttctaggggcttttttccttctagcagccctggatgaaggtgctaatctctctctctttttttttgtttgtttgtttttttcgagacagggtttctctgtgtagccctggctgtcctggaactcactctgtagaccaggctggcctcgaactcagaaatccgcctgcctctgcctccagagtgctaggattaaaggagtgggccaccatgcccggcgctactctctctcttacaggcttagatagttcagggtcacagcaggaggccaacaaaagtaatggccctaggacttgctattagtctgacttaactccactgtgcacctgactctgcttcattcagttaaataaaaaacaaagatatgaaaggcatcttgaagacctcattcccttgctcccattgcaaagcctttcaggaaggggaagaagggattcagctgcaggtcactccaggacctgagagctgtcaggaaatcggttaggcttcccctcgctggcctggagtgctcttgtagtgggatcatgtcagctggaagatggctgtccccagaacgtgagttctccatgtccccatttatttaccacacttcagcagcctggcctgtatcgcatggtcacaatatttatgaccttataccaggctcaagcttaaaccacagggaaactacagtcagcctttgggatcctttgcctgtgacagtgccctgggtccacttgtcttctcatcctcaactctccagctcccaagatctcaaacctcctgctgtcacctgcagcagtccttgtaggatgtggggctctgagagcagaaatgtgactagtttattgaaccgtgtttgtactcgcttattgtctgattggaccctgttttcagctgacaccatcatatattttaagaaagaaagtttgtctgaaagactgttctccggcttcaagaaccattgtccctcaggtcttggcgtgagaacttttcaccttgttcttgttagctgggcagcttctggccacagtgtgcatgtgctgtctgggcaggaggaatttgtcttactgctgactcccctgctctccccttagataccacctcttctcactgcctgggagctaagggcgaaacaaagacggcagtgatttaagctggttttcttgtgttggttgtttgtggagacaggaagggtttgtgaggagtgtcagttggagtgagcgcctgagagaacaggtgctgtcgctgaccctgacttgagcagaggttcttggagtcctgctgggtctggggcagcagaagtggcagctgtcttggctcacactcctggcctctgtagagctcctcctgagaccgagagggagacaagccctgtattgatgagattccagctagtaacatcctagtaagtgtataactgcacaaacaaaaccgacacagggaacagagtggtggtacacacctgtgatcccagttcttgggaggttgagtcggaggattccaaagctccaggtcagtaaaactctgtatctaaaaaaatgaaaacattcaaaaccaaccaaagatcccaaaccaagctagaatttaatacagagtagtcgtcctacctgccatccagaaaacctgtgctccacgccggagcagcagatgtgggctgaggaatgcgggtcggtggaagagaggaagcgtcactggaggtttccatctttgcctgaaagttagcgcgactgtgcttcccctatggcctccagagacacatttgtggtggaaagctgagaaagcacttgacagtcagggaagaatttcttctttctgttatttttattttatttttgtgtttgtttgtttcgagacagggtttctctgtgtagccctggttgtcctggaactcactctgtagaccaggctggcctcgaactcagaaatccgcctgcctctgcctccccagtgctgggattaaaggcatgcgccaccacgcccggctttctgttatttttaaattatatatttgttcacccacccacccacatgtgtacgcgtgtggaggtcattagacaacttgggagagttggctttcttctaccctgtgggtcctggggatcaatttctgagtgtcagtcttggtggcaagaatctttacccacgaagccatcttgccagttctcaggatttcttactatttctaggactggactctagaagctggggtctgtctcctaagagatggctacagtctgacttgtcttggcgtctgtcctcagtactacccaggccatgagggaaagggattcaggagttcaccatactcttttgtggctcctggcaaaatgtttagcttggctatacagtgatgtttccagaatttaaaccccctttcaggagttggcatagttggtgcccttagggattccatgaggcttcactgtggtcttttctagaatgaggaatgcattgagattattctcaggcatgggacatgaggcaagtagggggttcagtgtgtcctagtggcagggaacctagctgactctgcgcatgcctctaggctgctcacatggttccaggtcatctactgtaactgtgtaaaggaagcccctttatttcctgcatctcctcctaaatcagctgcttaatggctttccattaaagtccttcccagaactcaacctggactttagagtgcctggctccagggccagagtttttgctctgctggtgagacatgttcctgagtactgtagtgccaaagtcctaccaccctagccagttctcctttcctgaccctcaaacttttcctccttcttcagatagccttagttggtgggatagagtatcacaccacggtaacctctttccgctcattaaaaacatgtgggcttcttgctttcaggaatatttaaacagtttcacaattctttttttattattattatatgtaagtacactgtagctgtcttcagacactccagaagagggcatcagatctcattatagatggttgtgagccaccatgtggttgctgggttttgaactcagggccttcggaagagcagtcagtgctcttaatcgctgagccatctctccagccccagtgtcacaattctttagcccatagttaagtaagtctaagcaataaacataggtttaacatatattgaacaaataatatttgtatacagaagctcatttgggtatctttgttttctggattgttttccaatttaggcaacatatttttttgtcgtattgttctgagtcttactagagaaagataaaaatggcttatatgtaagaggtaactggttctgtatatatattgttttgttttttatttttggtttcaacatgtagtcctggaactcactatgtagatgaggctggcctcaaattcatggaaaaccacctacctctgccttctaagtgcaaggattaatggtgtctgtcggtatgcccatttctaatctttaatttttcattgttttatgcaaattccatgccattagtattttgtttattaccttgtaacttttagatacaaagaagttcatgtgcttatttaagtttatgattagctaaaattttaactaatttaaaaaagtgttttcctgctaacagccgttgttttgttgaagcatactcagggctgtggagatggtgcagcatgttgttgccaagtctgatggcctggattctgtccccagaacccactcctgagagttgttctctgacctctatgtacatgtgatgtacatacacacacccatgataaataaattgaaaaaaaaaaaaaacattgaaaaccaactcccactgggcagtctttaatcccagcactcaggagcagaggcaaatggatctctgagttcgaggccagcctggtctaaagagtgagctccaggatagccagggctacacagagaaaccctgtcttggaaaagaaaaaagaaaagaaaagaaaagaagagaagagaagagaagaaaacgaaaggaaggaaggaaggaaggaaggaaggaaggaaggaaggaaggaaggaaggaaggaaagaaaaagaaaaccagctctttaacttgttatgcttagtagatgtgactatgttgataattttggtttttcttccatctctgatagggggacctttcctaagttacatgggtttgggctctgccatcaccttgctgtgtgtccctgggcaagtcactacaccttacctctgtaattgacatagttagctctatatggcctttatagttaacaaggagtcagagttaattaagtaactagcctgtagtttaacttgaaatcttaccttcctcttaattctatgttggatactctgtgtttacttaacctttacggaaacccaatgcaattaacattaaataatacattttgtagataaggaactgaagctgagaatgaccacttgtataacttggccaagaatacagaactaaccagctgactggagctgggcccagtacccctctctgagccctaacctgattttgctgaggtcaggacagggcataggagactccaggctgctgctgttgcctctagctctgcagcttaacagttctctcagactgccctgggcccaagtgtgtcttagcagtagttttcctgggaagaaagatccctcttctgagactgtgggccagtcctcacctcagtgccctgaggcctctgtatcagtccttggctctgtttggctaccttttgatactggctcccttggcctttgaacctaatgacttctgctcaggccagtgctccattctctttaactagtaagtttcaggaggtggctctgccttctcaagctcaagtctctggctagaccacctccctagagtgctgggcagagccagttcttagtcctgtccccacccgtcctcagcagctaaccttaagtgactgcatctccacccacccctggcctacagtcggtttctaatctgctccctgctcaggctgtcctcactgcaggagaggaagtctctaaagcaaacaggaagcgccagagacacccaccagctggaattgatagaccttttaccaggaaggacagcagtgtgaagttagggtatggagcagagaaaagaagcgtgaacattcctcacagggactaagaaggggcgatattgctgcagcccttggtgtcttgaaggcttcagcttagaaaagtgaggccctgccccactcagtggttgctcatgtatgtcagtatggatttgtctgccttcccttctcagctggagctcaggtgtgtcagtcagctacttctgtttgtttctttgagacggggtctcactctgtagtcctacctggcctctgaccttacagagctccccatgcctctgcctctgaggagctgattttaaagccgtgagttctagactccagagattctgatgtagatggtctaatgtagattctgaagagaaaagtggctactgacctgaggcacccagagtacagcaacaatgaagagcaatgtcctgattgtcctgtttcttgtccattcttagcatgtgcacagactgtagtgtccagggccctgagcttgcttctgccccttcgtgtgtattattgggaaaagacatactaaatatggtgtttccccaagtccttccacatgctccctttctatgaaaggcatgaagttggggttggtgctcactcttgatggtctgtgagtgaaccaggattcttattgagggctgggaatgggtcttgagggagtcctttgtcatgggcctgaagtttcaccattgccaaacattcaggggaaaagattgttactcatcctacgggcagctatgttggtgcctagctcttaaggacttgatttctttactccaaacaacttaaacttattctgctacttgatttaaaatatggaatatctttgctactagttcaggaggaaagattccttgcacacatatatgtacaccacacatgcatacacgcactatacacacatgtaaaattaattaatataaatgttaacagtgaattaatctggcagctgtatttctttacctttgctagtcttcaaaaacaatacagagaagccaagatttatttcaagctatatttcaatagctgggtaatattgatttataaataactcctatgcaaatttggctacctaccagccatgatcccagttaatacttgcagatttagctttctgctttagatgtttcttccatgatatcttctcagaccccttccttctctccccaaactccaaaactcttcctttcctctctcttcccttggctagtagaagtttcttgcccaactgttgtgtgatcagcatttattgacaaggctgagaataaattgtaagaattgtttacacaaatttgagacagattctgaacctaagcattacagtgctgtgtttggattgaaacaagatatgagagcagagaagtcagtgtttgaacaacacaacctttacacactgcacaaaatattatgcctatacatatacacatacaccacatctactacataaacccatacatatacaccatgcatacatatacatacaccacacatacataacatacatatacatacactgtacatacatataccacacacacacaccacgtgcacatatacaccacctgcacatgtagagagaatatcttgtgtattatatgggtgcatcatctgtcaattaaaaaacttccggcctataggaaaggatagaatagaaggtggggcatccagtaggcagaaagaattctgggacagagcctggcatgggaagagtcaccagagaaacatgaggagatatttggtccttgagtagaggtaactaggcatgtgacaggatgtagattggtataaatgggttattttaaattattagctatatggcttaggtatttgtaaatatattttgagtcttgagttgttatctctggggaacttggggctgggaggaaaatagcctgttacacacacatacacatacagcacacacacatatacatataccacacccaaatacaccatgcgtgcatatacatatgtcacatacacatgctacacacacacacacacacacatacatgctatacacactcataccaggaggcaggacagtgcaggacatgaattaattcacttttaccaaccaccaggggtatatcttctggttttctagccttgggagtagacagtgtaagccttcctgagaacctgggtgtggcctttacctgtttcagacatgctcttatcgctgcattacttcatgacaaaaattgtcttgcttagtgctttattggctgaaaaggtcagacacttctgctcatgtgatcccttcttggggccaggaaagcctcgaggcagtagaccataaaaggctgtgagcacctgctcaggggttcctagaggcagggccagggggacagcagcacctttcagcagccaatttaggccaactgggtagaacttgctcagtgtactagcaaagccagggcctgcttaccagtctgtggagaaggtgctacactctgggcagacacactggcattaaccctgatgtgccctgtcactaattgtcctggtttgacttagctcaggtggcttgtgtgaggtaacccaggaatgtgacgagatagtcacactcctggcgcctcaagctgggctttgtttgcttcatgctagctgctcaagccctgtttgtatctcagtggtacttgcagatagttggctggctctgttctgagcctggatgagcactcccggccagccccacagatggcttccacatacagataaggttgagaattgttggtgagaactcattttctccctttctggcttaaaaaagaggaagaatgagaagaagcacatcacattctggctgggcaggtttacagggctctgggttccggagggacgacacttggctttcgacttgtaggggcaggaaggttgctgccggtgccagtagttgtctctcttccacacctgctgaggtttcttgcagccagggttttgcttgtctgttccctgccccactccttcatacttcttgtgcttgagctgaagtctgccctgtgtcatgtgcactcggggtaatcaccaacttgtaaattccactgtgtatcagggtcacttttgccaggtctggactttgctgagccagtggaactgctgcagccactcaaaaccaacaccaagggtgggcatggccctcattgttcttccccagcagggagaacagcctgataacaaatgagcttgtgtgtaggaacccaagttacatcccagctctgtcacttgtatactgaatggccttgacctgggcacttaatactgtcgttatatctgtaaaaatgggaggttatgttaaagcttcaaagagataatagtgcagttctccatgagtactggctctgtctttcagactgatttcctgaagtaagtactctgagttcctagaacatgcatgggcattgtgaggaagctctcccgatgaaactgcacgggccttgtctttcctgtctgggtgaatgagaaagcatcttacctatgccatgtctaaatgacatttctggttagtaatcatattgaagattgcaacccccacttccttccttgtacttttggggaagaggtggcccccatttcaaagcttttttcctttggtgctgcccagaaaggaaaccgttgctcctggttagtgagtcattcttcctgaagctcactttttaaatgagttgctgggagattctggatgtgcaaaaggatttgaggctgaacaaagcaggccctttgctgtcagcttctgcaggggcaccgagcttcccacaggcccctgtccatcatgctcctgctctgggccgtaggggatttactcctcctgttcagggccaggtcagctctcctccctatgtgtgctcagtatcttttggtatgtcttctagagccttctcatccttctgtgcagtttggaagcttccaaaaagtttgagtttctgcagttgagtgggaaccacaggcctggaccaccagttgctaagggtgtgggtctcagtgtcatgtttgcctccacctacccccatcttccccctaagctttctttgtgtcaccccttactctgccagcagagaatggaagctaggtctctatttaaaagggagagctggcagcagagactgggggcagagctccggcctcagagcatgtttggttttctgtgtggtttgttttttaatgtgtgtgagactgcaggcccatctaaaatgagaagactggggaaagaagctgaggaagagcgagggggcattgctttgattctgatatacacagttcagcctcagaaagccaggaaagtcagtcagtcgttctactgtgtggtacaagcctggtcattctgataactcgaactggccaggccttggtctctgagtgcccataagcaccttatctgaggagctggctgccaggacctgctgtgcttcacccacctccccacacactgctcctgcgcagagtaggcttgtgagcatagactacaatcttattgtttgatgacctaaatcctagtcgtcttcctgggcccttttttgggggagagaaggtggagcccagcgagcctgatgactcatgctggcatttatttctctcttggattttgtaagtgaatttatgtttttgagagaaggaagtctgagtttttgcttaggacccatgagcccaatattgagaagccactttgcttggtactgctctgcaggaaagagtatagttgagtctagtgaagacttgctgttcaaccctgtggaaagggctggaagtctagcggcaagagcagttacccaggtcctcagggaggcacctgttgacagtctcattctaactccctatttctgatttctccctgcagttggaggcctcccttcccattaagtgcctctttgcatagcaccggccccacccccacgctcactggtactactacagagcagcgcgccatggcgggtcgaggaggtgcagcacgacccaatggaccagctgctggcaacaagatctgtcagtttaagctggtcctcttgggcgagtctgccgtgggcaagtccagcctggtcctccgctttgtcaaggggcagttccatgagtaccaggagagcacaattggaggtgagtgagcaaagcaagtcaggccagaggggtctggaggaaggctgcacacgcagaaaccggacctgtctggcctgggaacacctttttgtcaatgggccctggagttgaatccagcagtcagtcttcatgcttcgtcccaaaaagcaagagtgctaagaattacctagggattgaaaactggcttcctgctctggtctggcctctttattagttgtgtggatgtgaggtctttttttttttttttcctacagggcagtatatatgtccattcctctgctgctgacctttgttctttctctgattccccattggtcagcatttaggatgtgaataagctctggactcagtctctcacgtccgtagtcagtgtgaacctcaagaggccagggccacccttggttttgagtcatccttcttctctgctctcttggttggtaggagatttccaggcagctggaaacagaataagccatgtcagcagtcttctcactgcctcctcagctctgtcaggagctagagagggggaagtgcgttggcagtccaggctcctcagtgggctgggggggcgggggggagtggtaacaaggaaaaacagcttcccacagaactgtcataatcctcggctgggtccagggtatggggaaccctacctgtctacctgtctgtcccagctccaggattctccttcaaaacatgtttgccttagcctctcacatctgtagtcagtgtgaacctcaagaggccagagccacccttggacttgagtcctttctctgttctccttggtaggagatttctaggcagcagaattcctgtctcaggtggcatctgtattcaaaccacgggcggctatacaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgcctcccctttctagcccctgctgtgctttgcaggatggctctgaaatggctcaagtgcaggcacttcccagacaacacacaggagcatgagccccacctgccctgtgtggacaggcttctacatgccagaagcaacaagcaagaataagtcagggtggtttccagttcttccttgcctaatgacaccaccttttctcttgcagcggctttcctcacacagactgtctgcttagacgatacaacggtcaagtttgagatctgggacacagctggccaagagcgctatcacagcctggccccgatgtactatcggggggcccaagcagccattgtggtctatgacatcaccaacacagtaaagactttccttcttttctctttgtccttcatttctgtaaatccccaagaactgggttataaaaacctcatttggggggctagagagatggctcagcagttaagagcactgactgctcttccagaggtcctgagttcaattctcagcaaccacttggtggctcacaaccatctgtaatgggatccgatgccctcttctggagtgtctgaagacagagacaatgtactcacatagatgaaataaatcttaaaaacaaacaaacaaacaacctcatttcagaccactcagccttctgttcggggtggtgtatgggcggatttcctgttgactggaaaaagagcataagaatctttaggggtgatgtttcaaatgcctatggctatgccagtttgcatttgcaactgagtaaccctgagtagactatttcctttgtccctttgacattgccatcctgtctcctcaggatacatttgcacgggctaagaattgggtgaaggagttacagaggcaggccagccccaacatcgtcattgcactagcggggaacaaagcagacctggccagcaagagagctgtggagtttcaggtaaagtgacagaacttggggaagggtgcattggctctgtaagggaggcctctccaggctgcctgggccctgtaaggtgacaggcagtggcagctctcatctgctgtcctctcaggactcaagcacaggccataaaggaattgtctttgtgttgtgggagtgggtggataggtaatatttctgcacgtttgctttgtaagccaaatggactgaagcagtacttttttaggcaatgcatgcatgtaaacttcaaatactccaacaaggcctagagaatgagtttagtgtctttaatcctagaaacttagcctctcttatccagaattcccaggttttggttttcccaaaaatgtacatatcttttactttacatcatggatgggaatatgctgtgtaccacatgtactatatgttacagtgtcctatgttttttgtaggggtggggagcaggaagtatctcatgtagtatgtagtagcccaggctgctggccttgaactcctgaacctcttgtttttcctggggttacaatcatgagcctccacacccctcagttcatctttttccagtcctaactcgatggcctcctggattgcttataaccgctgaggactagagacagtgctgcaggtggcatccacatctgctcatgcttttgtccagatgtgcaggcatagtgcaggagatctctctccaggaggatctttcgcctggtgattttgaagaacaagtagacagagaggacctagggaagctattaagaatctgccaatatttgtgaactgcgaggtgtggcgtgtgagtggagagcaggtgatgctggtgttttggggaaacccagaacaggggaaccctaagcctgaaacccctgcatttgcccagtcagtctcttgatttataagggcagagaccgaggaagatcttatcctgggtcttagccctgccatctgccatgttcccctcccactctcttcctcacatgcctgagtcaggaagcacaagcctatgcagatgacaacagcttgctcttcatggagacgtctgccaagactgcaatgaacgtgaatgaaattttcatggcaataggtaagttgtctctccctgtccttcccctgagcagaacaggaccctgtgtgctagtctctagtgggtctgtgggatatcttccccagcagaatttttaccatttaaacttataaaattgagctggagagatggctcagtagttaagagcaccagctgctcttccagagatcatgagttcaattcccagctcacaatcattcgatccgattctggtgtgtcagtgacagtgtgctcatatacctaaaattaaaaattttttaaataaaattaactggtaaaatcgtctgactcccagatgcaaaactttctaatgcctggaccagtctaagtgttattctccctgcccatgtcagagccttccattgccatgtcttcccccataggactttagctcatttgcctcaggaatccttctgtctatgagttcaaatcctggcaatgccggttgtcactcgggttttgggcaagttctctgcttcagtttctagggacacagtatacctggcacacaagccctccagtattctggctgtcactgagtaggggagagtgttagggtgacctcaaaacctacttccccttctctccctaacagctaagaagcttcccaagaatgagccccagaatgcggccggggctccgggccgaaccagaggtgtggatctgcaggagagcaacccagccagccggagccagtgctgcagcaactgagcccccttacctgccactggccccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccccttgccctttgctggtagtagcctgctcctgtgctcctcatccgtggggacagggcttggagcagtcaccctttcttcccttcttgctggagagcggactcagcaagagcacccacatcttaacttgttgggagcgtcttaggctggggcagtgggcaggccctgagctggggaagggacaggctgctcttccctcagctggctgtcaatcaggctgcagcctcctccccaactgactcccagctgggagagaaaccgcagcattacttaagcatcattattgacagccggacacccatggcccaggatccctccacccttggtcactctgacctctggctctgagccctgttctgaccaaatcacgatgatgagtatttgggggtgggtgggtaaggggggggagtgggagggatggaacccaactttttctgtattttgtattgtatgttttcttcaccatgtaaccaatcagtatcttgtcaatatagtcagccgatcgatcgacctcacgcttgtcttcctcgtccttctctggcagctgatcaggccatacgtagcctctctgtttttcctgaagttaatttaaatgaatcatccaatctcattaaatggctctactccctgtgtgtgagaggatgctggtggtcatggtaaccaaaagaaagaagccctgctgttggtagttctgatggtggaagaggataggactgacctggggctgacatctgtctccccccagcttacattaaaggatatgcaacctgtatttgaagattgttggtgtctgaagtgacctgtgagggttttttgataggacctaattaggactcagaccttttttttttttttaaatatctcctctccctgacgaggaacaccgagtactggtcgtaaggccggtgctacagcccatcactaccactgtccttcgtgacacctccatgccaggttcaacactgtccatcctggttcagaccatctgctgattctgaatggcaacagctaggctgtcccagctctctgctgctccctgctggagctattgctattggctaaatccatacacacccctagtttatctcagggccagaaacttgattattgatgtacttactaccaccttgagttccctcccctggtcaccctactccctacagctccaacccttcaccctcaggaaaaaagcaggaggacttaaggctgctgcacacctcggtttaatacattagggtaggttgtagtgcctagggcctcccctcctgagtctcagggccgagtctgtttgggcttcaactcttctcccgcaggaagaacgctaagagactctaaggattcttcacactttcgttttgtaaggagctcttaggccctcccctcctgggtttctgggactggcctgtttgagcttcagggggaggtaggcacttgttttgtcccctgagccacagatggccagagggggtcaggctgcaggtcatggctgcaggatctaaggtcggcgggagctgcatttgtcggtgaacactctgctccatgcggtagcggcccctgctcgggtcattcgactcgtgttgccgctggccggtcaccgtcagattctggccgtctatccgcaccaccaagtcctccggagcgaaaccttgggcatccacctttatttggaaacttggttgctcacagccattgccctgcacctcatccctgagcagcctcactggtagagtggccacttgattccgttcagcaagggccacgctgggacatcgggaagctacccggttttccccgggttcgcgctgcccggtggagaaactgcttcctacccgctgcatccgagagtgcaactgctgcctgagggcgcgagggctccccaaccccccatccggggcgggtgcgaagaggaagggcccgcccactcttcccatccagaagggcaaaaacactcaagtcgctgtcttatcttccttgcaagcgctgcagcttttgtccagaaccggcttctgcttctccctgggcccttctctcacatcagagggcaggaaggaggctatgaaggaactggatcacctgaatgtgcggggttacagctccatcctgggagctgatgggattgagcaacggggttgaaaaggtctggcttgctctgccctgccctgccctgccggccctgccctaccctgcccttttaagaatcgggcctggggcaaggaaaattgttctctggactgagccaaaagagggggcctttctgatcttccaggaagaactatccctgacctttcacagtctacctctacaatgggaagaaactgtctatttctctggctttcctccacccccacccccccattaaggagtgggcagggaaaaagatggaggtaggatggaagggtatgaggtcaggaatcctctccatcttcaaagctgcctaggcgagccagaagaggggaccaccccctaccctccgcatcttcagtgttggtctctctggttctttagttctcagcacacacaaacacactcccccccccctttcctgcccactcccaacacacacacacacacacacacacacacgaatgcccgtgcatgaacacacacattcaacagcagcatggcccacaactatgtctctttgttcttttgaaaataaaaccgtttctgtttaacagcaacccaagtatagaaaaagctgattgtcactgggcagtgatggcgcatgcctttaatcccagcacttgggaagcagagccaggcggatttctgagttcgaggtcagcctggtctacagaatgagttccaggacagccagggcttcacagagaaaccctgtctcaaaaaacaaaataaaacaaaacaaaacaaaacccaaaaactgattgtcaaagttaattcataagtgtgaacaccacagtacaaatagtagaattaatgttacattttatctctattgtagctgcaagccttagccggcagccacaatagggcaggcttttgcaatgtgggagccaacctcaggcccaggcctgttcttccacctatggactttaaaagggcagcatccacaaatcctccagacggccagtgttctggggtgcctcttgttcccaagaggatagtaattgtcactatctcggatggcttaaaaaagattagaatgaagtaatggtcaaatctaggatgctcaaccaagcgacatttggttgtctggaaccaagaaaaaaaaaagtatggaaggccaaaggatgggaagcggcaaaggaagactacgactcccatcgtgcgccggggccgtgacgcctgcgcactgtgcgccggttgcccatgcggccctagggctgggagcgcggcgccgctccgctgcgggggaggccatggcggaaccttcccaggccccaaacccggtcccggcagcgcagccccggccccttcactccccagcccctgccccaacttcgactcctgcgcccagtccggcttcagcctccactccggctccgactccggcaccagcccctgccccagctgcagccccagctgggagcacagggagtgggggcgccggggtaggaagtgggggggatccggctcgacctggcctgagccagcagcagcgcgctagccagaggaaggcgcaagtccggggtctgccgcgtgccaagaagcttgagaaactaggggtcttctcagcttgcaaggtgggggcggggcctagggcaaaaggggcggggcttggggcatccaaggtctggggtaggaatggggggcgaagctctagccatagagccgctcttgcgcttgggatgcagacagcatcagggaactgaaccttccccctccaggccaatgaaacctgcaagtgtaatggctggaaaaaccccaagccccccaccgcaccccgcatggacctccagcagccagctgccaacctgagcgagttgtgccgtagctgtgagcaccctttgggtaaggcaggcaccacctttggagctggggcggagggcaggagccaggtcctgtttgaacagggtgacataagtaccacagagcttcttggagaccttctaaggaaatattgggtagggaataaatgtgaatgtcccatggaaggaaaaaaggagatctgccttggtagcaggtagctaccaagggctgatgggagaactgagaacactgggtctccctgtctgtcaagaattggagaatcaagggtgtgtcactggctagttagaggaggtacaggaatcaagccccgtggagctcttctgttcttcccagccctaatgtaaccatcttgcagcggaccatgtgtcccacctggagaatgtgtcagaggacgagattaaccggctcttgggaatggtagtagatgtagaaaatctgttcatgtctgttcacaaggaagaggacacagacaccaaacaagtctatttctacctcttcaaggtgagttctcatggagtaaagatggtgaagctttggtgtgtgttggggatcctgctctctgagctctgctactcctgtttctgcccatccctcttccttacagctcttgcggaagtgcattctgcagatgacacggccagtggtggaggggtctctaggcagccccccatttgagaagcctaacattgaacaggtagggcgggcatgtagcaagattaaaggcgacttaagagggtggagagtctggtttatttcctcaagctgagaacaggggagaggttcaaggaagggacatggtgtttgctgacctcagagtgggtgtggaagttggaagggtcagaggttctcttcacagaatccctcctatttgacatgcctctgttggctgtccacacctcctcctgattttgtcccctccttactcctcagggtgtactgaactttgtgcagtacaaatttagccacctggccccccgagagcgccagacaatgtttgagctctcaaagatgttcctgctctgccttaactactggaagctggagacccctgctcaattccggcagcggtcccagtctgaggatgtcgctacctacaaagtcaattataccaggtaagcccagacagggccttacaggggaggcttgaacagccagtctggcggtctccaccctcacctgccgctccacctcccccagatggctctgttactgccacgtgccccagagctgcgacagcctcccccgctacgagaccacccacgtgtttggccgaagccttctacggtccattttcactgtcacccgccggcagctactggaaaaatttcgggtggaaaaggacaaactggtgcctgagaagaggaccctcatcctcactcacttccccaagtaaggctcagtctggcctcctgggattttaccccaaattcatgtccttgctgttgtccccttttttccaggaaggcttcctggattggtccctcctctccctccatgggccttctgggatctgggtgtctacctggcagatttgcccatggcccagaagctacttgctagtatgtgctagtctggggatggcaggtacatggcccaagctaacgctaccctctttcagccccctgatagatagttactaattagtttcctctgggtgtgtggatatcaccccagagcccctcctaccacagtgctctgagaagtctagagtttactttttttgtttgtttatttgttttttccagacagggtttctctgtgtagccttggctgtccgggaactcactttgtagaccaggctggccttgaactcagaaatccgcctgcctctgcctcccaagtgctgggattaaaggcatgcgccaccacgcccggcttagagtttacttttgaagtgaagccattacctatctctgtgcctctgttgttccacatcttcttcccatttgaatctgggaacaagcatgtgggaacaagaggtgacaagattggctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtggtggggtatggtggcaacgggaagataccttggggctcagacagggctgagatggcctggatgcttctaaaggccctgccatgccctctctgccacaccctccactccccccatgcctggatttcctctctcttgcagccacggtcagtgcaacagttgtacccagcttcagtccttccatgggaggaggcagcaacagctccctgagcctagattccgcagggactgagcccatgccaggtgggtacttggccactggccactggcccacattcacccttgcctccacgtttcctgctacccccggggtgaccctgtcatcctccccagcaggggagaagaggaagcttcctgagaacctgaccctggaggatgccaagcggctccgcgtgatgggggacatccccatggagctggtcaatgaggtcatgctgacgatcactgaccccgctgccatgctggggcctgaggtagggagcccagtctgttggcctgtgggggaggggatccccaccttcactccaccccaaggcccttgctttacaccttcttctgcctagacaagcctgctttcggccaacgcagctcgagatgagacggctcgcctggaagaacggcgaggaatcatcgagttccacgtcattggcaactccctgacgcccaaggccaaccggcgcgtgctgctctggctcgtggggctgcagaatgtcttttcccaccagctgccaagaatgcccaaggaatatatcgcccgcctcgtctttgacccgtgagtccccggggaggactccagcccctgagctgcttctctttccatcccactacaccggacgctctcttaataacagggctccacctttcagggttccgttcctgccctctgttctcatccctgatgacacttccctctttcagggctgagggacctggggagcgaggagaggacaggtgagttccatgacatgtcccctctctcttaggaagcacaagaccctggccctgatcaaggatgggcgggtcatcggtggcatttgcttccgcatgtttcccactcagggcttcacggaaatcgtcttctgtgccgtcacctcaaatgagcaggtcaaggtgagcacagtgcccctggccacaaccccgttctaccacccacctctgaatatggaccaagccagccaaaatggcagggtatctgtgccccagcccttcttgtagcgaccagacatttccacatactcccacagggtggcagctttatcttgataactgatcattgagaaaatactggtttttaaaaaaaaaaacgcactacgctgggcagtggtggtgcatgcctttaatccaagcacttgagaggcagagacagggatctctccacgttcaaggccagcctggtctactgtgagagttccaggacagccagggctacacaaagaaaccctgtcctgaggaaacaaacaagaaaaaatacccaaagcagcagtgatttttgttttgttttgttttgttcttttctgatgttgggatagaatgcagggccctgtgcacgctaggcaaatgctctaccagtgagttctactcccaacaatcaatatttttatgttaaccttagggactttctgtttcagagaaggtctcatgtcgccaagcccagccttaagcaccctgtgtagtcccggggaccttagacttgtgatccccttctcctgcctccaggttgctagggttacaggtgtgcaccgccacaccgggtcttatccattgccggggactgaacccaggtctttgtacactctgagcaggtgttgtactaactgagctctaccccaaggcagccacacttttaaagtgacccttggtttcttcacaggaacatttccataccttggggaagttgatagtcccagcttctgtctttctttttacaacaaactccttttgggcttttcattctcctgttttgtgtcctgacatgaacaggcctctgtgacccctttctgctctccccctttattctaaaaccccaggtgtggggccaacagcggtgttgggttggagcccagctctgctgcatccgttcgtggtccactgacctcagactgttctttgtgtaactggctttcaggggggttttttggtgttgtttttcccgtgaaatggggcttttaatacctggtcgtgggctaactgtcaaatgggtctttgaagactcaagtgctgagtctggccctgagcaagcacctagaaagccttccctccccctccataaacactgagcctctgatagccacctgtcctctctgccttggcttccccatctcctttccaccctgttccatcttccccacagggctatggcacccacctgatgaaccacctaaaggagtaccacatcaaacacagcatcctttactttctcacctatgctgacgagtacgccattggctacttcaaaaagcaggtaagccttggtctcaccaggctcatacctgctgcctggggccctgatttgtgtgtgcagcatccagtagtagagtcccctggcaccagtgagaaagggcccacccctttcttctccctacctttgccacccagtgaagaacaaggccagggattggaaggtcctttgggggatggcaagaggtgaggagcagccggcctgcagcctttgcaggggcagggacggttctcacactgctaccctgatgatcagagatacaggaagaaatgcactacgtgctgtcttctcagtcaatcctggagaagtggctgtgaacgttagcgagtccttgctgatggactgtgataactctccactcatgtagggcttctccaaagacatcaaggtgcccaagagccgctatctgggctacatcaaggactatgaaggagcgacgctgatggagtgtgagctgaatccccgaatcccctacacagagctgtcccacatcatcaagaaacagaaagaggtgtgtatgtctatgtgtggtagagacaggccaggttttaggttcctgccctgcctcttagaaaaagccaaaagtaaatgttaccatttactgaccatggtcttgggggtgattgggcctgagttggccccctcagaacctcgcttcctcagatcatcaagaagttgattgagcgcaaacaggcacagatccgcaaggtctaccctggactcagctgcttcaaagagggagtgaggcagatcccggtggagagcgtccctggcattcgtgagcaggggccttggctgagagggcaggggggcattctcagggcatgggtaggcattctgagggatgctttctccccctctgcaggagagacaggctggaagccactgggaaaggagaaggggtaagtgtccattcagtcaagggggagtgaccacaggaatggaggcgtgtgtgcgtgcgtgtttgtgtgtgtgtgtgtttgtgtagtagggcaagaaggacccagacctcagcctcggtatctgtcatttccagcaaggagcttaaggatcctgatcagctatatacgaccctcaaaaacctgctggct

SEQ ID NO: 992 - DNA, 851 bp, Mus musculus
  misc_feature (1)...(851): n = A,T,C or G
ctgggacaccgccgggggtgggggggagaggagcggagtctgtggaagccccggcccaaagtaacgctgctgcccggagccgcgttggaggcctcccttcccattaagtgcctctttgcatagcaccggccccacccccacgctcactggtactactacagagcagcgcgccatggcgggtcgaggaggtgcagcacgacccaatggaccagctgctggcaacaagatctgtcagtttaagctggtcctcttgggcgagtctgccgtgggcaagtccagcctggtcctccgctttgtcaaggggcagttccatgagtaccaggagagcacaattggagcggctttcctcacacagactgtctgcttagacgatacaacggtcaagtttgagatctgggacacagctggccaagagcgctatcacagcctggccccgatgtactatcggggggcccaagcagccattgtggtctatgacatcaccaacacagatacatttgcacgggctaagaattgggtgaaggagttacagaggcaggccagccccaacatcgtcattgcactagcggggaacaaagcagacctggccagcaagagagctgtggagtttcaggaagcacaagcctatgcagatgacaacagcttgctcttcatggagacgtctgccaagactgcaatgaacgtgaatgaaattttcatggcaatagctaagaagcttcccaagaatgagccccagaatgcggccggggctccgggccgaaccagaggtgtggatctgcaggagagcaacccagccagccggagccagtgctgcagcaactgagcccccttacctgccactggccccactn

SEQ ID NO: 993 - protein, 252 aa, Mus musculus
RCCPEPRWRPPFPLSASLHSTGPTPTLTGTTTEQRAMAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNAAGAPGRTRGVDLQESNPASRSQCCSN

SEQ ID NO: 994 - DNA, 50002 bp, Homo sapiens
  misc_feature (1)...(50002): n = A,T,C or G
cctgcctcagcctcccaagtagctgggatgacaggcatgcatgccatgcctggctaatttttatatttttagtagagatggggtttcgccatgttggccaggctggtctcgaactcctgacctcaggtgatccacccgcctcagcctcccaaagtgctgggattacaggcgtgagccaccatgcccagccaggctcctccctttagaaacaaccccctcatgtgctcctctttcaagcccctctctggacggggcatcatgccctgggggttcctcttctctcaccaaatgtctcctgagtccactttgttttaggctctgggccaggcctgtacattacaccttgggccttggtcttttgctgcttttcagtctcactttgatatgcagtgtttgtttgagttagggttatagtttctgactcagctccacaaaagactccacattctcaaccccataacactgttgggtgggacagggagggtctgcgctatggccgcgggaaggcaggaatcagcttgaactctcctatgtccccacagggcctcagccgcttttcccgatcccctcgcctctcccaggtaacacccacttcctgggtggggttgaattgccctggggagagggtgagatgggtagcagcatccccctttccatggatggggagctgcatccgccggcgaaggctcttacttaatgaaggggtctgttgttcactgtcctgcgacatcagctgccccctctgcccgcagccccgctcagaaagcctcggctcctcctcagacaagacgctgccatccatcacagaggccgagagtggcgcggagcctgggggtggtcccaggccccgacggcccctcctgctgcccaacctcagcccagcacggcctcggggctccctggtcagccttttgggcgaggagctgcccccattctcagcccttgtctcctctccttccttatccccatccctgtcccctgccctggctggccagggccacagtgcctcccctcacggcccccccaggtgctctgctgcctggaagccccctcagcttctcattcccccactgggaacctttggacctccggacctcagtccccggtgagacgccagcctcccctgctttcccaaaacccctattggcttccagaaccttctctgggctctatccctggcgttccaaacagtgctacattccgtctctgcccgtgtgcccaccgcacccttccaaccacagcttgcaaccccaacccactttgactgctgctcttgctccgccccctggcactgctgcccccagtccccctctgtctgctctgctctggcccttaccctcaccccatggtgctgatgagcactgccctgttcccaggatagtggatggcattgaggactctggcagcacagctgaggccccttcattccgattcagcaggaggcctgaactgccaaggccccgctcccaggcgccccctacaggtaagggccaacagtggacttcaaccccgtcatccatctgcccatccacctgtccatccatcccatatgtagtaggggcctaccatgtgccaggtgccatcctgggaatacacagataaaacagacctggcccacgctcttggagtaagtctagcagggagacacctctgtacacagataaacaattccagatgctaaataccatgacagacaagaacaggactctgtggtagaagaggaaggtgctcactcgacttccttgcagaggaggggatgcttgggttgcttcttaaagggtgggtgggatcttgaagagtggagcaaaacagttattgagctgggcatggtggttcatgcctgtaatcccagtactttgggaggctgatgagggtggatcacctgaggtcaggagttcgagaccagcctggccaatatggcaaaaccccatctctactaaaaatacaaaaattagccaggcgtggtggtgcacacctgtaatcccagttactcggaaggctgagacaggagaattgcttgaacctcggagacagaggttgcagtgagctgagagcacaccactgcactccaccctgggcaacagagtgagaccccatctcaaaaaaaaaaacaaaaacaattgttgaaaggcatgaaaaccagagggatgctgtgttcagacaccaaagagaagctccgtaccaagatggggcaaggggcaggatgaggctggagagttacacaggggcctcagaaccaggctaaggagtttaggtttcccatcttacagaccctagagctttgtctccccctgctctccgcctgcccaatgacaggaggattccagcccaagttataggctcaggtattaatgctccatgaactcacctgcatcccttcaccctgcagggaccaggcccagcccagaattggccagtgaggctgaggaggtgaaggaaaaggtttgccggctgaaccaggaggtgggttggggctggctcagagacgtgcctgatataacagcatttcagaccctacacgtggctcacttgaggtcaggagtttgggaccagcctggccaacatgatgaaaccctatctctgctaaaaaatacaaaaattagccaggcacctgtagtcccagctactctggaggctgaggcaggagaatcgcttgaacctgggaggcggaggttgcagtgagacaaaattgcgccattgcactccagcctgggcgacagggcaagactctgtctcagaaaaaaaaaaaaaaaaaaaagagagagatattcacgctagctagatgaccttgggcaagtcccacaaccactctgaacttaaaccttgggcaagtcccacaaccgctctgaacttaaacttcctcatctaaaatggggaaatagtaatatgtgcttcccagagttttaaggatgaaatgagagtgcatatgtgcctggtccaatccctggcatgtcataggcactccgtaccagttggtttccttcctccccgactggctcaagtttcccagcctgataagagcatctcttctccctccaccactgtaggactctttcctgcccaggccctacctctttcccttaccccagccgtgggtaatgagtgctaagcagatgcaggggcaggggacagggaggctgagaggccttcaggcctgggggacctggatccagatgtctgaactctgtccaggaagaacctagattctatatgctgaggctcagcctctgcctcctccccaagggatctcagagttgtcaccgcagagcaaccaggcccagcccctgggagccagccttccctgtgttctgataaacatcgggcatcccagaggggcggtgcctgggctgtttcaggccctggggcctgagcggggctggctcttgttcagcaagcttgagggcaagtccgctcaaggcctcaggcatccctcaattctaggccagtggttcccaaacaagtatctgtcagaactacctgataggccgggcgcggtggctcatgcctgtaatcccagcactttgggaggctaaggtgggtggatcacgaagtcaggagatggagaccattctggctaacacggtgaaaccctgtctctactaagaatacgaaaaaaattagccgggcgtggtggcacacacctatagtctcggctacttgggaggctgaggcaggagaatctcgtgaacccgggaggcggagcttgcagtgagctgagatcgcgccattgcactccagcctggcaacagagtgagactccatctcaaaaaaaaaaaaaaaaaaaaaaaaagaaaaagaaaaaagaactacctgacaacctattaaatgcagatttctgggcctcttaggattgggaatgtctggggcggagcccagaaatgtgccttttcaaaagtttcttagttgattctctagtcgctgaagtgtgaaaagcactgatagagacccttgagcttgtgtgatgggatcagctgagaataataaggctgtcacttcacagatgtgtggcctctttgagcacattttttaacatcttgggaaagctcgcgcgcgcgtgtgtgtgtaggggaggaatagcaatatctgctgccccaaatcctttctggaaagagactggggcattttccatctaggcaaaaataaccctcatcctgcctttttcccagggtggccatgagcagaaagtggctgcgaaagagctttgtaaactggagaggggggtgcaccttgttattactgtggcacctgtgaaacaactcgatgtgttttcaacagatctctcgtctcaatcaggaggtgtctcagcttagccgggagctgcggcacatcatgggcctgctgcaggccaggctgggtcccccaggccacccagcaggctccgcttggaccccagaccctccttgtccacagctgaggccaccatgcctctctccttgtgcgtccagaccaccacccagcctccaggatactacgcttgctgaagttcactgcccagccagtgtggggaccatggagacagggactgcgctcctggacttgagaccttccatattgcccccctacccctcagagcctgaccctctgggaccctctccagtgccagaggcctcacccccaaccccaagcctcttgaggcacagtttccagtccaggtcagacacgttccactgaccctggcccagggcccaggcctgtctggggtgggcgctgccgctcaccactcagggaggacctgggccccttggcttcctgccttggggtcagcagccaccagctggcctggttggctctggatttctggactttttaatgaagcgtggttacctctgacgctattcccttttccaagccttccccaacctccccctctgtgaggggagccacctgagggctgtggaacccagcaggcatgagatgaaccgcagtgcccattgggctgggcagatgagatcctactttctccccaggacctggaggcaggtagagatgggggagcagaggggatgggcaagggacccagctccagcctaggacatgaagggaagaccagacaggatcttagcgtctatagcaagagagacaggttgtaggattttgcctgaagatagcttagtgatattgtgaggtcttctgtctcagcccctgggtctctgctgaagaccttaagagcaatgttacctagagaggggtaggtttgagatgttgcttggaatttgagcaacccatgatttcttaggccgcccaccatgagcccaggctggagaggctcacctcatcccacagcccacacaggaaacaaacggatggctccagatatgtactcttcggctcgcgcagcattattttcaaaatatgagttagttccaatattaaaaatgagacagggccaggtgcggtggctcacgcctgtaatcctagcactttgggaggccaaggcaggcggatcacctgaggtcaggagttcgagaccagcctgaccaacatgcagaaacctcatctctactaaaaatacaaaattagccgggcatggtggcacatgcctgtaatcgcagctactcgggaggctgaggcaggagaatcgcttgaatcccgggaggcggaggttgcagtgagccaagatcgcaccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagtgctgggattattttgaaaaatatttttcaaaatatttttcaaattagccaggtgtaggctgggcatggtggctcacgcctgtaatcccagcactttgggaggccgaggcaggtggattacctgaggtctggagttcgagaccagcctgaccaacatggagaaaccccatctctactaaaaatacaaacattagctgggatggtggtgcatgcctgtaatcccagcttcgcgggaggctgaggcaggagaatcgcttgaacctgggaggtggagggtgcagtgagccgagatcgtgccattgctctcaagtctgggcaataagagtgaaactccacctcaaaaataaataaataaataaataaaaattagccaggtgtagtggtgagtgcctgtggttccagctactccagaagctgaggtggaaggatgacttgaatccaggagttcaagaccagcctgggcaacatagcaagacaccccccccacccatctctatacaaattaaaaaattagccaggtgtagtggtgtgtgcctgtggtcccagctactctggaagctgaggtgggaggatctcttgagcccaggaggttgaggctgcagtgagcagtgatcacaccactgcactccagcctgggtgacagagtgagaccctgctcaaacaaaacaaaacaaaaaaaacctcaggacatcaggctaccgtgggccaacattccatctggcaataactggcaatcagctgggctgggtggccactgtcctctttagatgggatctgctctgcactctacttcgcagtcaccacgtttcttgatcatctcccgacacccagctagcttcccttgtttgaaatttttgtttggtctctgtgggtatttgagttctcaaaacttgagtgtccatcagaactacctgagatcctattaaaacgcagattctgccaggcgcggaggctcaaaaaaataaaaaaataaaaagcagattcctgggcctcatccaatttggaatgtccggggtggagcccaggggttgagtttgcaacctctgccttacctaacagtgtgttcccaggtccctgtgcccaacaggtgctttttgggcccagtaatgtctgcttctactcctaggcgtgggtctgtcaacatctctgtttctgtctctctgcaggctgtctctcaaggtggtctcttctgctgctagcaactcaaaaatcccaacagcactccctatcctttccctgaccccagaccgctgccaagcctgttctcccccattacaacatggtctcactcagggcctggactgctccaaaactcgcccaggtctccagctctcctctaccacccaacaccctgggctcacttttggataggaaataaactctttatttttgtagttattggctctgggtgtttctgggggttactctgagagccccagggctttggaggagccaacacagcaatcactccccaccctcaccttcgttgtaccccagggcccagttgctatctctaggaagggcagaggcaccagccaatctacttggcaccacattcacaccaccaggggccccagggttgaggaagaaacttaattagtcactatgggcctattatacccccttctctcccctgcaccccagtcacagccatgtatgcacacagtatgtgggaaggacagagtcctggctttggcccacctccagccttggaaaggtgggcctaggggactacccatccctcctgtataaggaactgttccagaactgggtatggcaagggggctgggggaagagcttgtcaccagccagaacctgctaggaatcccactctgccccatcccctctgtcctcccaacaagccctctcttccctcttccttttcacttctcatgaacactggcgcggaagtggggattgtgtgttatgggtgtaagaaagagagacgccctgatgaccagatggaactagatgtgggcacagttttgtggcaggttgtccaagacaggtaaattctccagctgaggctccaggatatgcctggtgttggcgttataggcacaatggccacagctgtctccggtgagctttgattccacacaggttttcagtagtgtcccttgaggatgagatgcaaaagaagaggaggtactggtttgtgttgagaggtaagggtgggaggaatcaggagcgggcccagtccatattgagaggagcagaaaaaacaaatattcctgatccatagagggggagagtgcagagtgggggtggttctagtctttatttacggatggagagggccgaggcagaggttgtccagctctgtattccgcgtcagagagaagagctgaccctggctaggagcaggggaaggcagaggcagagatggtctttgtgccggcccccgcacacaccaagtaggaggtggtggcagaagctctccctttgatctcacccagcatcctgcagagaactcttcctgcagcgctttcctcaccttcccaatcacagacgcccctggcaatcgggcggacagtgcagacaagggcttctccagatcagcgagttcacaggactgaggcctcgcgtgcatattcattcgcaccacgttttttctttcccaattctgcacacacaatcctctgccttcttccaacgctccaccacccgccttccctcggggcgtccggaaccggcggtgacgcggatggcagggttagccttaaaaagttcccggccgtaggctgggcgcggtggctcaggcctgtaatctcagcactttgagaggccgaagagggcggatcacctgaggtcaggagttcgagaccagcctggccaacatggcgaaacccccgtctctactaaaaaatacaaaaattagtcgggcgtggtggtgcgtgcctataatccagctcctcgggaggctgaggcaggagaatcgcttgaacccgggaggcagaggttgcagtgagatcgcaccactgcactccagcctgggcgacagagtaagactccgtctcaaaaaaaaaaaaaaagttccggccgggctccgcctcgcagtcagccggctccaccctaagcccaagtcccaggcagccactgactcctcccagcgctgcgaactacaagtcccgcgatccctcgcgcgctccctaccgccactcccgcgttcctaccggcgccgctgggtaggtcggccaagagtgcctcccattggtctccgcactgtcaatcacctgggagtattgaggggcggggcggaggtggagatccggatccggagcggctgaaaggcggaagtggaggccggagcctgggacaccgccggcggggagagaagcggatcccgtccgagccccggccccaagtaacgccgccgccccggagccgccgtgagtatgcttgtcccaggacctggtgtctcgcctgcgttgaagcatctccagggcagcccttcctcccgcccagccccagtttagggggatactgacccctcccccgacccgtagccccctcttgaggggctccccaggcgtcgggccataggaggtggggagcttctttccttagcttacctgcctttggtgagccttaaggaaaccgctatgactgtcctctggcctgtccattctagttgtgggagagaggtaccctaagttccgctccccctgcttccagaatcggaggatctttgctaggtgtgaaggaacctgtccctcttctcttttagaagtgacagggagtgctgtctgtcgccgttttccttcctcctgtcccacaaaaccagttgtcccctctagccctagaggaatatctcgatttcctttgggggaggggggtcgtctgggtgagaccgttccacacgcacagaagtgtgtgtgcgctcccgcaactccttacttcctctctttcctcaagccagagaaccaaccaggacctcagctgagtttaaagtcacttactagaaatgagctgttttcctgttttgccccttctgtctcccagccctgtcctctagttatgttgttctttgagtgtctctctctttctgcctctgaagaatttagctgaggtttgctcaatcctagctacagatcacagatcagggtggatgtgcccattcattatcttctttcccctccccccttgctccaggctcagctctgtcctcccagagcacgtgagtggtttcccagccgcctcaaagggactgcttttcttgggactgctgtccgtgtgtctatagggaggagaataagacccaaaatgaggagtctggaattgaagggccatctctttcccactcccaaacacacacacatacacctccctgagcaacaggtccacaccacgccagggtctgtctgcaatcccttcagggcttggacttattactgaggactaagtcaagatcacaatggcagttctggatttttaattgtagcctgaggaattccgatacatgccagaaagtgcaggttccctcaaccatattgactgatccttgtctgttgcttggggcttaggtgtgtgaaatagctgctgtctcagaccaagctttgttatgtggccaaagtacaggccggagactgtaccttaacgaggagtagcctggctctgaggccatgactgacccttgctatctacagtggaggaagggacggaaagccgtgcagtttgtgggaacttctgtagctcttcagtgttctgggctacctttaccaccctcgcttgccacttaaaagtgctgtgttttttggccttgaggtgtgtttgagggcttctggacagtggctagtatctgattcctacagtcttttgagtagagctaggatgtactttcttcacttttttgtttgtttgtttttgagatggagtcttgctctgtcgcccaggctggagtgcagtggcgtgatcttggctcactgcaacctctgcctcctgggttcaagcagttctcttgcctcagcctcctgagtagctgggattaacaggcgcctgccaccacacccggctaatttttgtatttttagtagagatggggtttcgccatgttggccgggctggtctcgaactcctgacttcaggtgatccacccgcctcagcctcccaaagtgctgagattacaggtgtgaaccaccgtgcccggcctacttatttcactttttatcggacaacagaagaagccttccttattagggtcaacagctggatcacaggctctgtatctgtgtgggttcctttggggttcattggagacttcttcaaccaacctagtttctctgatctggtcagcctgggcatctgaggggcagggccagagaggcctgactgctcactggccattggtctctgaccagacttaggtcttcaggagtagaccgcagtttgtcactcttcaggagtgctgggatgaggccgaccagccttctgaggagaccttcttttctttgtctggacatgctctcccagctctgactctgaaacgactttttttttttttttggagacagagccttgttttgtcacccaggctggagtgcagtggcacaatcttggctcactgcagcctctgcctcccgagatcaagggattctcctgcctcagcctcctgagtagctgagattacagccatgcaccaccacgcccagctaatttttgtatttttagtagagatggggtctcaccatgttggccaggctggtctcgaactcctgacctcagatgatccacccacctcagcctcccaaagtgctaggattacaggcatgagccactgcacccaacctgaaacgactttgaaggggaagctctgccatttagagagacgaggcaggccccagtgctttgggtcgttatgcagccacttctggcacctagaaattatagagtccaagcagaggtctgactctgcctggcagagagagcgatggctccgtgtgcgacagaacccctcctttctgatgctgttcctcccctgccctcttgcctctcacaattagagggctgttaaactgtagagggacagtaacactaatttttaaaaatcattttaaggttgcaaaattattttcatacatattcctcataggtgccttgggaaatagtggggcttgtttccccactttgtttttaatttttattattacttttttttttttgagtaagataaggcaagtgtccctgctttagaagggatgcagaaggaacttaagtagtttgcctaagatcgatcatacatttagaaagtagtagagctggggcttggatttggggtcagatgtgacctgatctaacagtgggcccttcttcggcctggtttgttcgttaaatgaatgaacatgcagactgagtgcgccacggcacaagggcagactcttaactctttagccctcctcatcactagcgctcctctgtttttttgtcttccccagcgtctacccgacctcctgtcttctctcttgacccctttcacctctgcctctgaggaccaaaacagttaggagtcccaagtcagtactcttcagggcctgagagtttgctgacatctacatgtcattaatttttctgggaacctgaaagtcctaatggctagaaaatgaaagttaaagtgagtaaactcaggggtcccactgggcagggttaagggggaagcaacagagcgggcctctggttagtcctctgtttctcctgtggtgctgcctgctgcttgcaagtgggaagaatgtggcttgccaccaggagctcctgtcactagaatttacatggaaacagagcaagatcatacatttaaattcagccccaccaagcaagtacttcttagaccttctacttctttttttttttttgagtcggagtctcgctctgtcgcctaggctggagtgcagtggtgcgatcttggctcactgcaagctccgcctcccgggttcatgccattctcctacctcagcctccagagtagttgggactacaggtgcccaccaccacgtccggctaattgttttgtatttttagtagagatggggttccgccgtgttagccaggatggtctcgatctcctgacctcgtgatccgcccaccctggcctcccaaagtgctgggattacaggcgtgagccactgcgcctggccagaccttctacttctaacccttgcccagtaaacaggcagtgtggtcgggtggaaggcactagaacttcagaggcagttggacctgagttctcatcctgattcccccacttaccagttgtgtgaccctgggcttgttacttgacctcactgagcctgtgtttcttctggtaaaatggggatgctaaataccttgcagaattagaaacaaagaaaggagctagtccagtgctggcagactggatgcccacaaaatagcagttgcctctgatgggtaggtaggggtttgaaggttctttttttttttgaggcagtctcattctcattctgttgcccaggctcactgcaacctccgcctcctgtgttcaagcgattctcctgcctcagcctcctgagtagctgggattacaggcacctgccatcatgcccggctaatttttttttttggtatttttgtagagatggggtttgaccatgttggccaggctggtctcaaactcctgacctcaggtgaggtgatctgcccgcctcatcggcctcccagagtgctgggattacaagcatgagccaccgtgtctggctgatttttttttttttttttttttttttttttgagatggagtttcactcttgtctcccaggctggagtgcaatggcgtgatcttggctcactgcaacctctgtctcccgggctcaagctattctcctgcctcagcctcctgagtagctgggattataggcgtgtgccaccatgcccagctaatttttgtacttttagtagagacagggttcctctatgttggccaggctggtctcgatctcctgacctcaggtaattgtgcccagcctcaacactgattctgattcaacatgtgtaccaaatgtatgctggggctgggcacagtggctcatgcctataatcctagcactttgggaggatcgcttgatcccaggagttcaagaccagcttgggggccaggtgtggtggatcacgcctataatcctagcactttggaaggctgaggctgggagatcacctgaagtcaggagttcgagaccagcctggccaacatggtgaaaccccatctctactaaaaataccaaaattagtcaggcgtggtggcacatgcctgtaatcccagctacttgggaggcttaggcaggaacctgggaggcagttcaacctgggaggtggacgttgcagtgagccgagattgcaccactgcactccagcctgggcaacagaccaagagtctatctcaaaaaaaaaaaaaaaaaaaaccagcctgggcaacataatgagaccccatgtctaaaacaaaaacaaaatgtctgctgggatgccttgtacattgcttgatggtttcacaaattgtctcattttgtagacattgaacagaattgatgtgggttgtattcccattttacagaagagaacgctgtgccacttcagttttacttagttgtaagcgttttaatattaaaacagtcctgtaactattatagattagaatgcaaagtttgcatgaattgaagctaacacaggaaactttaattaattaattaatttatttatttttgagacagggcctctctcacccaggctggagtgcagtgggacgatcatggcttacttccgccttgatcttgtggacccaagtgatcctcccacctcagcctcctgagtagctgggactgtaggcatgtaccaccatgcccggctagtttttgtatttttagtagagacagggttttgccatgttgcccaggctggtctcagaactcctgggctcaagtgatcctcctactttggcctcccgaagtgctgggattacaggcatgagccgctgcacctggccaaagacagtattttgcttgtagccagctgctttgggttcaactcccagatttctgggagtttcctctcccctgacttgagtgaagggtacatatgttggggctgtttgagaagcactgctttaggtagaatttataaactaggatgtgccaaaatccaggtaatcatgcttgcaaaaaccttggcagaggagaatcggaatatttttggcatcctctgcattaatagcttggtattgtaagagattacttttccaattaaatagccccatcctctatgtataagaacagtaatacaaataaaagctaaacttctatttttgccatgtgccaggcactcttgtgagccctatgtgttgactcctttaatcctccgacaaccccaggaggtaggttctgtgtttaatccccatgttagagtgggggactatgtagtaatggcagagatggggtgtgctcttatcgctattcaatacagcctctccttgacccatctctgggctaaatgcctactgttcactttgcctagaaggctcttctgcacctcacgtgcctggaaactgtatctccctacttttctctcaaagctcagtttgaatgccacttcctctgtgaagccttcccttgccccaaatgggctgagggcttgtctcctacatgggctgtcttctcaactgctatctcattgttccttatttgcctcattctctggtgggtgagccctttaggggcacagatcgggtcctgtttgatctttgtgtgtttaggacctggcatggcactcagcatagtaggctccctactgaagttgttaaaggagagggcagacattcaaacctgcccttaaagcaaacaccaaacacctgcccacttctttttttttttttttttttttttgagatggagtcttgacctctcacccaggctggagtgcaatggtacgatcttgctcactgtaacctccgcctcctgggttcaagtgattctcctgcttcagcctccctagtacctgggattacaggtgtgtaccaccacgcccatctagttttgtatttttagtagagacggatttcaccatgttggccaggctgatctcaaactcctgacctcatgatctgcctgcctcagcctcccagtgctgggactacaggcatgagccactgtgcccagccttgcccacttctttttttttgtttgtttttgagacagagttttgctcttgttgcccaggctagagtgcaatggcacaatctcagctcaccacaacctccgcctcccgagttaaagagattctcctgcctcagcttcccaagtagcagggattacaggcatgtgccaccacggccggctaattttttgtatttttattagagatggggtttctccatgttggtcaggctggtctcgaactcccaacctcaggtgatccacccgcctcggcctcccaaagtgctgggattacaggtgtaagccaccatgcctggccctcgcccacttcttttaacacacacttcccttcctttcttcacacactttggatgtcgtgaacctatgattcaaacttaaatccatctgatcccacagcttgagccatatctttggtccatcccccagaaagttgctcacagacaaatgggagagcaaacaggtcaataggatcaatgttacagtacggatgatgggaagcaagtcacaaactcagtttccagaagttaagactctccaaatctccatttctggtgaagggtttaatgggacaatgagggcgcggccctgactagccacagtccggctgactggcttctgccgtgtgtgtatctgatggcaggacagaacgaccgtgcttctgcagttgtgtgtggtgaggcagcaccgaccccagaccagtacttagcaaggatcagtggaagcaaatttgactctgcctgtggatactgttctgtatgtctgcacaaggctcgttcctgagtgaaggtggcttaaaaaagtggtggcagcagctgttcagaccagtggtatgagcagccctcacatgtgtattccacagatggggtctttaacattccctggtcctgtgcctgcagtacttggatatcctctgctcaccttgaggctggtctttctttctttctctctctctctctctctctctctctttctttctttctttctttctgtttctttctttctttctgtctttccttctttctttctttctttctttctttttctttctttctttctttttctgtctttctttctgtctttctttctgtctttctgtctttctttctttctttcttgacgaagtcttgccttgtcgcccaggctggagtgcagtggtacgatctcggctcactgcaagctcccgggttcatgccattctcctgcctcagcctctcgagtagctgggactacaggctcctgccaccacgcttggctaattttttgtacttttagtagaggcagagtttcaccatgttaaccaggatggtctccatctcctgacctcgtgatccgcctaccttggcctccttttttttttttcttttgaaatggagtcttgctctgtttcccaggctggagtgcagtgatgccatcttggctcactgcaacctccgtctcctgggttcaagtgattctcctgcctcagcctcccgagtagctgggactacaggcgtacgccaccatgcccagctaatttttatatttttagtagagacggggtttcgccatgttggccaggatggtcttgatctcttgactttgtggtctgcctgccttggcctctgaaagtgctgggattacaggtgtgagccactgtgcctgggcaatttttgatttttttgtagagacggggtctccctatgttgccgaggcttaataaacttattctttcagaatacttttagaaaagttacgcagatagtacagagttttctcacaatccctcacacatagttttccctgttattaacatcttatgttagtatgtattttacattaaagtccatcctttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatccagcgataaggccgggcacagtggctcgcgtttgtattcccagcacttggggaagccaagatgggcggatcacctgaggccaagagtttgagaccagcctagccaacatggtgaaaccctatctctactaaaaatacaaaagttagctgggtatgatggtgcacgcttgtaatcctagctactctggtggctgaggcaggagaatggtttgaagcagggaggtggtggttgcagtgagcagagatcctgccactgcaccccagcctgggcaacagagtgagactttgtctcaaaaataaataaataaataatccaatgttactttgttttattgcccaaaatgtttcagctttgcccattggttgctcttttagcctcctttgacctgcctagtcattgtgaggatttttgtttttggtttttggttacttctttacattttggcactgccagatttttggagacagactcactctgtcccccaggctggagtgcagctgcacgatctcagctcactgcagcctctgcctcccagattcatgcaattcttgtgcctcaacctcctgagtagctgggattacaggtgcacgctaccatgcctggctaatttttgtatttttagtagcaacgaggtttcaccatgttggccaggctggttttgaactcctgacctcaagtgatccacttgcctcagccttccaaagtgctagggttacaggcatgagccaccactcccggccccaggcttactttgtgtatttcgtgccagagttgtagattcagctggctctccaaggccactgcctttttagcaaatgttttctctcaggtatgttgacatagagtgatgtggatgccttgagttatttcttctcttgatggttagtcatagttactagagactctggagttgggaaaggtagaggtggacctgggaaatctaccccctgagaatcaactgcagtcctgggagttaatcccagtagctggctgttgttctactcacccattcatactgctcttacccctgcctgatgctatgactgatccaaaaaatggtctgatttggtctttcctttggaatttacctatggaggtgtgggaagatgaggcatgtgtatataatcgttctctatttcaggtgctaagttctccagctaaaccttcctggactctgggtcttgtaagagattccacatggtccgggccagtcagtgtcttttgctgcccttccaaaatggactgcccccatgggacggtttgtggctgttggcgggctcagggtaggctgtcactttgtgccgtgatcctgaatcattgaatagctgaaatccttccattgtactgtcatctctctgaaaatgtgtaacttgagccctgctggaaacactaacttgggatcttaacaggagttggtttacaagccttttgccttctattcatagctccatgtatgtccccttcaggtggctgtcagaggcatcccaggcatggaggagggcgtgggtggcctctctaaccctggctgctctcctagacatcagattgctctctgagctgctcagacagcgtggtgatgaatgacgccagtttccaaacctctagcatttgcagcctggtttttaaaaggaactctgctttctttgtcagctgctctattcctgtcccctagccctctcaacaactgaactgcttcttccctttcctgaaagaggctttgagatggaaggaagggcatttgggctttaagatgctttgtgggctgggcgcggtggctcatgcctgtaatctcagtactttgggaggccaaggcggggggattgcttgagcgcgggagtttgagatcagcctgggcaacatgatgaaaccccatctctaccaaaaaaaaacccaagatgctttgtgttaatggggctttttttttttttaagaggttatggtttgcatggttggggccttcaccccatgcagatttattggatggtaatggtttctcccctccatttttgtggttttgggagctagtctctggaggatacaagattggggttgttgacaggacactgagtatcttctaggaaactgaggaaagacgtcctcttcagcattctctccaaatgagaggtgctgaagaatggagtcccgggaaactggaggtaagaggaatgtgtgaatgttgtctgacagatgaagtgaggagtccggctccttcacagggaagtgaaggcgcaggggctcccctgctacagaacatgtactgaatgcttcccgatgccaggccctttgctgagagtctcacatgcatcatcttcctggcagtcctggagacgggtggtactggtctctccattttacgtgtgaggaaatgggttcagtgacaacaccaggccaccctagtaagtggtgcctccagaacttgaactgaagttcaagttgtctgactccagcacttgtgctcttaagctctgtgcagtagggatggaggaagtcctccctggggaagtgaggcagctcctcagctgctctgtggctctgttaggggacccgagccgtctggcagatgaatgcagatttaagccctcaacttcccccgttcacttgccaagtgtaagcgggcggtacctctcacatgcacagttcaccgtatctgtgctcacctactatgggtcaggcttgctgttatgtgctgttaacacaaaggaaacccattgtccagcctttgagaattttgtaatgtggttgttttcatctgcaacagtgcctttaatttctcttgctttctctctcacaaccctcagtcccccaagttctccagccccttgccacctacactagtcttatgaacatttggggccatggaagcagaagtgtgattcgctcattgaatcttgtttagacctattcattgcttgatttcttcactgggcaccactctacagtttgttcagcaaaaattaagaaagatggcagacacagtggctcatgcctgtaatcgcagcactttgggaggctgaagcaggtggatcacttgagcccaggagtctgagatcagcctgggcaacatggtgaaaccccatctctacaaaaaatagaaaaattagctgggcatggtggcatgcgcccgtagtcccagctacttgggaggctgaggtaggaggattgcttgagcccaggaagtcaaggtagcggtaagctatgattgcgtcactgcaatccaacctgggcagcagagcaagaccctgtctcaaaaatgtatatagaaaaaagagctgggtgtggtggctcatgcctgtaatcccaacactttgggaggctgaggcaggcggatcacctgaggttaggagttcgagaccagcctggccaacatggcgaaacctcatctctactaaaaatacaaaaatacaagctgggtatggtggtgcacacctggaatcccagctactcaggaggctgaagcacgagaatcgcttgaacccaggaggtggaggtggtagtgagcccagattgtgccactgcactccagcctgggcgacagagcgagactccatctcaaaaaaaaaaaaaaatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaggtctcccactgagaactttgacttttttcttgttggttgcatagccgctgaccacggtgtgtgtggtgtctgaacaggaggcatttggattgctatttctcttttctcccactttcctctcaaacttgacctctgctctctgtttaggagctgaaggcaaaacaaaggggcagtgatttaaactggctttcttttgttttctgttatttgtaagggcgggaagggttttggagaggtgtccgctggtgtgagtggctggatgaacaggtgctgcttctgatcctgactttcagcagaggtttctggagtctttctgggcctagggaagcagcagaagtggcagctgtcctggctggtgcttctgacccctgcagagccccttttgagacggggggaagacgggccctacattgatgagattccggtgagaaatgtcctagctaaatagtaactgcctgaacaaatgaaatacaggatagttggggtaggctggggccagaagaacctttgccttggatggcactcttcctagcatcctgcctggcattggcaggtgaagaactgactggtggcgtgtgagccaccatacagccatgttgtcatccctaacaagccctgtggctgggacgtgtgtgtggttctgggctgcagaaagattccaagttgagcttttgcttgaggcttgagagagcagccctagacaggagtagagaatctggcacagcctggatcacaaggtcaggaaatcgagaccatcctgactaacatggtgaaaccccatctctactaaaaaatacaaaaaattagctggatgtggtggcacgcgtatgtagtcctagctactcaggaggctgaggcagaattgcttgaacctgggagctggaggttgcagtgagccgagatcacgccactgcactccaacctgggtgacagagcaagattccgtctcaaaaaaaaagaatctgccacaaccttgctgactgaggtgtgctgttagacactgggccctcttagggagaacagtctcaggaatgtcagcgttagggcctggcccccctggtgccttttggaatcggtaggctggcggagagccttgcctggtgcagctgcaggcagtgccctgtctgtgggccttccgtgctacctgtctcctctgttggccagcagggccaatgactgagagttgttgagctgcccatgaagcctggggcccttctgtggacagcactggccgaccacactggccaagctgtgctagcagatccatggagatgtcctcccaccccaatagtcttcctccctgtgggtgcagaaagagggagtggatgctggaggtttccatccagccctgactgctcctctctgagcctctccagagaacccatctgtcattgagagctgggaagaagctcagggatcagggaaggatttcatggtgttctgctggggtagagtcctggaaagctaagggtctgtccctcaggggtgtcttccacccgagtgagcttggcatctgtcctaagtgatacaagacttcccacacaagggaaagggctgcaggagccagctgtgctctgtcctggctgacttcagcaaagttccaggctcagtctgcatagtgtttattaaagatcacttggtaatgtgtatccaggctttaagcctcttgatgcctctgcacactggccccttttgcaggtattggtggagttggtgtctgcacttggggctctggtggaccccatcagggcctgattgtggtgtggaagtctaggcactaagcctcagaaatcttattgaaaaaagaatgaaatgaaaccaatctcagttaaggaaggtgggggtgctttccctgtggaaggggacccagctcaccttcagtgcccctctgggataatttacttccctttccgctggaaaaagggtcatcttcctgtggctgtggaaaggcagcaccttcctccctactgctgcctcccccaagtctaggtttaagagctggacctcctgaaggtgggaggtggagcccaccctgttgcaacaccccccattgggattcggctagatctcaccctgggctcttaagcttctggcttccagggccagggccaagcttcccctgttagactcttaggtaagacacaggccctgtgtgaagcagttccataggcctggtcacacagaggacacccttctctttgattccatcccccaacccctaaacccccctttcctctgcagatatactctagactggttggggagtggagaatatcatactgttataacctctttctccccatcgaaaagacataaatatcagtttctctttattattgtgaagctttaaaccacttgaaaatcctttagcccacagttaagcccaaacagtaaatatatccttaatatatatgtgggaatcttattttttatgaggaatcccattgtcttgcaccttatttgtgtttaacatttgggtatctttgttctccgttggtcttttccaattcaggtatcatctttttgattgtcttttttttttttgagacagagtctcgctctctcgccaggccggagtgcagtggcactatctcagctcagtgcaacctctgcctcccgggttcaagcgattctcctgcctcagcctcccgagtagctgggactacaggtatgcgccaccacgcccagctaatttttgtatttttagtagagacggggtttcaccatgttggccgggatggtgtcgatctcttgacctcatgatccacccgcctcagcctcccaaagcgctgggattataggcgtgagccaccgtgcccggcccttgattgtctttaatattattttcttcatactaaagaggcagaaaatattttatatacagaggagctagattgcattcatatcgtttccaagctttaacttttcatgattatatgcaaaattctataccagcagcattttttaacctttttattgacatgtgacttatgtataatagtttacaaattgtaaatacagctcgatgggtttttatattattatacactcatgtatttacctctcaaatcaagttataactcctccatccagcagtgtgcttttttttttttttcttttttttgagacagtgtctcgctctgttgtccaggctggagtgcaatggtgcgatcttcgctcaccacaacctctgtctcctgggttcaagtgattctcctgcctcagcctcccaagtagctgggattacaggtgccagccaccacacccagctaatttttgtatttttagtacagtcggggtttcaccaggttggacaggctggtctccaactcctgacctcaggtgatccacccacctcagcctcccaaagtgctgggattacaggcatgagccacctcacccggcggcaatgtgcttttttcagtttgatagaaactcattttttcctagctaaaagctacattttttaaaaacatgcatagaaggtcgcagtccctgttatttttagtaacaggggttatggtaatgagattgttaatattctggggtttttctttctatctctaataggagagccttgcttgagttatgagtcttgggcaggcttgggctctgccaccagctagctggctgtgtgaccctaggcaggtcacttctcctcaccttcattttttttctttaattgtcaacagtaggatggggtctttaaggcccttttgggctctgactaccaattctagcctctggggtaataaacctgccacttgttgaaagctcaccttcagcctgatactgtggtgcattgtttcacttgatctgaactaccccatgcaattagtattaaagaataccaatttttagataaggaactgaagctgataatgatcacttgtgtgacttggccaaggtcacacggctaataaacggtggagtggagcttgaaccaaacccggctcagcctcccaagtcctaacctgctagccacgctggggaaggttgtgggtacctcgtgtggatcgtggctggcgttgcttcagattcttctttcctctgggtctgcaaccagctagaagcctggatagtcctgctgtgagtctgtcctctgtttctgtgtgctggcagtggttttcccttttgaggaagagctgtgttcttgagcctatgggtaaatcatctccccaactaatcggagcctgggaagcatttgcaaaaccttgactccagttggcttttaaatcaaatgtcttccactttagcctttgaaccgagttacttcctcctgtgtctcttgctccattttctttaacaactcctttctgctgttgtttttttggtttgattttgttttgttttgctggactcttgtttaaatattcaggaatgcccttttccggggtaaaatgtagctgaagagtcactggtcagaagcacctgcaggggaccctgggcggggtcacttggttctcaggccacctggctaaccttgagtgagctagtctctacgccccgcctgccctggtcaacagtctgattggtttccctaatcagcttgctctccaggctgtgccaggactctcagctagaggaagtctctaaagcaaacaggaagtacacgagacactcatcagctggaattgctcacccttttaccaggaaggacaaaacatatgaagtgggtgacttcgtggattagaggaaaggtgaaactttcaaagggaggttagggggaggaattgcagcagcatctagtgtcttggagaaggctccagttgctgagtgaagctgaagacccctcccacattcatggacttacacatgcacacttacgagttgtgcacagcactgatcgggggtgcctttctgtctcttggatttctccctccttcgtatatcaactgtagctcttgtgcttcgatcaactgcttaaaatcactgggaacttatttttaaaatactgatttctggactccacctctagagattctaattcagttggtcagggtattttctaaaggccctgggtgattctggtgaagaagagtttgactggaggctgaaatagaaggatcacttgagcctgggaggtcaaggctgcagtgaatcgtgattgcatcactgctctagcctgggcaacagtgagactctatctccaaaaaaaaaaaaaaaaaattacaggtggctcacacctgtaatcccagcacttttggaggttgaggcaggagtttgataccagcctggccagcgtggtaaaaccccgccgctacaaaaaatacacaaaaatttagccgggtgtaatgacgtatacctatagttccagctactcctagaagctgaggcattagaatcgcttgagcctgggtggcagaggttgcagtaagcagagatcgtgccactgcactccagcctgggtgagagagcgagattctgtctcaaaaaaaaaaaaaaaaaacttaagaaaaaagaaaaagaatttgagacccactgacctgtagtgtccagagcagagggaaccccggagcagggaagaacagtgtcccatttttctttctctttctcttccatccttggcccagaagtgcctgtgcacagggccagggtgtttaggagcttagatcccttctgcgctttcatgtgcattgtattaataggaaaatagtgtgactccaagtccttatacattctctcccctttcctgtggaagacatgaggttgggactggtgcttgttcttagtggcctctgaacaagccagggttctgatttggatggtgggtccatggcaaggagaatctttctccctagatctgaagctccagcacggccattgtacttgtgaaaaaaagtcaacttttttttgagacagagtcttactcttttgccccaagctggagtgcaatggcgcgatctcagctcactgcaatctctgcttcctgggttcaggcaattcttgtgcctcagcctcccaagtagctgggattacaggcgtgtaccaccacgttggctaatttaaaaaaatcaactttgactgtaactttagctcttatggagaatttgatttttgtctcaaagaagactttgaaaactatgtcagttttggctataattccatcacctgactgcacaagtggataatttttgccaggggttcaaaaagaaagattgccagtaagacacacatccctgggaggcaggacagctcagtgaatgcattcacctttactacctgccatgtcttcagtttcccaggcttgggaggagagggtataatgcttcctggggctctcggtctggccttcccctggcttagacaccctcatatctccgtgcgcccttcctagcaaaattggcttccttgggctttattgactgcaaaggttggacaccactgctcatttgatcaccaagcagggccaggcaaaccactaggcaacagaccgtaaaaagtgctgggtgtgcctgctcaggtatctctggaaggcaggatcagtgaccaggcagaacatgtcaccagctagttcatgccagggagagcctgtctcagttcattgggatggccagagtctgttcaccaacagtcttggagaaagtgttacaaataaccctgtcagtactcttagctactgtttactcaacatgatgtgtgtgagacagctggcaaacactgccattaaccctggtgtgccccatattagtgatgagaacactgaggctcagctcaggtggcttctacaaagtgattcagaagtggcaggagacagtcacatctgtggtgccgaaagccagtgcctgtgctcactctctctctgccagatgctctagccctggctgtgcttcagtgggtgtgcttcacctgcagatgctgggctctgtgccaaaccttcatgagaatctcgaggggctggctgcacagatgacttcaatgtacagacaccgttgagaaccactgcaggagagttatttgtctccccttctggcttgtttttaaaaatcacattctgttcctctaaccctgtggtttggtagtgacaagacttagatctgttacctgtatttttctcgacctgtaggtgctggttacttcccagctcggtaccctaagcaccagctgctttggtttttttggaatcagagacttggttttctattaccatctcccagtccattcatacctcctcctccagtgccccagccacagaccattgctcagccaagactctgtgtcacgtggattcatggtaataaccaacttgtaattccactgtggttttccctctgttgctgtcgccctgcctggctctgggcggctcctcccactgttgagggcactcagaaactgcaagattactgtgactgttgctagagccagctagagctagaccttcctggaccagcaaagttgctgccacaaaaaaagagagtttcattcacctagcagccctaaaccaaacatagggcaggcactgcctccattgttcttccacagcagggaggatggcatcatgtctatggtgggtctggggggttctgtcacctgtaggctgggtgaccatgagcaggacatttaatatatgaatgttaaattatctatctgaaaaatggaggttgtcgtaaagcttgaaggagataatagttgtgcaattgggaagctgaggcgggagggttgcttgaagccaggagttggagaccagcctgggcaacacagtgagactccatctctgcaaaaaaaaaagaaagaaagaaagaaagaaaattttaattagctgggtgtggtggtgtatacctgctggaggctgaggcagtaggatcttggaagctgcagtgagctgtgatcacaccgctgcactctagcctgggcaacacagtgagaccttgtttctttaaaaaaaaaaattatttccttccatcagcactctttgagttcctagtatgcacataggcactgtgaggaaggcatctctaagaagcagaaagcacagaccttgtctcttcattgactgaggtgaaatgagaaagcgtcttaaactatgaaaaattgaaatgacataactttgaaatatttacatggtatttctggttgctaattgagacccaccaccccgtacttccttccttgtacttttggggaagaggtgggccccatttcaaacctcttttcctttggttctctccagaaaggaaactgttgtttctggctagtgaatcattcttcctgaagctcactttttaaatgagttgctgggagaacttggatgtggaaaacgatttgaggttgaacaaaacaagccctttgctgtcagcttcttgcatgaatgtggaccatttgcttcccacagatacctcctgttcatccacattgctgtcccttaaccatgagggaatgtacttcccttgctcaggggcagatcggggctctccctgggatcttagactccattatgcaaagggcagcctaataaaaaccttttctttccaacccaggttcaaatgctgaacagtgttcagtacttaatacctactcacaggacctgtttgtaaaacattctgtatatattctgatgtctgttgacatcagatgtatatgtctgatgagacatccacttatgtcttctagaggcttctagagataggctcctcatgtgtctgcaattccaaaacttaacaaaaacaaaaagttgagcctctgaagctgtcactaaccaagtgattcagatgtcgggactggaacaccagctgttggggatgcaggacttggtctctgccctcccacacctcctgcctcttctttctctccatcgccccatctctgccagtagagaatggaactgaggtctctattgaaaaagggaaagttggtagctgtgctgactgtggcagagctatgactttggtgtgtgtttctgtgtgtgtttgtttcggtgtgtgttttgttttggtgtctgttttggtgtgtatttctgtgtgtgtgttggcatgtgtttttgtgtgtgtgtgtgtgtgtttcagtgtgtatttgttccggtgtgtgtgtttctgtgtgtctttgtgtgtgtgtatcggtgtgtgttttactatgtgtttgtttctgtgtgtgttttgttttttaatgggtgcgagactttggcccatcaaaaatgagagaactagggaagaaggatcaggatgagagagtgaaacattgctttgattctggtgcacagaggcacacagtccagccctagactgaaagtcggtcagtccttctgaaggtggcaggagaaaaatggctatgttaataacaacttgtgctggccaggccctggtccctgaatggccatgaggttggccaagcaccttctctgaggagctttctaccaggacctcttgggcccctgtctgcctcaccactgtggtcctggctaccagactggaacttcattattgatctaaatcctagtgtcttcctgagcttttgttttgttttgttttgttttaattttgccccaaaagcctgttgacttaactgtcaccaggctgtcacacattcattcatcgcctgtgtgtgtttatttgtaggtgaatgtacatatttgggatccagaagtcaatgtgtttgctcagaaccatgagcctgaagttgggagaccattctcctctttacagctcagatggtggtagagccggtagacatctagtatagcccagtggggcctcctgacctctagtggggagggcagggaggtgaggtgaggggaagcagtcagctaggtcttcagtgaggccagagggaaagatctgtaatttaagaaggacacagcgggtgacggcctctgaactaactcagtacttctcatttctcccttacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggaggtgagtgggcatgagggagtcggggaggggcctgaaggttgccaaagaaatgctttgaccttgaggagatgggaagctgcctgcctgcattagggactaaatgcgtctgtggtggcagccccacttcctcacctgggccctggaattgagcccagcaactggtctccatgccagagtcccctcaagcatcgctagtaagcatttgctgggagtggaaagctagcttcccatcctgtttctgccccttcttgatctgtgtggccttggctgaggccctttcactgccctggcctcatggagggagagctgactctggatctttgaggccccttcttactataatgggtggtccatgtgccctggcctttcccacttccagaagaaggaacagcctggtgagtcggagctgggtgataggtgggtgtttctgaagctgactttaccctttctggagctcacagcctgttgttgattttccagtggtcagcatttaggatgtgagtgagggtctggcctcggcctcttgcctccgtggctaacacacacatcaagaggcaggggccaacgctggccttggccttgagtcatcctttctctactctcttggtaggaggtttctaggcagctggaaacaaaatgggccatgtcagcagtctccctgctgcctcctcagcatttgggtcaggagctggagaggggaagtgaggcagtgccccatgtccctcagtgagctgggggagggcagaccaggaaagcagccttctacacatggctgtcctgggttctctgctgggtccaggggcaaaggggccttttgctgtctgtcccagctctggactcctcctttgaagcatgtgtacaggcaccctgcattcccctaaggagtcacctcttagtgactgaaggtcaggtcacagggtggccatacaggaacaggtctgggtcagagctaggggcggtggctagctggagtgcctggaggtggtaggggtggttgggaagccggccacccagcctcagcctggtggtggaacagtgtgtacttccccagcatagctaagtgtgtgagaatgtccttaggaaacccaaggtcagtgacacccctgggctggagcaaactgaggggtggagcggtccctagctgctggtctgttctctgagtggcggaggaggaggtctgagggcgctcacccttctgtgcttggagtaggcttcccctaggctttccctctcttgcccctgctgtgttgctcttcagagagtggtcctgagatggctcagtgcatgcaggagtcccttctcctgccgttgcctgggctgggtctgcaaagcctgtgcagaccccgtcccccagacacatacataaaaatccaaactccaccccccactcaggcctgctttggctcctggcttgagggttctctgtgcccatctcagtggtgggcttctgagtgccagagcctagaagcaacagtgggattgtgtggggtggattccaactcgctcttgcccatggacgctccttctctcttacagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagtaaagatttccccttgcttcttcctttgcccttcatcttctcaaagtcccagggattgggttatcagagccctgatttcaggccgcttaaccctctgttcctgggtggggggtgggcagatttcctgtttggggacattgcatcagaatctttaggtggcaatgtcttagataatttggctgtgccagcttgagagtctctaatgggtggccctgggcagaatgccttctctgtcccttcgacattctgtccctgtctcctcaggatacatttgcacgggccaagaactgggtgaaggagctacagaggcaggccagccccaacatcgtcattgcactcgcgggtaacaaggcagacctggccagcaagagagccgtggaattccaggtggggagatgacagacttgggggaaggagtggagtaagcagctccccccggcctcgcctgggatgctcaggggctttgggaagggccatgctaggaggcaacagggaagcttccatctgctgtcctctcgtgcctcaggcatgggcctaacatggctcctgtctgtaatcccagtgccttgggaggctggagtgggaggatcacttgaggccaggagttcgagaccagcctaggcgacacagtaagactctgtctctgcaaaagatttaaaaattagctgggcttggtggcacgcacctgtagtctcagctgctcaggaggctgaggcacgaggattgtttgagcccaggagtttaagattgcagtgattgcaacactgcactccagcctgagcaagagtgaggccccatctctttaaaaaaaaaaaaaaaacagccaggtgtggtggcacacacctgtaatcccaatactctgcaggctgaggcgggagatcacttgagcttaggagttcgagaccagcatgggcaatgtggcgaaaccccatgtctaaaaaaatacaaaagttagctgggcatggtggtgtgctactcaggaggccgaggtggggaggatcattagaggccaggagattgaggctgcagtgagcagtgatcgtgccactgcactccagcctgggcaacacagtgagatcctgtctcaaaaaaaaaaaaaagaaaagaataaaaaaagcatgggcctaaaaggaattgcccgtcacctgtctctccctggttctctttctttggtggtaggggtatgtgtatatatggatcactagccttctacttctcttttcttgtaagttgactttttaattaaacttattgagaaagaaatacttaagtctctgctaaccctagaaactcaacttctcttcttctaatttccccagtttcttgtccttccagaaatatgcacgtgttttttaatccctttctttacattgatggcagtgtgctatacatactgtatatgataattttttaccaatccctaataatagcaaaagactgaaaacagtgctgcagtagacatccacatacttttgtgcttttgtgcaaacatgtaagtgtatttgtaggttaactttctagaagtatttcctagcctagtgattttgaagagcaagaaggcagggtggacctggggaaacccgggtaagacatctgctagtgattgtgagctgagaggtgatatacatgagcggggaaacccagatcagggcagccttaggcctgaaaactcctgtgtgtgtccagctgatctctattatgataaggtgctcgaataaggaaggtttgtatcctgggccctgggccctggcccctgccaacatttccctctcacctcctctcacctccatccaaaccaggaagcacaagcctatgcagacgacaacagtttgctgttcatggagacatcagcaaagactgcaatgaacgtgaacgaaatcttcatggcaataggtcagttgcttctcctcccctcctctctccaccacagcaagggcatatcacctgtctgctggtctagagtgggcctgcggggtcccttcaccactctttttttttttttttttttttttttttgagatggagtctcgctctatcacccaggctggagttcagtggcacgatctcgactcactgcaagctccgccccccaggttcacgccattctcctgcctcagcctctcgagcagctgggactactggtacccaccaccactcccagctaattttttgtatttttggtagagacggggtttcacggtgttagccaggatggtctcgatctcctgacctcgtgatccacccgcctcggcctcccaaagtgctgggattacgagcgtaagccactgcgcccagcccccttcaccacttttaaccttctgataaaattgttttcatcatcacctgactcccagatgtagatgttggttgttcacccgagaagttcctgaagcctgggccagagtctcaacatttcactctctgagcctgtagcctgccacccatttcagagcctgccatcactacccctacccactgcctaggagtttttagctcatttggctctggaatcttccttcctgggttgcagatcctggctctaccactcattagctctgtagtcttgggcaagttatttaaccttactttgccgcagtttcctgaaaacaatcagaatgcacctgacacacagaagccctcaatatgtgagttaccactgattgggtataaaggccagaatctgctccagtggaactgggagagttattggggtacccccaacaaatgcacttttccccctcccaaacagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcacaattgtcttccttgtctttctctggcagtttatcagacagtgccctctgtagttgaagttgatttaaaatgaaccactgaatcttgttaaacaaaatcttcccctctaatgtgaggggatgctggtggtcatggtaaccaagagaaagaggctcttactgttagcagctccgatgaggtagctgacctgggctgaccaagtttgaagtttcagggcccgtgttcacttctccacctcccttcccctcccccacctaccagatcatactggggtgacatgcagtgtgtatttgatgatcattagtctctgaaacaccagaaacaacctctttgggtttttttggttggtctttaccagtgagagggtctggatcctttctcttcctgaagaggaaggaatcccaacagcccctggaacgctggactggtcttaaggccaagactgtagccactggctttcctcaccacctctgtccacgtcacccccccacaccacatccaagttgccccagtccagctctctactggttctggaatcaggtctgggcactcagctctctgctgctacctgttggagctgctgctcagctagggccacactctcctccaatttctcccagggccacagaggcctgattcccttttttttttttttttctttttttgagacggagtctctgttacccaggctggagtgcagtggtgctatctcaactcactgcagcctccacctcctgggttcaagcgattcttctgccttagcctcccaagtagctggaattacgggcacccgccaccacgccctgctaatttttgtatttttagtagagacagggtttcaccatgttggccaggcttgtctcaaactcctggcctcaagtgatccacccgcctcagcctcccaaagtgctgggattacaggcgtgagctaccacagtcggccttttttttttttttttttttttttttttgaaacggagtctcactctattgcccaggctggagtgcagtggcacgatctcggctcactgcaagctctgcctcccgggttcacgccattctcctgcctcagcctcccgagtagctgggactacgggcgcccaccaccacgcccggctaatttttttgtatttttagtagagacggggttttaccgtgttagccaggatggtctcgatctcctgaccttgtgattcgcccgcctcggcctcccaaagtgctgggattacaggcgtgagccaccgcgcccagcattttttttttttttttttttttttttttgagacagagtctcactctgtggcccaggctggagtgcagtggcaggatcttggctcactgcaacctccctccacctcccaggttcaaacgattctcttgctcagcctcccgagcagctgggattacaagcacacaccaccacgcctaatttttgtgtttttagtagagatggggtttcaccatgttggccaggctggtctcgaactcctggcctcaagtgatctgcccgcagaggcctgattcttggtggaccaccaccttgagggtgcctttcctgcctcctgtgcctccagtccctctacctctgacttccatccccagaaaagacaacggacaccaaggctgctgcacatcgcgtcgtttgtttaccgggtcaggttggaagccttagagccgaggctcccgagtctcggggacggtcctgtttgggcttcagggagggccagcgccacacactggcctctgacccacagctgcccggagggggtcaggcagcaggtcatggcggtaggactcaggttggacggtagcattttccggtgcaccttctgtgacatgcggtaactgaccctttccgggtccctgacgtccagttgctgctgtccggtcaccatcagccattggccatccacctgcaccaccagttcctccggggcgaagccgtgggcatccagcttcatttggaaaccgtctctggcatggtcattgtcctcctgagccgctggactgtccctgagcagccgcaccggcattgtggccacccggttccgttcagcaaggcccacgctgggacaccgggatgccacccggctctcgttggagaaggtgttaccgactctctgcatccgagtcagcaactaactgctgtcaaagggcgcgaggctcccagcgcagagctaggcgcacggacgcccggagaggagggacctcgcgcggcctacccgagctcagctccgctcgctcggttcccttcgcttctgcaaacgcaggcggagttcgggatcagccacgcccatcttacctccaagagccagactgtcagcgccctggcgcgcccgcagctgctctcctcccagactccgaccctttctccgcccttccccaccttcgttaatggacccggggaggccgcagctgtgaaggaactggatccacgaccaggccagacccgagggagccgcaccctggcgcagccaacagcagattgatcccccagctggaagggggctgtcttgccttctaaggaccaggcctggggcaaggattgttcctagacagagccaggggagggcggccttcctgggtcatccaccctacctctccctgaccacccacaaccccacgcggacacgcgacacgaggaggtggactggtctctccggctgcattaattcttcccggggcgtcctgtgctgcaggctgtggtctgggctctggggccacaaagatgaagacgcagttggggcttcaggagagtggctcccagtgcacagagaaagacctagccctcctccgcctcaccctccacgtcagtagccttcttggtgaccatcataaccacagctatgcctctggtgctgttatttgataattttttttttttaagagacagggtatcattatgttgcccaggttaatctcgaactcctgggctcaagcgatcctcccatctcggcctcccaaagtgctgagattacaggcgtgagccacctcgcccagcctataaactttattttttatttttttgtagagattggtggggggggtctcccaatgttgcccagcctggtctcgaactcctgcagggctcaagctctcctcccgcgtgagccagccacccggcctgataaactcctttttgttgagtgatactattaaatacatacatactgaaaagcgcagaaaaaggtgcaggtgaatgtcaggaggagaacacacccaagtcaccaccacactactgcagaactgttgctacatctcatctctaccgcagctgcaattccgtgtccggagccgcgtggggcagggcctgtgcgggagttgggggagggggttaagtgggagacaggcgcgtgaaagaggcagaccccacgattctccccaagactccttgtccccaagaggacagccatcgtgactctcccggactccattaaaagagattacaagtgaagaggggtcaatgtggggccttcactcaggcctcacttggctgtcaggggccaagagacaggacagaaaagtctggaagctggaggcagtgaggggaaggcgcgggaagactacaactcccgtcatgcgccgcgcagcaacgcctgcgcactgagcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggtgggggcggggcctggggtgaaggggcggggcttggggcatcccagggctctggtgggaatggggtcaaagctctggctgcggagcggctcttgccccagaggtataggtcattgactgatccttccacctccaggccaatgaaacctgtaagtgtaatggctggaaaaaccccaagccccccactgcaccccgcatggatctgcagcagccagctgccaacctgagtgagctgtgccgcagttgtgagcaccccttgggtaaggcaggcagcgcccttggagctgggggcaggtgctgggtcctgcttggacagggtgacaagtgccacaaagcttcatctctgaaaaaatcaaagatgcctcgaaggagggattgggttgggggggggtgtgcaccaaggggggagaaaggaaatctctcagcccagaacaggcccaggcaacccaacggttgatatcggagcagtcagtctcactgttggtcacactggttggaggaacagagtgtgtatcttgcttggctgtgaagagggtcaagaagccttgttgatttcttctatcaatttttcctaactctgccatctgtcttgcagctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaaggtgagcttccactaaaggagggtgtgagtgaaggaggtggggccttgaggggttgtctgcagctctgcccccctcccctctatgcccccttcctcttctctctagctactgcggaaatgcatcctgcagatgacccggcctgtggtggaggggtccctgggcagccctccatttgagaaacctaatattgagcaggtgagataggggaattggagatagcggataggagaattggggacagcttggaggagtggggagcctgtgttctccattctcctcaagctgagaacactggggaggttcagagaaggaagggtgttttgtgctaacctcagggtgggcatggtggtagggagggggcagagcttttctatagagagcacccgagagagagaggagaaggagaaccttgtccctggccagggagcatcttcctttgtctaagaaggccctgcgggctgctcacacctcattcctggttttatcccccacccaccccttctcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccaggtaggcccagccaggggcagcttcgggggaggcttgcaggcccagcctgggttcagtggtttccgccctcacctgtctccccctcgaccccctactccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcaggtacatagcccaagctaacgctgcccccacccgaccctacgccccagtagatgttactaattgtttcccatgggggcctggacacagcctcagactccttccctgcacaactctccaagaaaccagaccttaagcttgaagtgaaaccaatttctactcctgttctggtcttttctgtaccattttcttctgttcggccacaccttttaaaatctaggccataactcccctgttcaaaaaaccctgactgactaatcctggctctctagtgccccctgccatcaggtgggaacaagagatggcaaggtggggtggagtctgagcccattttgatactgagggcagtgagggggctcagggtgacaaggtgccctgcctggccacacagcacaggatgacatcagctcagacctgtctccctgtgccacacagcgtggtgaaactgagcctgtttgatctctgtcctggatgtgtcctgtcctcttaccttcaattggaggctcccagaagacaggggctgtcccctctctcaggtccccagttccctaagagcagggtctgtctctgaccagcctccagtccctctgctgcctggcccaggctgcaccctggagaacagagttgtgggacagactgtgtcctccctacagattcctgtccatgctggaggaggagatctatggggcaaactctccaatctgggagtcaggcttcaccatgccaccctcagaggggacacagctggttccccggccaggtatgtgccatggtacgctctgtagggtgtctggcctgcctggctgagctaagcctcctgggtggaagagagctcacctgggccggaggccctggatcccactgagggacctgccaccggcttcagcccccccagtccctgccttctctctctctctcctcagcttcagcacccccgtccctgactctctcctcagcttcagcccccgtccctgacttctctctctctcccctcagcttcagccccccatccctgacttctctctctctctcctcagcttcagtcagtgcagcggttgttcccagcacccccatcttcagccccagcatgggtgggggcagcaacagctccctgagtctggattctgcaggggccgagcctatgccaggtggatacttgacccctgacctctgaccctcattcactccttcccaaaccttttttactgatcctgagcaaccttgcctgcctccccaataggcgagaagaggacgctcccagagaacctgaccctggaggatgccaagcggctccgtgtgatgggtgacatccccatggagctggtcaatgaggtcatgctgaccatcactgaccctgctgccatgctggggcctgaggtgggcagcccgacctgctgaccagttgggggacccccaccaacctgagaccccggctcaccacccctcttctgtgcccagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgtgcgtcccccagagagcccctcccccagggcagcacacccagttcccttcctcctcggcctcttcactcctcaaaattggggatcccctgctccccacttctgaggttcatcctttgagcattcttacttctcactgcccaaccctgactacagctcagacttccagggctctggggacctgaaggggacagtcaggggctatgacatgcccccctctctcttaggaagcacaagactctggccttgatcaaggatgggcgggtcatcggtggcatctgcttccgcatgtttcccacccagggcttcacggagattgtcttctgtgctgtcacctcgaatgagcaggtcaaggtgagcgcggctccccggccccagccccagtccacggcccactcctgagtttgggccagttcggagcagcaggatgtgtggcatgcagcagcccgttgctcttctcttagttagcggcccgttcctcacatccccacaaggtggcagccgtactttgataactgtggattaggaaaccacctgttgacagacggagcccaagcagcagccacactttggtggacctgtggacttgggttttctgcatcacaagaacatttacatacatgggggaattaattactttactttttattttttatttatttttttgaaagagggtctctctcacccaggccgcagtgcagaggcatgatcagggctcactgcagcctcaacctcccaggttcaagtgatactcctgcctcggcctcccaagtagctgggaccacaggcatgcaccactacgtctggctaacttttgtattttagtagagacagggtttcaccatgttgcagggtttcacccaggctggtctctaactcctgaccttaagtgattcacccacctcggcctcccaaagtgctgggattacaggcatgagccaccgcgcccagccaaactaatcattattacagtagccctatgctgatagttttggcttctgtcctttgttacaacagacccactcgtagggtctctggctctgtgtgtcgcatacctcagatctgtgtggtgcctcattggccctgacgtgtgggaggcattgctcctgctgctcagacctctggtgactccctctcccgcttctcccaactctgaggcccagggactgggaatcagtggcctgtgttgggtttggacccggccctgccacggctggcagcctgaccttgaacacatttcctaacgtagctgagtttcggttttctcttctgtaaaataaaggtggtaatactcgcctctggggttaatttgagaatcggtctgtaaaacaggaagcactgcacctagcccagagtgagcttagaaagcccgcacccttcactttctccccataagctccccttcctctgtcagctgcctttcttcctctttgcctggatgctctcgctctctctacctcctttccaatctacccgctcttctctggtctctgagacctctccagcaccaggcccatcctcagctcctggtgagtcctgcttccctcccccgcagggttatgggacccacctgatgaaccacctgaaggagtatcacatcaagcacaacattctctacttcctcacctacgccgacgagtacgccatcggctacttcaaaaagcaggtgacccgtagcctcgtcccacaccggtcctttgcctggaggctggggtaattctgtccagcccctctgtggatggagtaggagtccctttgcgtcccctacttcacctgacacctgccaggagagtctccatgcctatcttctttcctctgctgccattgccccaggggagaatgagggcctgtggggccagtagagcaggccggaggaactgggggtcagtagagcatcctggaggaactagggggccagtaaagcaggccggaggaactggggggggcactagagcaggctggaggaactggggggctagtagagcaggctggaggaactggggggccagtagagcaagctggaggaactgggggccaagagcaggctggaggaactggggggccagtagaggaggctggaggaactggggggccagtagaggaggctagaggaactggggggccagtagagcaggctggaggaactgggggactcttcgggatgagtcaggagtgggcagctgacctgggacctttccagggacagtttgaaccctcacagtgccccaggaggaggttcaggagcaggaggtggcaagtggcacgtgctactcctctggtgctcccaggtgagggacgacagaagttgggaaatacttatggatggactgggtcatgaccatccaccccccagggtttctccaaggacatcaaggtgcccaagagccgctacctgggctacatcaaggactacgagg

SEQ ID NO: 995 - DNA, 1593 bp, Homo sapiens
cccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcacaa

SEQ ID NO: 996 - protein, 216 aa, Homo sapiens
MAGRGGAARPNGPAAGNKICQFKLVLLGESAVGKSSLVLRFVKGQFHEYQESTIGAAFLTQTVCLDDTTVKFEIWDTAGQERYHSLAPMYYRGAQAAIVVYDITNTDTFARAKNWVKELQRQASPNIVIALAGNKADLASKRAVEFQEAQAYADDNSLLFMETSAKTAMNVNEIFMAIAKKLPKNEPQNATGAPGRNRGVDLQENNPASRSQCCSN

SEQ ID NO: 997 - DNA, 143412 bp, Mus musculus
  misc_feature (1)...(143412): n = A,T,C or G
ttcaccctgccttctctcatagtccacagtgcctctttctcagtgagacctagactgaaggaggagcctattgggtgacctggaacctggcctggatgtgaagtcaaaagtcaaaataagccagcttttccctcagctggtgatttctgggaccctcctctggctccctgggatctgagtaaggatgggtctactgaaagctgaagccacttcatgaaaagcaacttctgagtccagtcctccagccatgcctctgaggacagcagaccagggggtcctagcagggagggaggtctgggtgcagaaagccagcagccttgggggagtagaaccttggggtccaggaagccatgggcttccttttgtcttattgagagtctttataagatgacttttgactcagtgttgagagtttgtttcaaaacaaccatgcagcaatgggttgggagtgagtgaaggctagctgagctttgccctggccaatggtgttctcactggattcccaggagcctcccttcctgtctggaccggctccctgggtgtgagtagggagcagatataaaataattataaggcatggaccttcagagtgggaggtgaggctctgtgatggggcagacggttggtgagcaaggaagagtcctgtgacagaggtggagggcacttgagctggatcttgaagactggagaagatcctgctgtatagactagagagggtaaaggtttgagtagacaggaccaagcatagagtgttaagcattgggtttctattgctgtgatataacgccgtgaccagagcttcttggggaggcaaggctttatatcagcttttcccacatcccagcccatcactgggaagtcagtgcaggaactcaagcagggcagcattctggaggtgggggctgacacagagaccacaggggaatatggggtattggcttactcctcatggctggctcagcctgctttcttatacatctgggactactagccccggagtggcactgcctacattgagtgtggccctacagcatcaataataaatcaagaagcacagcaggcttgccttaagagccaatctggtgggggcatttccttaattgagcttccttcttctccaatgactcttacttggctgacacaaaactatcccgaacaaagggtcaaatggtaggtgacaacctatagagtaaaagttggtactcaaagacatagtgtctgttgggttggtaccaagtgcatacttgtgatccctgcactcacggaaccaagaagatcatgaggttagcctggcaatatacaatgagctgtctcaaaaagctagaactaaaatccacatatatagaagatacagtgtctaaggtgatctcagagtgttcagacctctgcttggtgacaaagtatgctgccctcagcgccaccactggccctgtagtgtcaacatactttcttgtgttctcttccctcttaagtccaccagacgcgtcccattcccatctccccttccacgtgcttgctggtatgctggctgcccgtccttcagagcatttctctgtagacttcttgaaaaggctgggaagggggtctttgtttcttgcagtcatgtcctcacccgccttgaatgttccaggcagtgaggatacagcagtgaactagattcttgtgtccatgaagctttgttggttgctgaatccagctgacgtccaggcggatgctgtcttgtttagaagagccagggtacctttctctgatgagagggctctagggtggctgatgccccaagatgctttgctgtcagaacagaggttgtgtgaggcctgggttttgccttcctggctcattgctctgtaaccagaaccaagaaccataccaggcacatagtaggccttcagtaaagtttgggggaatatagctgcattgggtatgaagcactgatgttgctcacctcgggggcagttgcttgtatttatcattgtgtgttctacaggagggggcattgctatgatatgttcatatgcatgttgcatgctttggccactttcaactcccctcctccttcccacattctattttcatgttttaaaatttattattattattcatcattaacgtgtgtgtgtgtgtgtgtgtgtgtgtgtgcgcgatgtgtatgggtattagtgcatgtgtagagtctacacagtgcatgtgtggaggtcagggacagccctatggagtcagttctctctttctaccatctatgggtcctgagaattcaactctggcctgcaggcttatttatgctcaagctcctttacccacagagctgtctcttctgttctctttcttcctgtcaactctagactttgcatgaaaggaaacacacaatttttgtctttgtggtactgatttttatttaacatgaagatttccagctttatcaattttcctgaatattttcattctttatggcagagcagaactccatcacatgcccctccacccacctcccttcccagttcaactcttcctgggtgccatgtctggtcctagaactctacacttgtgaatactcctgtgataagtgtaggtaggcagggaaggaaaagtattttttaggactcagaattaagcacttctaggtagcttagtatattgactttgattttgattcttgagagaaagcagggggcaggggagagacagggagggagaagaaggagagagagagagacagaaagagagagatagggagagagagagagagagagagagagagagagagagaacaaactatgtgtggggttaggtgtgcaatctccaggctatttcagatactgtctacacacagtcaccgctaaagttctgtggaccagtgcattctgtggacagctagggtaataaacaaacaaataaacaaacaaacaagacttgtagatttgcccccattctgttcctccagactctgggcagtgacgaccttctggttgctaggtcttcaccctgtctataattctataaatagccacagtacacccctgggatggcaccatctgtttcctgccaggccccagtgacccagatggcaggcatgtcaattctctctcaaccagacaacaaattgcctaactacccattcccataggctctcttcagttaccagagaccactgacatcttgagtgggtgactgattcaggctgtgtgctgagtcccacttgtgagtctctgagggccactgccctggtaaggagggcatcctctaagtttgtgggagtgaacacgccccatcacttctgggattcaagagtctatgcatctatttctttagacacaatgaccactggtgggggggggggcaagcaagccatcctctcgcagctgaggacccctctcagactccaagtcacacaacagttccataaggtctgggacaccctcccattcttcttcctattggaataccagattcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagatatcttcccactgaagcagggccatatcactcctcttgtggagcactggggacactgtgggacttttaggattgtccttcctggggacaggtgctgtcttctctgtcttagaaggtcaagttggagggtgattgacaccctctagtgcacatttgaatcatctgaggggtttagacccgtgaaatcagtctctgtgtggggccctttccctaatggagacctcttaaatctaatgattcaggacccttcctatcctctccagttcatggtctgagaaagaacactgccatcaggtggcagtagcttgacagtacttgggtctggccttaggctcatctgtatgttcgtgatgaaagggtcagtgcacttgtctttggttttatatgcatcataaccctttaattaaacgtatcaacttaataatacctgacacattgatgctagtgccgtaagggccacttgtaaatgcagcaaatcaatatggcgccaggcagcatctccccattaatgtctagtgattaatctctattggtgggggataagcatctctcctgttcagatattagcgttagaccggttgttgaagtgtcctgttttcctcatgtcacctctacgatttctccttaaatgtcagctttaccctgcaaaagcagtgcatggccatatcagctcaaacatctctttagctttgtgaaacagaaacaaaagtgcgagtgccatttatttatccccatgtctatttccctaactgtttagagttaagttcccagggggattctttacaggatccagctgcaagacacagcagcagcagctggcaccgtaggaaactggcatagcaacgaaaagagagggctgggttatttcagggcctggagatcagagtctgtggtcctaggctgtaccccattacctgctggctctgtggtcttgggtaagttacagaacgttcagagctttggcttgttactaaagtagggattcttggtggttgttcccggtgaaaaggaatgcaagtggcttctcgtgaaaccacttcgcaaacacgaagggacagcatcaaacagacaaaaggcagggtgatggttacttttctgttactgtggtagaataccgtgagcaatgcaatttgtagacgagagagcttatttgggcatgtagttgcacagggataagagtccaggatggccaggaggcatggcggcaagtggcagacatggcagctggggcggaagctcactctttaaaccacaagcagaaagcagagaatgatctggtaacaggtccaattctgtcgcccatacttcctccagcaagagcatgtctcctaagcctacctgtcttagtaggggaactattgctgttatggaacaccatgaccaaaagcatcttggggaggaaagaatttctttggtttatatttccacaccactatccatcactgagggaagtcaggacaggaactcaaacaggacaggaacctggaggcaggagctggtgtgcaggccatggagggtgctgcttactggcttgatctccatggcttgctcaaccatgctttctttcagacctcagaatccttagcccagggatggatccacccacaattgactgggtccttccatgtcaatcactaatcaagaaaataccctactaacttgcatacagtccaatcttacggagacattttctcaatgtttcccatctctcaaatgactctagcttgtgttaaattgacataaaactacccagtgcacaatccgaacagtgccaccaactaaagaccaaatattcaaatgcctgcaaccatggtgagggtggggtggggcgggcatctcattcaaaccactacagacaaaacccaaaagcatcaaactacaagggtcaaaaacccacagctgacagaaacttaatggaatgagacgagccctccccgtaagaccagggacaggatgagggtgcccacccctgctgtttctagtcaacactttactgtaggtggtcacaaaaagaaatgaaggagatagggattataaaaatggaacacaactgtctcttcttggacatgacacgagcctgtattttgaacaataaatcctggaacgcagtaagaatcaccagactggtgcataagttcagtgtgacagcagcacgtagcgtctacatccaaaagcaatcatatttacggatgccagcaacaaattacccaaatgtgggacaaagggaacagttccgttaacaattgtgagctggtgaaatgggtggaaaatgtaacaaaagaacacaaagcctagtccttaaaactacagagtgttgaaagaaatgcaggttgacctaagaagaccgaggagatctcattgagctggttcctctgccccaggcgctctccaggttcaacccaatcctgagcttttctgcagaagccaagaagttggtcctaaaattcacaagaaaataccagaaacctagaatagtcaaaacaagttctaaacccagaatttctagtttcaaaacatgctacaaagctacatagacaatatggggctgtaataatggcagtctcatagagaagctgcatacaaacgggggggggggcggtgaggtgaagcctgaactgacactgtgaaagagaggacccagtgttgagaagccatcttcaggaggggtacaggtatggctgggaacccgtatgcccaagcagaccccttcatacacagacatgaggtcaatcctagctcagtgtgaaaggtacaagagactgaagaggtgaatcaccatgagacaagttaggcaagccttcttaggtatcatctcaaaccacgcaggatgaatatgcaataagtgggtcttcattatagtgtgagctctttattacatcatatgcttctatcatgtatgtatctatcatatatctatcacttatctatacctatcacctattggtctgccatccatatatcagctatgtatgtgtcatctatctttctatacctagaatctgcttctttatatctatttaggtatctctcagtagttcagataacttcaagttgggaaattttagattttaccactgtgggtgggaggaaggatggcccagctgcttaggaggtcatgacccacatttttattcccagagaatgccccagagaaacaagaacgtgtctgaaaaaacttgtccatgaacactggcaaatgtcctcagaagggacacacatctgaataccacgaacagagagtggattgctgaagtgcagcaccagcgctatctgccgtatcttcagggcatgtggtccaagacacagtggagctgggaccctcccacagagcatggccacatgtgagccagtctccctcctggccctgaagcactgcccacagtccgtgagctatctgtccctccacatcttctgcacctttaatcttacacttggggctctcgttgagtaacatgagggtcacccagatacaatcattgtgacaccatgatgctcatcagatagcaaagaggctacagaggaacagacaagagacactgtagatgtgtgacttcatcactcaaagggatgaggtgtggggtgagttttttatttgtagaattttccatttattactttgagactgtggctgaccacatgtcactgaagctgcagaaagcaaaataaagagatgtgattctttatactgaaaaaaaaaaaaaaaccaaacaaaaaaaatcattggagtggtgatatactgtatactgcagacatcttagagccatgatactgaaagagagagagagagagagagagagagagagagagagagagagagagagagagagagaagccagtcacagaaggccacaactggaggcagaaaatagacttgtcatagcctagggatgggaggggtggagaagggggtgggcttctcataggtacagggtttctttttgggacaatgaaaatgtataaactcaatcatggggattgttgccgagacttgtgacagtactggggtacatgggaaaatgttaacttgccttaaaacagtgaatcccgggccacatgaattataccttcagcaaacattgtttaaagggaagagacagcaaacccctggtgtgtaatccttaaatatgtcctggaactggaaccagagctggtgctgggagcctgccctcttcagaaccaggggagaaccaagggccaccacattctcataggccatgcagatgttttaatttcttttaaaatcaggaaaaaaggttaaactctgaaatgggtaaagtgcttgatgcttaacacactcatctttataccaataaggttgtaaaatacaacattttcagactgtgctggctagtttcatgtcaactggatacaagctagagtcatctgagaggagggaacttcaattgagaaagtgcctccataagactgtgctgtagataagcctacgttttcttgattagtgattgtattagggttttattgatgtgaagagaccccatgaccacagcaactcttatatttaactggggctggcttacagttcagaggtttagtccattatcatcataacgggaagcatggtggtgtgcaggcagacatggggctggagagggatctgagagctctatatctggatcctcaggcagcaggaaaggacaattagccactaggcctggcttgagcttctgaaacctcaaagctcacctcccagtgacatacctcctccaacaaggccacatttcctaatagtgtcactccctgtgggcctttgggggacattcgtatttaaaccactacagtgtttaatgttggagcatccagcccatcgtaattggtgccacccctgagctgatggtcctaggttctataagcaggctgagaaagccaagggcagcaagccagtaagcagcacacctccgtggctttacaccagctcctgcctccaggttcccgccctgcttgagttcctgctctgacagcttttgatggtggaatatgatatggaagggcaaatgtgataaaccctttcctccccaggctgtttttggtcatggtgttaatcatagcagtattaatcctaactaggatgtataactaggagggagcatcctagttagggtctcactgtgcagcttgggctgtcttcagagtcatgatcttcctacctcagcctcctgctgggactacaggcatctgtcactatagctgggtgacatgatttccgtccttagttttcttttctatgtaggaaggaggtcatgaaacaaacaaagaacctgggatctaatctgtatgctgcaggtctggcctgagtttgaacatcccacttacctccctacagctttgggggaaatatatcattaaagaaagtttaaaacaatttactcaaaatctaacaaaaaaattcaattttccttctcgaggggcagtgtcattgaacttgagcccaggtccttatgcctgcttgttgctctgccaccaggccagccctttcttcttatcgctcccttccagaatgttcttgcttgtcaacacatctctctttataatgttgatgataatctcagcagcgctgtttggctgtttgacccaggcttgtggctcagcatctcagagcctcgtggtcttcatctgtaaagggagctaagggtcgagcctcccagtgcaaagcacaggggtgaaagcaagcctgcctgagccacggccatggtgtctacctgcctgtgtgtggcctgatgcattgggggcaggagtgacacaaattagagaagagagaaatttctggaaggacgttcaagacccaatgtgaccaggccttgccttccttatcccctctgccaccactgcattcctggccttgtcattgtcatgtggcttccaggaagctcaggagctagaagaacttcagggaacattgtctgaggactatggaggctccagacagacgagagtgacggagtcagaaagggtgtggagagcctggacaggccagtgtctccctgggtccacttttttttaaaatgagatatcaaaggtgtgtgtgtgtgtgtgtgtgtgtgtgtgtgtgtgtgcatacacacttgtgcttcacatgatcagtgtgtgcgcttcatgtggtcagcatacagaaaggacagaagagaataggaggcacagcctggtaggggtggaggttagaaggaaaggcaggacagaaggcagaggagctcaggcctctgacttggccagggatgggagctggtcccccccgaccccaagctcctggcataaaacagggctgcttggaatcacagctaaggaagatgccttgtgggtcaggttgggggcagtgttacttctgggtctcttggagggggacaggcaaactgggaagttgtgttttctcactctgaaacctttttttttctttccccaggtgagaaatgtcgcagcttcattgacctggctccagcgtcagagaaaggtaagtagttagctctgccctccctggggacctgccctaccctggtggcttgtcagagcctggggtttctctcttgtacctatgaggcttcctgtcacatagcactgtctgtctctgggtgcagaggacaaagtgaggaggccagtggaggaagagtgccttggctgggtcatggtcctacctcatagacctgtcattaccttagaaagttccagcaagccaccttggggagactgagggacaagggacaagaaactcagtgcccttctgtaggcaggaaggagcgagtgtccagctgcagggagagactgtttcctctgcctcttcaggttccctggagacatttcctgtttgtgcacatgtctgatcctgaggcacttggttgagccagcaggatctgtgtctgtcttcaaccagagattagtaggaatcgctgtggcaagccagcatctctcacagacgggaatggtggttgccaggggcttggatactaattgtcagggtccagcgttgtcagccaagaccgctatcgacctcctgatgaagggtctgtccctctgcactgatgatggggaaacatcccagagagattatatcacccaaatttcagagctgggcttttaagacaggaccttgagtccagtgtaggcttgcctgagcaggattctatgtgcacgtttccttagcatggtgggtgagttctgcagatacattcagtgtgagcatgtaggcaccagaacacccatgtgtactggtggttgtgccccggggcacaccggcaatggtgtttccatgtggtgccctctataagtagcatgtgtctgtgtacagtgtgggcaggttggctgttctcttctagagggctcaaacctcccttgctttctttatggggactgagggcccccaagagtgaacgtcatctattttactggtggtgcagtttgacttttagggcttggtggccgcgccgaggaccgtcagatggcatatatcaaaatgtttatgagaaggctgtgtgtcgggctttgttacctagtgatagaaggcttttctgtccctgctgcctctcaaagtccctggctttaactctgtgttgccctgctggtttgtggcagctgcacggctctcctagatgcaccccctccccccagccccctgaggccccaggtgcctttaggtcaagttaattaaaccccagcttccctctgaacttgattcttcacttcaaacaggagtgcaaagcaaagcggagaatgaaccattccacccctgggggtctgcattgagcatttctgtcctgacggcgtgttcattctggtggctacaccagtttctgaatcctttctggggtctttctggtctgccaatgtaacagaaaacccccttcctacacacacacaaacacacacacgcacacacgcaaacatgcacacacacacacacacacacgcacacacacaaacatgcacacacacacatgcgcacacacacacacacacacacacacacacacacatgcgcgcgcgcgtgcaatgagcctcactgcactgttctctgggctctgttctttacacacagtcacatgactcctctctcgggtaaggaaatcagcgtagtatagttaggagatgagattagaacccagctctttccttgttcttttcttttcttttaaaaaaaaatgcttacctttccatattgtgtgtgtgtttgtatgcatgtctggagggtcagagggtaatttgtgggagataattctcgcttccaccatgtgtgtcatggaggttgaattcacatcattggggctggtggcaacccctatgagagtcattttgctggcctgtttgtttcttgagacagggtctcctgtaggctgggctgactttgagctccagctcttcatgtctctattgaacctggttctcagatgactgtttctctgctgacaagggagatctaaggggttgtggggagcctgaggaccctgctccatggcctctgagggggttcaggccagcacttccctccctgccttagtctagacattttcatgtttctgtgacaaattatcagctactgagccgtttggtggccaccatgatcttactcctcacctaattatgatggggtgacccagatcctccaacatgttgggcaggtactcaccagtgagccatatcccagtgtcagaatgttttttttttaattaattacttatttattttatgtgtatgggtgttttgcttgcgtgtacaccatatgtttttacaccatatgtgagctttgtgcctgaggaggccagaagagggcatgggatctcctgagactggacaattatgagcctccatgggggcgctgggaaccaaacctgccctctggaagagcagtcagtgcccttaactgctgagctatcttctagcatgtgtgtgtgtgttgtaatgttttatcttgttatagtccaggctaacctcaaactcaacatcctcctgtctcaaactcctgtgtgctggactcacatctaacttagaatgcttttttctttttgaaacataaatcacttaacaggatccccttgtttaaccttcctgtgggccacatcttacttgggtaaactcattgttgttgctatggcctcataggccttgtgtgacctggccctctaccctgaatgccatctcctgccacctcccccttcctcaccacactccaactccagaatatttgctgggccctgggtcagccgagctgatgtgtgtgccccagggcctttgcatgtgctgttccctggactactgttcttccaggactctcacagttatacacatttaggaaagttttagtaacaccaaagtgcatattctagagacagaggactctacaagatcccctttgtcggccactaatactgcgttgctttatcagtgtttgcaaccatgtgcacatgcatacttgtgggtggagatgcccaggcatcttacataggtggaatcatgaattccttttcttatcggtaccagtgacttactgcttacccttcttctccctcctccctcttctctcctccttcctccttttccttctgtgctatgggtgaaccaagacgtagtccacagttcaagcacagtttctacccctgagttgcatctaagttctgtctttcttttgtgaatatctatagactattctgtcacatgtagacttcatttatgcagctgaatgcccagtctgagttgcttttgcacttggagtgtcctgtatcgtagttaacccttgggatgctgcacacatctctctcccactaaggccaacacactccctctgatcttttagtgactgaccgtgacctgctctctgacaggggtctgtgtggcaggcctcactatggagggagccgactgaagatgcctgagctgacccctaccactctctaccccctatgtgttaccaactccattctgaaaatagacatgaattcccttatttctgcctttccctctgccctccagtttccctctgtcttatcacctcggttactattcacagggacaaaagtgtcttaccagtcaccctgagcagctaaataatatcttgaaagctggtgtagcagtcaccaatatctatagcagtgctgggtaacacgccgatctgccactcggttgctcgtgtgcctggagggaaggctgagcattctgtgatataggctgacttgattccaaggatgcaggctggtcttaagcctgctgctcatggatgcattcaggggccaggtggaggagcctctgacagcaatgacagaagcacggggaagagaggctcactaggtgggcacgcatgaggtctttgctgtgtcaggcccaatgacttgtcattggtcaaagcgagatttagggccagggccaacattagtggggcaaaaagtgtgccacccacaaggaggctagaatgcagcaggttgccaacagaatccccccaaacttgggggtgcacagatacaagatggtggtggctgctggtgccaacatgactttgaccaggttgtgagtgtgtgagacttgttcatttgtttcttaacatttctcctggttattgtcaggacctcagtttcccctgaggtggcctgacatttggtggggataactatgcagtccctcaccactcaccactcaccagtggggtcccttgcgtgtctgttacagtcacacagacttttctgacagacgtgtcttgagcgcttatttatgcagcctgggcaggcacaggaggtgcagggggtggggggtgaggctggcctagaatactgtccccagagtaggagctaaggaaacagctactgagtagcagcgggctctgaagtaagaatgaaaaatccactccgctgtaaaacactgggggaaatctctttcttgagaatcagaaaaggccatgtgatgctttgaattcacagcagtcatgacgaatccacagcagtcatgaagatggagccaacaggaatggaggccaagctgttggccaaggtgtgacggggtatgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctccctccctccctcccttactcctccccttcctttctttctttttaccccaatatgggtttttgtgtagccctggctgtctggaactcactctgtagcccaggcagacctcagtctgtcccccccccacccccccgcccagtggtgggattaaagatgagtgccaccacctattaaaagctatatatttagggctgttattatggaatccccttgaacattatcttggaatttgttcccttcttcttattggttctcagtttcttgggtctcaaggccattgtctttctgttgccttctgcactgggaaaatatctttaggaacttcccaaaagggagagcatgattgactgagaccgcttctccatcacattcggatgatcgtatggccaagtggtttgttgtctgagtcctgttcccaggctcttgtttttctttcatggacatgaggcctcctttcttttggatgtggcctttgaacaatcctgggctgtactcttttccaagctctttggcttattttagttttaacctctgtatttttcttatcctgtatattttccttaaatatatggttttttttgtttgtttcttgtttttatgagacaaggtttctctgtgtacccctgtagatcaagttggccttaaattcacagagatctgcctgcctctgtgtctccagtgttgggattaaaggtgtctgtcaccactgcccagcaaataaagttttaaattctttgtttattgttatttttttaaacagagtctcactaagtagcccaggctagccttgaacttacgacctcagcctctagaatactgggatgacaggtgtgcctcttctttaagagcaaggcatgagccaagaatggtggcttcctgggccctgcaacttctcctgtgttctagtctgccccttgctgccagttggccacctccctgggagtcctccaatctgcacacacagctagtccttcgaaggaacatcttccctgcccatcccccaggcctgggagttagccttctgcaacttttccttttccaggtccaattccacgacaagcacacctctcgcctctaaaggaccttgaacctcaccctctcctgatttcacagtgtcatctcagctggctgcctgcattccaggctgcacagcttaaaatccattctgcagccacagaatactctagaagaggccaatgaacgtgaacatctgacaactgcttgcagcaacattgtgaggctgaaccctgacacacagagtgtgcaggtgagaggccagcaggcagccctggaaacctgcctctctaccttccatcctaatggctgtagccccatctctcttctaacatctgtttccctaaccctccagcatcttctcatgccttacaaacttctattcatacttcaaacccttcatagacatggcccattttgaaaggccatccctgaacctcaccaagatgtctgtctatagtgatgtgtcctgtgagcatcaatcacactgtattggaaccattgttctccctgagaacatgcgatgtcttgtcctctactgcactagagtgcaaaatatatcgacacagcaagggttagtaaaaggtttgttgaatgagaaggggagagggaaaggggccttaggcagagatgctggaagatacctttagttcaggacctggatctaacctctgtagcagttgtctgctccagcctgtgtggctgagctacttcaacctgtttccatcgttgtgctgcagtcagtgagccaggaattttgaagggtaccaggtagaaatctgtgagaaacaatgtcataagctgctggttttgcctctcagggctgtgaagcagctctgagctgatccaggctttggctgagtcggttttcagcctctcaactgctctgccctgaatcatatagtgcgcaattcttctgcttacttaatttactgcagtttagtgattatcttgtagacgtatggggtgtgtggagatgacaacatacttgggagagggtggaaccgactccataggggcccaaactgctattggcatcaccctagggccaccgctgtccagcagtcctccgtaccgccacttgggctccatagtaaattccaggccagccatggatctagagcctgtcttaagacaaacacacagcagagccagctaacctggtgccagtttacccactaaagtagacacactgttgccttgctcaggagcagcctgtcccatcctgtgtcacctaacctggtcctgcaattgcccctctgtgtggagctgagtattgaggagaattccccagccatgtttctagcagcccaccgtctggagcagcaattctcaacccgagggtcacgatgcctttggtgggggtgggggtcaaacaaccctttgacaggggtggcctaagaccatctgtataccagatatttacattacaattcataacagtagtaaaattatagctatgaagtagcaacaaaaataactttatggttggaggccaccacaacatgagaacaaaaataactttatggctggaggtcaccacaacatgaggacctgtatcaaaggaaggcttcattaggaaggctgagaaccactgagctagagggaacaaagtgtcagagccacagtctgtgggcagagaccttcaggagcataagtgagggaggggtggctgatgcaggaagggtctagaagaagtggtttcttgtctgaccttagggcagcaggaaaaaatagctctgtgggatgaatggcctgtgaacacagactgtgttgttagtatggagacggtggcaggttcgcaggagaccctggtgaagagctgaacaatggaaggaagaaagactcagagaggcattcgtgcttgttcaaggttacacattagtctgtggtcagtgctgtctccctccctattgttgaggactttggatcagtgtcctgcgcaccccaccactcttccagctgctgagcctcagggccaccagcctgaacccccacaccctggccctctctgatcctgcctttctttcctggagttcagcatctctaattatggactagtgtgaagcccctcagcctggggggaggacgactctcagatcacaacatctaatgattactttagctgctccaattccaattacacaggattacctttccaggtaattagggatctgggtagctttgcctgctcgttctctcgcacagggttgtattaaccctgaccagtgaccggctttcatgttctataattggaaatactttctctgtgctgagaagcctgttgagcagaaacagtggtgatttaaatttctaagtggctctgtgggctcagcacactctgctgagaaatcgccgtgcggctctggggtctacaggcttggcacaggattgggtagtgtgcatcctgcaccagaatccatagctttagttaaagagaacttttgcctgcaagtctaccctgcagctcagtgctgagcgtgggatgtgctgacacttgtaaccagatcttagcccgtgtgttagttcactgacattgtaacaaatacttgacataactacaaagaggcagggtttatatcagcatttagtgtggaaggctcaattccccgattcttgaccctgccgttttgagcctttgcaggcaacacttctgtcagggttaactgacagagcatacacagagggaaagatggaccatgctcccaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaccaccaccaccaccaccaccaccaccactaccacacatcacacacacatactcccataccacccccccccacaccataccacacaacacacacaaacacatcataccacacacataaacaccatacccacacataccctaccataccacacacacacacacacacacacacacacacacacacacacacactacacacacatacatgcaccagctttctcctgttgtagtaaatgttagacccacctgacccctacagctaacttagaaatgttgaggctgtctctgtaccaggctggggaagaggaggagacatcttgtttgattggcaggggccgtggagttctctgtcatcagcatgtctcctgttccagggggaactactagagtgaagagaattctgggcaaactgggtcagggaggtgagccgggcaagaagggccaggtgagggtgtgccaggaggggctgctgggggaggggtgggagttcaggggctctggtgactccccagtcctctgcctcctgtgtcttacattggttcctccttgctctgcctgctgcttcaaaaaagggaccaactcctgttcccatcctgccagggaaggaagacgccagggtgagatcttagatgactcccgagtggccacatgccaaaggctcttctttaagcttggggcacgtctcagagacagaaggagctccagggacagggcctggtgagggcaagttaggttgtttgggatgtgcctcagaaggggacaccaggacccttccccccctctctgctttctgcccaccgggaaggaagccacttctgtcgttcacaggcacaaagcaagtagccaagagactgaagccggtcgcagccatgtcctccaagctaaaacacttctttcaggctcaggaagcaaacctcacaaacccaaggagacgtctcaaaaagacgaagctctcaggactgctcctgcagtctgtgcaaacaggaacaactgaagggtggcatctgtcggggtgaagcttctgtgagttacctacctcattaagtgacctcagcaacctcactgcctcaccaggctggatttgggtgggagtctttctttagtctctcactgggaagtctatctggagtgaacagagattcgttcatgtcacctctgaaaaatcccatgacacctctgaagctgtaagctgtggtaaacctttccccatttcagatgactcccctggggagtttgtcccaccaaacagaaagctgaggcgggggtctggtctcagctgccattttccaggccaggagctgaggccgttgatggagctctgggctgccacctgctctgtgtagtaaatcttccttctgtatacaatctctaagaaatggggtcccccttgctgcgccctccctcagccctggcacacagaagacatggaatgggcaccgtctgcatgccagtcccctgcaggcatgcgattctattgacgcctcatcagagcccgcagaggtgttttggtttctcttgtttccccgagcggggaagttgaggcttaccgagctagaacagggccacgcagtgtcagagctggggtttaattccgcagcatccgaggaccatgctaaagagcatggggtctgggttcacattccggctgtgcctcagtgtccgcagagcaccagacaagctacccaccaattatggctcaatgtcccttctgtaaggcgagggtcacatcacagcttgtggggttctgagacccaaaatgagatgatccatgcaagagtaggtcaacaaatatctggttgaatatttcgttctattcccctgctcatcagttccccctccccctgcccttcccccctagcctcccccctccagtcatgagctaacttgtgtttctgtctattcaactaatattcagctactccactgagggtggcaagagtcccatacaccccaggcacttccacagccttcctttcatcccccctcccccaccctagctctctgacgtcataacttagctctggtgtatgtcagagctgtaagacagttgactcagagaggttgatcggggagcctaatgacacacagcatcatggcaggtcctatttggctttgtgccacttttgcccggttggaaatgccaccccacctacagttctggccccttgtttgcttcttgggctctagacattctttgggttgctcgctgtgtgttcccacagcctgggaggcccctgccttgaagcggacagctgtcagggtccacgtgttggagcagctgagggaatccaaagcccccctgctcttgctgcatcccatctgctgcctcccacagccttgtcatcggcaaccatctgccgggttccccagaggcattgcaatgcttgaatgtggcatagatgcccaataggctttgtggccgtgtggatcagggagggacccgtgcctgcagttcctggaaccttgagctccagacagcctccaagtggaggtccttggaggccagagtccacctagcctggtgctctggggccagctgggtggcagtggataccactaaggttcctctggcttcccagcctgggctgtcctggccctgcttgcctggagcagccaatgtgataggctggaggcagggcttctctgggctgcttctgcctggtagcctctgacccttgtctaccccctgtttgtggatttgagtggaggctgtccaatcctctcactagcttctattgtttgtggcgctggggacagaggagccttgagcttgccaagccaacgcgctcatgtctagtcacaccccagcctgttttaagtcactgtgatgatagttttactgcaattttgttgtcctcctggggaattggcccatggaaagtgtccactttagcaataggttcagagctgtgtgcccactgccacctggtgtagtgcatctttgtcactcagcacctgtccctcctcagttggcccccaaactagacagcagtcattgtagaattgtggcctctgtggttgcgttcacttctaaggggtttttcaagagttatcctctctctctctctctctctctctctctctctctctctctctctcactctctctctcactctctctctcccatcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctgttagttttgctgatttgctggcagcatctgtgcctttttttttttccatcatgaaaagcattgaaaggttgcccaggcctgtttatctagttgcctgttgcaaacattcctttgtgactgtcctgtgatgtttctcctcttccttgtctttttgagtaacggcagggtcctctgtgttaagacttccagtaggtagtatgtgtatatattgggggtgaggcacatgtgtgttgggagagggtggtggtccactctagcagtccctccacagcctcgggggctctcttcattttcccttgcattagaggtaacaggttagccctggccacagggttcatctgcatgtggagtgctgacttctcatttgagcacactggtgtcctgtgcaccaggcccaacctcctcttctataatggccttgccttttctgatctctggagttttctctatcaagcccctgactatggaaagagaacaaactgaatgtggccagctcagcctgggcatggttcatcctattgactataactcagtaatatggctgtgctcagctatatggaacattgggaaatgtagttttattgtgggcccaggagggacaggaaacatgatatgtggaaatgcttgtcatattccacactcttttccctgcctcctgggccagagaagcgtgggggagggctgcaggagagaggctactctggccttctcttcccctagatgtatggcaggctgtgaaacctgtagcttgtgagtgtgaacgtccagacccctgcaacccacagttgctgctccaatgccccggagctggctttctgtattccctacacttctgaggctgggagcgcggggtgggggcagtgtggggatgaagggaggtgtggacagatatccctgtgttggttagagatttctggaggagacatgaaactaaaagagagcagacatatctccagaagcagtttctccaaggagcggagcatggcgcggagggtttcaggatacagaggataagagagggggaagtttgaggaaggaagcgtccatctgcgggtcagttccccggtagtggtagtcagactgccttctggagcttctccgtccgccagggttcatgtcattaacctctcatcctgcctgctggacacttgtccactcagaaccactgggagagctgccaccctctcgatggcttgtcactttgaaattggagctgagaatcagaattcgaagcttatccgctttcaggtgctctgttcctttcagatcccgaggtcactgcagattcacagaacacttattgatctattggagggccaccacacccaggtgtgtgtgtgtgtgtgtgtgtgtgtgtgtgtgtgtgtgtgtgttcatgcaggggttggttttgcttggccgggattcactccgtcctgtcagttcagaatgctctttctctgccagggaagccagaggcggtgcagaacctggggagacccctgactctgtgcctttggccggagcggggttttgtttcccattggttaatatggtcctgagtgtgacgaaagggcacagtgtgctccccttagaaggctcctcacagcagggggaggtctgcttgactagatgctaatggcagacagtcgcctgggtccaccctgccaggctgtggcattgtgggatgtttctaccaggacactagatgcttattaaaggatgttttcctcaaggaagacctttgtggagcctggaattctgatccttgggaagtcaagagtcacgacattcacaagatggttttcttcaatactagggagtctgaaagaggaggaccgctcgattgtcttcatgctgtcattggacaggggctgctgaggttcttggagaaggacactcattggctgaaggtcttagattccacaacccatgtgcagttaccagggtgacgtctggctgtacttgggatgggatcaagttgccaggcaagtgttcactggggtgtgtcctctgccgagcatcctgtgggctgataggcaaggtagggaaaggccttctagatggaggatcagcagatgtgaattccaggagcacttgtgggttgttctgtctacagcagctaccagctccagacaaagggatttgagaatagaggggagataggtgggaagtgtcagtagggctggggtgcaacaaacaccaaaagtcactccaagaggggctagagagatggctcaaaagttaagagcatttgctgctcttgcacaaaagaccagagtttagttcccagcttcccagcacccacactgggaactcacagtcccctgttatttctgttccaggggatccaaacccccttctgccttctgtgggaacctgcacacatgtgcacatacatacacgtagacactcacacatcaataaaaataaatcctttttatacacgtcactcacagagcttgggctccctggaagccatgcagagggcagtatatggcagtctgaaggctgatttaccggtgtccaggcagaaggcggcgtctatgggagcagcatcccagaaggcaactgatcaggggcagagagctggggttctgtgtgtatggaggaatccagtgtcaagtgatagcttaagatctggactcagttccacaatcataggaagaaagaccagttaggccaggcacctctcaccaccggaaatagactcaggcacagtcccataactgtcagctccaaatctctccctttcctatcattgtgtagctagacggggaaggagtaagaggagacagaggtccggccttttccagcagcctctctggggcaaatggggggatatttgctgctggggccattgctggagtagacaaactttgtctgcatgctacccaaacacgatacttgagaggcaagatttggtgagaagaaaaatcaggtttattttaggattgatacagagacaacagggagggttactctcctcccagcaccatctggaggaacccttgtataaagtcctcttacagggcaggaaaagaaagctgagagtgggtgggagtcttcaagtgcctctatatccactcccccaccatggacaaaatatactgaccggccttcacctcctggggctagcgcctctaaatctttaaaaattccattctgcccatcatcaccttaggcatccatataacctgaaagtcactggatgctccgggatttgtaaacctaaggaaagattatttagcacgatcatttagactgtagaaggccagcaaagaagagggggcaggcacaggagactcacacagtggccactgtttccaggatggggctcctcacactctctgagcaccctcagcttctggtcccccttggtgtcctctctccagagttctgctgtcatttatctagaacacccccttatcataccctacttccttctgcccacaaatcccacagagccctgttctatgaatctccctgttacctgtcttgctctcttcataggaccttggcctctttgaaggccctgccagcttcattcagtgccaaatcctagcatggtattggacatcactggggacttggcattggtctaagtccgtgctctagagcctttgctgagcctctgctgagcttctgctgagaatctgctgctgagcatgctccatctcatcagccgcgcatcctttcagcaagcccacggcacagctgtttcttcagctccttctttgcagaggagaactggggcctggagaggctgaccacattgattatgctcatacatctatgaagcaatagagtcagtagtcaagcccagagctctttgagggagggggttttattttcctctgggttccctcaactttccagtctcttccacacactcttgttcttgaaaataatattcttctctcatgtattacatctcaactacagtgtctcttcttccacccccttcactttctttcccctacctcccctcagacaagagcaggtctcccagggacatcaaccaaacatggcataacaagctacagtaagaccaggcacataccatcacattaaggctggatgaggcaaccggtagaagaagttccccacaagcaggcaagaagtcagagacagtctctgctctcactgttaggagtcccacaagaacacctaactacttagccataacatatgcagaggacctaggtcagacccctatagacttcctagcctcttcaagttcacttacatcctggtcaattgattctgtgggccatgttcttgtggtatccctgactcctctgttcctctgatctttcctctccttcctcttcctcctccaaaggactcccccagctctgattaatgtttgcccgtggactctgtatctgctcccatatgttgcaggatgacgtctctggtctctctgatgatggtgtggtaggctctggtcccagaacactccacaggcagggcaatctgtaggtcgaagattttgtggctgggttggtgttccagtctcttcacttgaagccttgcctggttgaagatggctggttccgactccatcatccccagcactaggagtctttgctagggctgctgttatggattccatggagtttccattaccctaggtttctacctcactccccaaatgccctccaattccagatgtttctcccagtattttctcccccaacagctgatccctcctgttcaaccctacccatctccagtctaccctcaaaatctattctactccccttcccagggagatccttgtattcccccccttaacttctccttgttatttagcctccctgagtctgtggattgtagcacgattatcttttaatttatagctattattcacttataggttagtacatctcaagtttgtctttctgagtctgggttacctcacacaggatgatttttcttagttccagccatttgcctgcagattttatgatttcatatttccttatccattcttctgttgtgggacatctaggttgtttccagtttctggctattatgaatacagctgctatgaacatagttgagaagtgtccttgtggtaggatggagcatcctttgagtatatggtcaggaggtgtagttgggtcttgaggtagatcaagtcccaattttctgagaaaccaccacatttatttccatagtagctgtacaagtttgcattcccaccagcaatggaggagtgctccctcactccacatccttgccagcatgtgctatcacttgagtttttgatcttagccattctgacaggtgtaagatggaatctcaaagtagttttgatttgcctttccctggtggctaaggaggttaaacttttctttaaacgtttcttggcctctgttgagaattctctgtttagatctataccccatttttaaattgggttatttggtccagtttcttgagttcttttaagattttggctattagtcctccatcaaatgtggagttggtgaaaatcttttcccattctgtgggctgccattttgtcctattgatggtacctttgccttacaaaagcttttcattttcacgatgtcccatttatttgttgttgatcttagtgcctgcatgattggtgttctgttcaggaaggtgtcttttgtaccaatgcattcaaggctattcctcattctctcttctatcggattcagtgtatctggttctctgttgaggtctttgatccacatggacttgagatttgtgcagggtgatagatatggatctgtttacatttttctacaaccaacatccagttataccagcaccatttgttgaagattctttctcccccccccctgtatatttgtggcttctttataaaaaaaaattcaggtgtccataggtgtgtgggtttatttctgggtctttgatttgattccattgatcaatgtgtgtgtttctatggcagtaccaagtggtttttgttactaatgttctgtagtacagcttgaaatcaaagatgatgatacctccagaagtccttttattgttaaggattgtttaacttcctgggctttttggttttccatatgatgttgaatatttttcttccaaggtctgttaagaattgtgttaaaattttgaaagggattgtattacatctgtatattacttttggtaggatggctatttttactatgttaatcctactgatccatgggcatggaagacctttctattgtcttataccttcaatttccttctttaaagacttgaagtttttatcatacagatctttcacttgcttgtctagagccaccccaagatattttatattatttgtggctgttgtgaagggcgttgtttccctgatttctttttcaacccatttgtcatttgtatataggagggctactgatttttttcaattaatcttgtatcaagccgcatcagctgtaagcattccctggtagaatttttggggtcacttatatatagtaccatatcatctataaatatgttgacttcttcctttccaatttagatccccttgatctcttttagttgtcttatttttctagctagaacttcaggtactatattgaatagatatggaaagagcagacagctttgtcttgtttctgattttagtggaattactttgagtttttctccatttaatttgatgttggcttgctgtatattgcctttattgtgtttaggtatagaccttgtatccatgatctcttcaagacttttatcaagaaggggcgttggattttgtcaaaggctccatctgatgagatgatcataggctttttcctttcagtttgtttacatggtggattacattgacaggtttttgcatgttgaaccaccctgcatctctgggaggaagcctacttgttaatggtggatgatcttttggatttgttcttggattcagtttgtaaatattttgttgagtatttttgcatcgatgttcatgagggaaactggtctataattctctttgttgaatctttgtgtggtttgggtatcagggtgactgtagcatcataatgaatttggcaatgttccttctgtttctgttttatgaaataatttgaggagtattggcattggcccctctttgaaagtctggtagcattcttcactcatccctcacttttaagccccccccccacccttagtttggtgatggttgagaggagtggccctcagaatacaaacgtggctacagcctgtgggtgtggtgctgtctccctgcggatgacaggtgcctggaaggatcacttgtcccctctggagttctcagccttcccttaggactgaagttgacaaactctttgagatagagattaagagttaatttggttcagcttggcaccagtggcccatgtgattcaaaacacaggctttagcctccagcacagctgggtctcaggcagggctggcccttggccagcactgggctccaagcctatccctggacccttcagactgggagactagggtggcaatgacacctcaggtcattttgttctggttcctgataagactgtcaaatgtctttccagatgaaggttccagttgtaggtcctctgaccttcacattgtatcacaagcgctgacctgttggttacttatttgaacaccagttgtgtaccttcctgctgtgacttctctaacctggccttcatgggcatgtttttattgaggtcaaaactctgaggagaagagcaagctgatgctactgctctaatcaatgccaaggctatgattgtcgttgcatatttccaatgaattgactaatctacagttctttccctctagtcctgtgccaccatacccctgtgtactggccacatccagttctgtgtgaaacatttatgtttgtacttgttctgatgcacatatagctttctatgtgtgcttaaatgtagataaattgtatatgtgtcggtcagtaaggtctccaataaggctgtgtaacaaataactccaaactcagtgatcagtgtacagaaataagcctaagctttcttgcttgtgtctgttggttgctgtgacaggtgcttgaggttaatggatgggtggggtccaggttagggtttgggttggcttaacctacaagtctcccatcatcctggggtatctactctgagaatattgccagagcaatagcagaaatgcaagacggatgagtgtaaatctgtgatgcctccagaggctcagctgggttgagacatggtcatttctgtccatgctgcctaaacaacgcatgtcagagacccactgttaatcgggaaggagcagcaagtggagatgttttgctaacaatgggccacatgagtaacagtggccccataacactaaaaacagctaaaaaaaccaatcacttcttatgagtggccattatggtgacactgtaaaacatgttatgtgtttgtggcaatgatggtgtggacctgccactctgcctcaaggagagcagtgcattcatgaaggagccccccacctatgcccacctatagtggtaacactgggcggtgctgtttagcaacttactattctatctttcacctactttagagtgtggtcctacttattaataaccagttctagagctggggccatgatttggtagttaaaagcacttacctccaagcctggtgacctgagttaaatcccagggcctaacacagtgaaaggagagaattaactctcacaagttgtcctctgccctgcacatgcatagcatgataagtattcatgtgtgcacacacatgaaccagatagatagatagatacatagatggatggatggatagatggttgtaggtggattgatactattttaggggcacacatcgtggtacatctgtagtatcagcacttgggaggctggggcaggaagatgactatttcaagatcagcttgggcagtgtatctagtacaccctctgacatacatagtgtaaagtatgccatgtcatggtgacaaaagcagccccccaccccctgcagcttgtgtgcagctagtctctagatgcatcaagagaccacactgaagccaggcatggcagtggccatctgttatctcagaacttcagaggctgagacaggagaatttcaagtgccatgacagcctgagcgacatggtgagacctggtctgaaaaagaaaagttaaaaaccacattgggtgagtgacatctgtcacaggtgtgtgtaagtgccccgtgagtgtgcatgagagggtgagattccctggtgctgcatgcctcgggatgtgttcatgttgtgaggccagacggcacattcagctcacatccggggaatgctgagtttcctgaatagtgactcaggccatcttgctgcttcttagttctccacaagccccatgtttgtgacctgctcatatggctgtctataccgacccttgccagaagctgcaactggacagaccctgagcatggttttctttctagtggcggatgatgttgtggttctgattccctataacccccgctgctacatggaaactcatttgtttatcctgtcctggacctctgtgaacccccctggggaggctccaccccgaggctgcatgccatatgccgtggtattggtgtacttttggggggtgctttatcaggttcttatacctatcaccccttcaacccttattccaccctaatcccttccaaccacccaaccaaggagagaaagaaagctagaagggaaagggatgtagacagacatctttagactacttcctgttgaccaaaggcacggaattccttgcatcaagtctagtcttcatcatcaggatatccagtgtcttcttgttgtctctttgctcacaactatttgacagaccacagcaacaggaaccaacagcagtctcctcagagcaccccatccctgctgaggctctcgcatgtgtaccctctcaaaagttcacagaattccaagcgtcatacactctcagaaaactatctgcaactggcaaaaccatgttcctgctagtgcacgaggcaaatcataatcacctgctgtaaagcagcctcttgcctcacacctaggattcaaacaaagacatctttcacataacagaactgttttttttttttattttttagaaaccaaagtgttgactacacctgttagatggagatagttatggatattcataagttgggtgggcagtgtgttgtgtaactgtcagggagtgtgatgacatgaaccccagttctgtagcctaccacacatccagggaagacttggcccagcctgctgctcccacacatgaaacacaagattgagtcaatcctgagagaaagtgaaatcacaggactggctgggacagggctggggtggtgaccagtgggacgtgcttaaaagggagcacctggcatccacctgacagaaaagggaaagtaagagctgcaggaggctgctgcttacaaactgggtgctcttcacagccagccctaggaacactctcaaaaatagtgttcaagtgtggacttgtaggtctgcaagccggaagcatgaggcttgtggtcatctctaagttcagttcacttatccactctgacttatatgaccggctgaaccatggacctgttgaccgcagtgtcaacacacaagggactacagatgccatcagggaatgtagatttttttcctgcctcagatggggtctcactaggtggcccaggttgacctggaactcatggcaaccctccagcctctgtttcctgagtgttgtgatcccaggagtataccaccatgtctgattcattagctcctgggcctgcagtcatacacgatcctgttggtgaccttcaggtcatcatacatttcgcaaccacttcattttcaagctctgggctgggtctcctccagctgggtgtgcccacccagtcagtacagggcaggaaggtacttctccatgcctttctgcacttccctgattagttagtagtgggtctgagaatgtcttcgtgccctgggactccaattcagaaccctctgatctgggtggactcctcccacccagcatcctgctagtcctcctgtctagcatccttccactgtgccttttccgaggagaaaggctgtggttagggagagggctggcaagccagacacactggctcgacaacaggccaaggattcaacaaggatgaagccaagttcgtctgccttgtctctggcattaattatttaaccttaattagcagctctgagcagagaaacttacctcctgattggtgccacagagaaccccaaggaagacacagatgtcacctgacagatttttcttgatagcgggggcattagctctaggaacccttcccccccacacaataaatttcaagattgctccagtaccttatataaataagcacgacatttgtacacaacctacacacacacacacatacacactcctgcacataataaactgtctctaggtggctgacagggccagcgagctgatgtcattctgcacatgctcagttatgggcacaatgcttttaagaacatatttttgctatgtggttgtttggatctacaggtctgggactcatggatagagtaagccatgtttgttttgttatgaatggcatggagagaaggatgacaaagcctttcctgggcaccttcctcagtgccctgctgatcaagaaaagaacatgaacatgtgagtcagacccacagtgtgctcagcatctgctctgcgtgcagtctttggtcctttgacatctcctgggggatgacagatgacagacctgtctggctcctctattcattcggtctgtgtggttccagcatgttacctgctttgagctggctcattctggccctgaggaggcacagggagcagtttccctgccttcccaggcctatgttccagaatggggggagccagacaagccaccattgtcagcttttatgctgtaaccaaaccctgggagaatggcggtacagggtggagagtgaggagctgggggtgggggtgnnnnnnnnnnnnnnnnnnnnnnnnnnnnnnnnnnnnnnnnnnnnnnnnnnnnnnnnnnnnnnnnnnnnnnnnnnnnnnnnnnnnttcgcagattcaaagggttcagctgagaaccatcgatggcccacaagcccacacccagctcctgactaatatctatagaaggtcctacagaccttgagcacagctaatcacagagtgtctttgcaagatgttatcagggctacagtacatgggaatgggaaaagttggttgtggtaagagtgtgctggagggtaattttgctgtggccttgagccctgtggcatgtgccacgaatctgccctcagtctcccctcaccaccatgaagcagataaacaataatcgaatctttagtcaagatgtgtttgcatgcatgcatgcatgcatggtgtgtgtgtgcatgtgtgtgttctatatgtgtgttcctgggggtagtatggatgtatatgccccaaaacactggatctctctctctctctctctctctctctctctctctctctctctctctctctctctctgtgtgtgtgtgtgtgtgtgtgtgtgtgtgttgagaccaggtcttactgcaacaaccctgaatggcctggaacttgctctgtagaccaggctagccttgaactcacagggatccacttgcttctgtctcctgactgctggaattaaaggtgtatgctatcccatcaggttctccattttattttttaaggcagggtctctcacttaacctggaacacattgatttgatgagactgcctggccaatgagctatagggatctgcctgtcttctcccagcactgtggttacaaacagacattgagttgcccaagtttatgtgggtgttctgaatatgaacttgagtcttcgtgcttctgcagcaggtatttcatcaattgtgccatcccccacttcccccatccccccatcccccccacttcccccatcccccacaacagaaacacagctctgatagtttgaaagggaaacaaagaacatatgggctcaagtgaatgaagatcaccattcaggcatggctggatccagaacccaaatgctctctctgggatgtatctcttttcggctcctgtccttgtgggtcttttgccctggcttccttctcagggaagccatctccaggagatgcagggtctctggggaggggagcacaaacatagtgattgcagggagaattgctcccacagaagctcccatggcatattcgcactggttgacgtgggctgggcacctttgctgaacctatcaccatcatgggttcatcatgagaggtcaaaactcttgttggccaggtcagtcttgtgatcttccttggggttgggagtaaggccagttccagaccccaggataggggaggggagggagagtcctcagttgctagcctcagtagggaaaagtccaaggggctagcctgctctcagaccatgagtttatttctggcaccccatctattctccagtgtagtgactcttgagtcgtagctggcagcagagatgtcaaagaaatacatgcccttagcagaggtgagaggtctaggctggacatgcagcctgggtcttaagcagtggctctggtagatcttctgtgtagaaaatggaccgtgtcctctctgatttgctggcttgaagtgctggacatggcgagccttgtccatgccaggcaagcctgctggcaccgagcctcagctcagctctttcttcgaccttttctcttggaaataagatctggctcattggtctggaactcagggtagtctagaactcatgatcttcatgcatccgaatccaatgctggaattacagcagtgcactgggcctgtggttcttcttatcagagagccacgtggggccctcagaaattctacattctctcttgtgacgagcagagagcccgtgaggagggaacctgggagggatgaagacctgcagctggatgccacccatggccagctctgatgcagtcagaagctgggtctggactagtagactgtgcttctgagccatgtcaaagccactctggtgaaatgcttggctcctgggccccggggagccagcctgcgcagtgaccctctgacccagccgctcaccatgcagcccccatcaacacagtgtccgcaggaagctggcagcactgaatggaatccaattagaggccttgcctggtgtgaggccatgaggccatggcagagtggctgcagctttgtttgggtttctcaaaactcctggggattttgcttgccttaggacagggccaggagctgtcagaggggactgcaggctggagaggaataagtctgacacattagaatctcacgcatctcaaggcatcttagtggatactttctacagcacactagagagctgggcattctggagtcactgaggcctgggtcacagtcagctgaccacgcccacacatactgattgtgtggagttgacttgggagtgagtgccagcatcctttaactctgcggaaaggatcccagcgtgtgacctggttgaaatcactgcagtagtggagggtgagggatgcctggaaactccagatgaactctgcctaggctgggaagccagaaagcctcttccaggggagctgtctgtgcagaggatggaagcgtgattagagggcagctaagatgtgggcacagagggcaggaagctgaggaagagtgttcaggaaaagaacagaatgtgcaaaggccctgtggtactgaagggtggcatgggctatttgggagaggggcatcaggaagaaggatgtggaatcttaggcaggaaggcccagagcccatgatatagagtctttgtctgcagagcatgggaaatcatgaaagacccaataataaagggtatggtcatgttgccattttcaaatggttttggctgccgtgtctctggcagacagctaaagcatgagggcttatggtagctttccttggatctgcttacagtggtgtaagtggccaatgatagaggaggggtgggctgctctgtgctgatgtcaagagcttggatcccagtctctcactctgagcacactccttggctcctctgagcctcagtttcctcgctgagacacatgggtggtgctcatccccatttcacagtagctgtgaaaattatgtgcggaattaaatgtccccttcccagggggcctttggttggtgtcaacgctctctgccaatgcctcttattacaaagacctcctttgcattgcctgctgggacttcatgccaaggcatttcataaagcccatctgtatttgtcacaggctgaccctgaactcctcaagggcatggctgttctggccttgattccatctctccaccagtccctggcacagagcaggtgctttgtagatgtttccacagagctgaactgggtcagcctgtggtcaggtggctgtgatcttcagtgggtaccctctctgagcagggctaggagtgggccagcctgtggtcaggtggctgtggtcctcagtggcaggcgttccctctgcactgtgtccagtgtctctcctggcagattggatgctgtctgctggtgagagttgtcactctgctctctatccctgtctcctgcagagttttaaaaaattctacctgaaaggctgctactgtctagacaggctcttcagcatgcagctgtctagacagtccccagctcactccagaccgaacctgaccttcagctcctgggatccccttacctcccctgctgtggtgagtgcgttttcagtcatccagcaggctttctgctgtcactctgaacacagtggtatcttgcccagactcctgggactcttcacatgtcccaagcagggccctgttcttagtagagcccatcttctctcttttgcctcacactgtctctgtccttctcctcagtgccagccctgtcccttcaccctgttcctgcagagaagatccccagctgcccagggaagtctggttcttcaaattgggaggggctttctccttctcttgagcactgctatgggatgagcccacattcatgatgtggcatggtcctaacctgtcacctcccacctcttcccagtccttagcggtgtatgtgtatatacgtgtacacacacacacacacacacacacacacacacacacacacacacacacgctcacacacgctcatacacgttaaccataccgcactaaccccatccatgtccctgtaagagcacgtctcccagaaacctcttaagggaggaaggatctgctctggctcagtccatatggctttctttcccttatattggggtacatctggtagatccactcccctctatctatgggaagatgagctgatggctgtttacatcatgatgaaccaggaagaagacaggaaggcaggagccaggagccaggtataactctgaaaggcccgctcctggtgccctatttccacaaacccagacctcacctcctgatatctctgcagcctcccagaatagcaccagcagctgggagtgggtcatttaaacaaagcctacaggggacacttcagactcaaaccgtaacagacctctaatctctagggcatagtccttcccctgtttgcatatagggctctctcagtgaagctcagattttctgtatcgttccttctctgaaaccatctgcagttctctgtggctcacagattccagggccagcaacttcagccagcatgtgtcccttccattactttggctcccacctggcctcaccttccagccatcctcacttcttccctacggcactccctcttccaagatcccccatctttcccaggaaatgccccatagtgcaatacttggcatggcttctgctgacttcagtctgaactacccctcctaccacgtacagtcacacacccggagaagccaggtcatgggtgtctctttttgcgatctaaactcctttggctggaattcatgctcctccaaggtgaggtggcactgagagctgccctccctctgcctgccctgctttccttcagaaggcatctgtgttgttttctcatccagctgcccacagtcagagaatgtgagcccagtccccagccagagacctagtcctcatggtcataatcaggttggctctcctgtcctttgacagggactggcttacacataggtggtgcctagctctatgagagcttacagagtctttcctgttcttaggaggagtcatagagtcggcctctcttcccacctcagctcaaggctcttcaggcatctaagagcacaaaggcaaaaaaggagaactcatcacccgttcctctcaggaaggagcaaaggtccccatctgtaatgatgctattgaacaactaaatgcatctactacagagacttccctccaagggttcttgcatgctggtaagaaaatcccctagccaggcatggtggtgcatgcttaaaagcctaatgcttagaggctaagataggaggctcatgagatcaaggctatctgggcaacaataagaccctacttcaatttttttttctaatgaaaaaaaaaaaaaaaaccccagactggggatatagtcagggcacttgcctattttgcatgaggctcaaggttcaatttctagtaccaaatagatataaaaatagacaatttctgaactatgggttaagtggtttgatccagtggcttttgtaacttgcaacctaaaacattctggtggatacaaggtctgtggtcaggtcaatcattggacttcccgtcaccagagataaatcagtagactgtgattggcctctggctctgacagtagttgtcagagcagtagttgagctagagagctcagtgccagccaaaagtaagacaccacagttgctggtggcccagcccagtatcagcctgcatccggcagtagattctggcgccattgtcaggtctccttctacatctgagtgatgcacgttgaggcagttgtgacagactgagcacatagatcgtaagcaaccacacgatgcaggagactacagggcttcactgtggacttgaacactgctcataacgccactcagacggctgggcaaatggcacctaggagctgtccattgtgcagttctgaaatcacagttgctgaaggaggaaggcgaactggaggagccacagacactagggaatacagccaggccgtgcatcaccaagttccacctttccatcctttgagttagatgcctcaagcagggagatgtttagaggcacgggcataatggagaggagagacccacagttttgacattcttgtggccactagagagatggagggacgggggtagtacagaggagagagaaataagtcatttcaggcaggaaggacagatgatggatgggatgggacagatgggcctggtcatggcaaggacaagcagatgagccgtgatggatgtgtttattgtgtcttattcatctccacagccgattggggagcatgctgaaccggggaggcggaggaagaacctacctggttgccatttgtggttggcttgagacattaaaaatgatgacactgggtgccaatctcctgccattgccccaaatgacaaacaataggtattgtctgggaggctattgtccaagagacatcattaaaacagggacctgaaaacacagtaataaaagtaaactcagacagtgctctggtcacagtgaggaccactccaagcccttgagccagttcattgagtgttcagggagccgtgttgtacggacttggcatgaccgaaaaagcttttgaaggatggataggagtttgggaggaaagatggaaggaaaccaagaagggagattgcattatacctcttgtttcaggaatggtggggatgggcgtggtggtttaatccctgcgagcctcattctaaggagttaaggcaggaggatcttgaattccaggtaaatctggggtacaaagtgaacatctgtctcaaaaaataaaagtggtgaattcacatagtgtttggtcttaatggttgttttgcaggaaatggaagctggaaattaaaggtttgtatcactgaagagtgctatacagccacactggcctcgctgctgggccaaagcctggaaagaaaccatccaccttggacaggcaggcaagggggaggggcagccaggaggaggtgtgaagaaaactgttgcttattgtatggccaagtgggaacgtattttaacacttgagcagacaggatgtctgcatgtgtttgccagcgtccatcagtctcagccgggagccaagaatgacactgtaggacgtcgccctttgccagcccttctggttgcagtgtcctttgcacaccaggtagactgatgggtcatagagatttagaaaaaagggagggccagcacagactcctttccacctgtcagagtcttaagagtctccagtccttctcagccagattcgggttagaaataacctgcttcctcccccttagttcctgagatgaaacctccaggctcctgagctctgctcctcacatcccctggtgggccactgcagccagggcaacctctgtccgccttggttgtcactgtctggacttgcttgcctgctgtgcctctctcttttctcctctcactagcaggagagctggcaatctttggggatttaattacatgttccctgaaggcctttcagcccatcacagggcttctgtaggctgctggctgggagggtgacagcagcctgctgtgatgaacagcaactccctgcctggtggtgtctgtacccagtggccggcccacgctccttgggctgcttagcatttgtttgagcaaagcatgccttggtcccattttgcaagatcagatagccaatgggaaaaacactctcccgcaagaagatgatgagagagagggtgagctgtgcagacagggaggcagcccacaggaaggcgctctcctgaagggatgcttgtcccccaaggattctggaaacttcccatggctaaataatgactttaagactgcccacgttaattaagtctgcctcacatgcagacagccgccacattagagcccccaaagtcagtgggctagggttagggaacacacagaagacccccatcgtacactgaagcaaacacttgctaattgtccctctactaaaggctgacggctgcaggaatttggagagagctgtggctgctcagggtgtctgaagagcttcagctaggtcagcaagagttgtttcttgggaggggtagggggaaggttgacaagatggctcagtggtgcttgctgctaagcctgacagcctgagttggatcccaagtggtagaaggaaacagttggctcccacaacttttcctttgacctccttaggtgtcgggaatgtgtgtgcatgcctaaaaaaaaattaatgtaaaaacaaagggtaattttcttacacatggcacaatgaccatgtgggaggaaagcaatgaacaggggctgtgtgtctcaagatgcctcgaagaagacatccagagaggccttgctgttcctctgcaggcaagatttcccaggcattctccagtgcaactccctctgcttgttgttgagaatagatttttgctgtggttttgaactcataatcttcctgcctttggctcctgagtgctggaatgacagatatgctctaccactgtgcccagcttttcagtcatctccaaatatgctgtttggtgtgtaagggggagacagagcaacgctgggagagatggaataaacccttcacctctggtcccttttcttgtctgtggaaagatctgagtgtgtctagacaacctgcaggccatgcttcctctgtgtgaggctgcagtgaggtgaggctgcagtgaggtgaggctgcagtgaggcaaggctgcagtgaggtgaggctgcagtgaggtgaggctgcagtgaggtgaggctgcagtgaggtgaggctgcggtgaggcaaggctgcagtgaggtgaggctgcggtgaggcgaggctgcggtgaggcgaggctgcggtgaggccaggctgcggtgaggtgaggctgcagtgaggtgaggctgcagtgaggtgaggctgcagtgaggcgaggctgcggtgaggcgaggctgcggtgaggcgaggctgcggtgaggcgaggctgcggtgaggcgaggctgcagtgaggtgaggctgcagtgaggtgaggctacagtgtgcctccctttcttgctgcactgccgttgctctcacgcacactcttcttactatggctgggcctctatagaatggatgaggagactccatttccagggacataggatctaagtggacctcccatcttcttgctgccatgatggtcaccagatgttaggtggtttacacctttgcagggattacagagaagtaacagtgtcctccttctgggcatgtgcgctaggctggagggatgcctgccaggagctgctggtgtgtggcttgtcatcttctgggatgccctgagaaggctgtgaggtagcctgagctcagtatgtctgatggtccctgtgtagcacagccatggagctggtaaggaacacagggctggagggtggacagcctcagagtctactataggcagttagttcattctggcaacagtgggaagccatctccccctgggcatccccgatttctagaactttctttgttccctgacttatccctccaccttgagtcatccagatttgaccaagagttggaaggtccaggatatccccaggttctgctgacagcttgctgagtgaaacgtgagtcggaatcctcacacggcctacttcaactctggtcatgatggaattggaccagttcaaaggagaacaaaaatggatcctttcatctcttccctgtccgattggtagtggctgcctggacgtctgggggtgggggcaggggagactgtgaggcaactcctggactctgtgggacagggtcatgcttagttagcaatgtctgccttgggtaaagacaaggagccagtgacttgtttatctgagcacacaggtcccatacgcacctcctacagtgctggatgttggtttagtgtgatatattagtagcttgcagctccagaccaagaataaaaatgtccagcaatccagagaacctacacaagccttcccagtctataaagtctttcaggtctgtttttctattagatcccccacaacttcctaatattttacaggaaggtacatttgatgcctaccttgcatcccttcttctggtactcactctccaggcttgccctgggtatccattcctgtgtctgggcctctgcctcgggatcaagactaaagcaagagactcacaaaagcccatagaaccccctagccagagtgattgggtgagatgtagccagacccaaccagaagttaggtgatgtcaggattatggctggacataatctattctagcactgggaaaaactaaggcaggaatgtgaaaagcttgaggacagcctgggctacgaagtgagtttaataccaatcttcacaaccataggaccccatctaaaaaacagaaggattgtgcccagtggagttggaggtaagggctatggcctgcaaccttgtatatcagccactattctttctgctgtaacaaagtagctgggtttatcctggctcacagttcctggggatacagtcctttatgacagagaaggcacaggcatcatcagtgggaaccaagtgtccaaacaagtgaacccatgggaggaggttcacaatcacaccacagcaccttgcagatagttttatattttctcttagcatggcatttggtgacatcagctctgagctcaatgtcagccacgctgagacatttggtggagactggggaccgcctctgagaactgccttgtccccaacaattttcttgcctctgcatgcaacctgagacttaagttacatgatagaaggtaaagtctcagctagaggaccaagtcctggatccagctgtgcctgaagctcttggtctgtctgtcattatacattcaactggtctgttgttgaagcctgtctggcttgtattttctgtcacctatttctaatggccagttatccattttatatgcaggcaaaaaaaaagagttgtcagatagattaatattaatgtttctaaagtttgttaatatttcctttctgtcttagaggaaagtccagagcctactttggctccaggggcttgcccagcctggttccacccctctctggtttggatcaaggccttctgggctttggcatcaccaggctctatcatggtctccagcagctgcctcctgtcccatctcctgcttcttcaatatattttgtcaccctgtctggaatgctttttctcttttggggtcttcaatcgcgccattgtccctggctcagcttgtggttccaggctgcccctctttcactctccacgcccagcacatgacgctttcctgaggctcccgccctctggattggggctcgtgggagctctggactacatcaggtttgtcttcacaggcttctgaatttttgttgcaataaccttgcctctgagatgcttgtgagggaggccagtctgtccacagctcagcaccctgtgcagtttagtgcagatggaagttgggatggactttcatttaaactgtccatctgtccagtcacactggcttctgttatataggctctaagcacacacagatgtgcttctgcttcaaactgtctgtctgtccagccacagcagcttcttgtttctaccccagggccctgcacttgctgacagaaggtttctcccagaagcactgctccttgttgattcttcctttttcttttggctgcagcccaatgtcaccccctagacttggctcctgggtggtgaccctaagaaatgagcctctttcttgtattagaaacttacttttgcttattaacgacgaatgctcacgtagcgaaaagtgcatacgggaaggctcctaggagaggccaccgtcttcccacagcagaatctggcctctcttctccacagctgcctgaggggtcacagcgaataaacatgaccttgcagtccagccaaggacaattttctgaagagtggacagtgggagccttgatggtcttgtcactgaggtcaggggctcaggcacttggctttggagcttttactgtaaagaacttcagctgcttgtctgggggtcccacctagtgaatggttaaaaagtgaatttcaacagcgggcaccccagggtgtgagctcacatttcctcctgagccctatcctcacacactaagcacacctgcacacagtacatgctcagtgagtactgtgtagtaagtggtgagcacttgtggtccaggcccagggagcaggatgccctgctgctgtcaagctgcaattcttttttccagacagggtttctctgtgtagccctggctatcccagaacttgctctgtagaccaggttgtcctcaaactcacagagatctgcttgcctctgcctcctgagtgctgagattagaggcatgtgccaccactgcccagcttgagatccaatctttatttgtggccccacaaagcaaccttttgtacatggatggctttctttgttttcaaatatttctttctcgacagaaatggaaaggttacacaggcccgctcgcatgcatgtacacacacacacacacacacacacacacacacacacacacacacacacagctggaatcatcaggttgcctggccctgctgacctatttcccttgacctcacactccatttcctggggtgcccatggacatgggcatgcatacatcctctaggggtggttgtgacagatgctctactcctgagtcccctccccacaattgtctctccttcccagcttgaacttttttttttttttttttagtcactgatcaaggtctgtgtggtctgctgtttccagaaccttccttagttataattctcttccaaaccccttgggaatggaggatcatcagtgattaaagagccaactggtcacctgttcctgggtggcacaggcttgtcagcatcccagagtggtatttgcatgccaggatgggcatggccaggaacaagtgtcaaaatatttagctggtaggaacagggcggtgggatgggtacacttatctggttgcaaactcattcctgtccagcatagttgttgtttgtgctgctgcagctgatgttgcagcagtggccagctgaggcagcaccactctaacaccgggcccattcgtgcccaactgccttagaaattcctcttggcctggcgtgcagctcagggcacttgcctagaacgcaggaggccctggctcccatccccatcaactccccacaaatcctccgcaaggaattctgggaggcccgaccctcacttagtaggtgaaggaatggagactcagagagatgaatgtttcctcacttttgatcatggggcataatggttccagaatattctgtctgctaccgcaccatgtgcacactaatccccatagccaggccattcatattgttttggggctttctgtgggaatcaataatgcagctgtgacagcctttatattattaagatgcctccaagaattcattttggacgactctatgatatttcatagtgtcagccgagacgtgtgtacgcggccgctaattgcattgttatttatcatagcaaaaatggaatgtaattaagtgacacataaaaatgccccgagatgatagtaaggaaacgagacacggtacaagctgcatgctcagcatctctggatccgagggtcgggtggtgcatgcgtagccccagacgccgagggaaaatagcctttcatacgccatcagaatccgtggtgccctgagaaggaagactgtgttttcttgtgcttgtagattctctttccagattttttaaaaaaaccatgaatgttgtattagttagctttctattgctgtataaacatcatgaccaaaagcagtttggagaggaaagggttatttgacttacccatcccaatcacagaccatcatcgagagaagtcagggcataactcatgcaggagccgaggcaggaagcatttggagtgctgttcactggcttgctcttgttcatttaccttatacttctcaggcccacttgcccagaggtggagcctcctgaagtgggctgagctcttccacatcaatcgacaaacaagaagatgccccacaggcatgcccaagggccaatctgaaggaggcatacctcagctgaggctcctgcatcctatgtgactctacttagtgtcaagttcacagacaccaactgttgaaagtgtactgcttttaaacaacaacaacaacaaaagataagtagaagctgaggctgatgcaggcctgatagtccctgttccatctgctcaggaggctgaggcaggtggattggcagtcaagactagtggaggctacagagcaagaccccatctcaatatagtaagtggcagaacgcttgcttgctcctccacaaggctctggagtttatctctagacatcaaaaaagtgtagaagaatgtaattaagttcagcctgcaagtttggttcattgctcttgttcagggttgggagacatttcccccctggcattgtttgttttgcttgggttctgtctgacagtaaagatgggtaccaccaaggtctctgccaggatcttttagcctgcagccagtatgcaaagcgagtgctttgtgccgataaaactttatttgcacaacaggaggcaaccaagatcaggctgtgcgtccgcacacccactgccagttcccgcagaagcccacctacattgtttgccttcgagaaatgaactttattaaatattggaataggtacaaaagaatatttatgagactcaagcttaagtaccagcaataaagatgagtgaatcaccaatttaggcagcaagccatcgatcgctcttagcagaggccctggtccccaccctccggcctcagccccttgcatccgaggaatgctgacttttctgtgtctcatcttcattctcatctcagtaaacacgtggcatagtttcacttctgtctgaaccctggatagactggaacatggctcatgggtgattccatgatggatctatatgattttcttaggatttcttcatactgatggccctggccgtgatctgtttgttgctttttatggttcagtctcccatgctagcccaacgatacagtctagacataccatctactcttgattggtatttgcttgctttttggtggtggtcacctgtttgtttatctccggagcacatgttaacggtgctagagtttctttatttgcatgactaagggacgggcacattaacaagatgaggcaaagccagattgatgtcagagtggccgtgcctctcatggcactctttgtctacacctgttgcactcagacataggcagcctgcccttagtgtcatctctgactttgtcacggatcccttgaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaagccagactccactggccacatcccacagcctcagagcccatcccccactactgcccttgagaagctctgggaccaagcagaactgtcagggtcttggtgctccccactgtataaaagagagagtgaccacactcaccaagcagaggttttcgtgacactacatcagctgcagttgactaggaatgaacacagcgcaggacgctggtggagttcataaacacccccacccctcaaccaactaaggcccacactgtttccaaaagtttagaagcatacccataatcataggctgaggcaggagagatgtgagttcaagggcaggctgggctgcaccgtgagaaaagaatagcaacaacaaaattctcaccatcggatgctgtaggctggtagtgactatgcttagcttagcctttctgagcagggcagtgggctgtcacagcccttccctgaggaccagcagtggtggctttccagagctgggcagaacatatctcagcgagaaaatcctccagcgccacagtgggtctaccctctctgggtggtggctggccagacaccaccggtaatggaggaggtgaggagctggccttggaggtcatcaggaggtgaatccttgcaggctaggtatacaaggcatggtagtacagtgaaattcctcttatgatacaggcagagatgtaattattgcctccaagtgaggaaaccaggagtcagagtgtgagtcccgaatctctgaagctaagtggctgcagggatatagccacactttggaatagcgcaatttgacatggagatatcatgagggcccggttctccataccaactccttgatctcagatgtcagcctccagaatcctaagaacacaaactctgttctctgtagctgacactctcaggtgttctgttatagccacatgggctgtggcactgatagcagcgggaacaagaaagtcacattagacagatgaagagtgcccagaaagctgaagggaaccaggacgcctagatgtatcagctatctatagacacaaccatgccgtgtaacaaacatacccctcaaaggtatgcggctgagtccatactccaaaagctcctgccaaagctggcctgaagcttctgctggcaggtggcctgctcttaccttagggttatagaccaactctgagggggacctggtcactcagccaccaatgagctagcctgggtacgtcctggatggagataaagccattagtgaccagcacttttacatctactttataaggtgtttctgtcacattaatgtcctgactgagacaagtcacaggattgagaccaatggtggagggggggtcaggcctgacaagatgatggggaacttgggagcacgcttgctgtctcgagcacaggaagtattggatggggaaagcggatgtgcagaggtcattgaggacagtgtatgcagcagggaggagggaggagccagtggaaggaggagacaaaccaggcagtacatgtgctgtgtgctcagcctgtaagaaccaagataggctgaggcgtttggtcagccacacagatgcccagacacctctgggacataattagccttggctcccacagaaaggttaattgctcggatcacagtctggagcttctggatccgacagagcagcccctccattaaagccccaagctgcctggctttatctgcctggctttctctcttttccatggaggcttggtcagggctgtgcctagcagtgtcacacagaggggtgaagatgctgtccaggaggcagactgaccagtaagcaaacgtttctgtgataaacatccttacagggacagcaaaggccgaaagctactagtgttctagaggacttgccagcaacctgcacaagggcttatttatgcacacaggccccttcaggcatagctggatccaggtgctctgatccctacatgcttgagctcagctctttcctgtacttgtttcctgaggacagattgtatgaggacagaggttccccactcccccagcttccattccccctccccagtttagcaactaccagggggaaggagagccaaatgtttccaaaaagtctcaagttgggtcctgactggctcagctccagtcacatgcccagtccttagccaaactctgtaaactctgagacccagtgctgccctgggtacagccccaccctggagctgaagggcccagctcccagaatacaaggaaaagctagttctgtgcccaaagggaacactgctgggctgcccagaacattgtgaggagagggtaggatgtcagggcctgcctatgtccctggagttatgaagaaggaaggaccattaggaacacctatttcacagatgggaaagccaaagcaagagaacgctgtgaagggatggtaagaggtgtctccgtgggggaatgcccagtagaggggacctgcagggtggcagggtgagctggcatccagaattgaaacgagacccacgtggagaaaagtaaccagccacaggataagacaaaagagcattccaggagaagcagccaagagcaagggagcccagtgtggtaggcagcctgggtagcctggcccttgtctgcagagaacctggagaactggagaaataaatgattcttggagggaaaggcactttctcttctccgcctcctggagttcatctttgaaaatctttgcttaataggcctgcttcgagagctgcctcatgggattttaatctaaattttattactactgaggtcggatctattttttcatctgatcttaactggattggctctttcttttgtgaactgtctggaaacctaaccttttgggcctccttaaaaaacttcccccttttttttgaaacctcaaacctcagactctgggaagccgctgttctcaaaggccgccagcctgcttattccctgggactttgatctttataaacaccaaaggaaaatgccgtttttattggcaaaagctttgtgggtacctccagatgagagagcaaactctaagctgggcagtctggatatttttaaactcctctgccaaagtgagaaagccaggatcctgtggacgaggtgggggtgggagggagagggcaggatgaaagacactgtgtccttccagagttggctcaaagtggctgtcagactagacaggatccccccaacccccgccccttacgtggcatgcacgtgcacacacacacacagtggtactgttttccttccaggacaatgtcacctgggcctgaataatcccaatctagcagtgaggcatggtgggcagcctgccatgcaagccctggggaggcccagaaggaggaaggtagcaagttcaagatcaacttagctatccaatgaaagtcaggtgtcaaacagccaccttgactggcgtggcctaagagtgcatacactgtggagatttggggagtttatcaaccttctgcctatgccttggagatcaggttgagggagtgtcttcctcttcgtgtggcccagttgagtctcttgtcaagcactctgctggtggctgtccaagtctctcaccctgtctcagggtgagtgggataaagaggaacagaccctcttatgatcagtttctaagtccacgaggtttataaagtgctgtcccagtagcccatgctgcacccacgtaagatgctgacctgcatgacatcagccacagctcccgtgcgtgatgctgaccagggttagatccagtggggactgctattggcaattttaaacaacaaggtcaggaagacaggctgatgccacttaggtatgagaggaagtaggccttacatttgaacacacaagcaactaggggacaccgacaacatttaggtcactgcagatcccaggaagaacatttatggtagagggaacatcaagttcaagtggccgtaaggtagagtaggcctgttgccatgaaggaatggtatctctctcatgatgagagggaacaagcaggggtggaggagaagaaagagtggtcaaggaggggagacttgtggctcttcagaggccaaggtccccatttcagatgctggaggccctaccatcatgaagactggaaaactggagtgggtggggacagactggtgcacttatgtagttcctcatcctcttagagacttggccatgtggtctgaggccacacacacactgagaactgcagaggcaatgcctctgtgggtactccatcttgcccaggaccaccttgctatatctaccaccacctgaagactgtcagtgtcactggggaccccatgatggaggtgtccacccttaggaagtgtttgctctttctcctcatgctcctggctctgcttggaagcctggagaccttatctacccagcctgaccctgtggcttcctcagccccttctgctctctcctagccattttgcacagccttcaactcaaccattgagctcctcgcctccacgtcctcatctggttaatgttcctgggcctcctctcatccttgtggtggcatcccctcagctgcttccttcttgtccttacagcccttctggctccatggtctgccccacggtggccttcaatcctctgttccctgcatcctgggcactttctcgagtattttgttgtttccaggaagtccccactgaggctctgtcactagcatcccatcacagaggtgaagtaacctaagctcagcaagatttaggtcacttgcttacatgcttctagtacaggaaatggcatgtaagctctcccttatcccctccctgtcccttcccactggaagcagtcccagatctgccacctgctagctggagtcctgggctctgcccttctttgtacctccatttcctctcatcaggaacgcagggtgatgatggagatacattgcagggtgatgatggagatacatgcccactgtcagttgagggcagctatggtgcttggcactcctggctgatatagatggcatgatctacttagactgccagcaacaggtagactatgacccacttgttcagtctggagctcctggcaagcttgagccaggttcctttcctctgtgccgctgaggattgaggcctggatgaggcttgggatgttgtcctgtttttctttcctcactgccaagacaaaatgttttccctaaggggaaaactgtatttttggctcatggttttagagcgcttccatcgtgggagggaaggcatggtggatgaggtcatggtagtgggaatatggtggaagctgctcccatctggctgaccagaagtaccagaggcaggcattaccttcaaaggtctcaaactccagcgcatgccaagctgacagaaaccaaccaaccaaccaaccaaccaaccaaccaaccaactaaccaaacaaccaaccaactaaccaaacaaccaaccaactaaccaaccatcacaaaccaggacaggggagatttcccttcccccaccctagtaacagccccacaaccctagacctgcagcaggtggcatgaaatcaactggtactgaggtacaagaagcttcccaccatgccctgctggcctcatccccctcccccactccttgagtacctctgacctccatcattgacagttccccccaccatctcccctcccacagctttctccagctgccacgcaggatgtcctgtctgtgcacactcagtgagctgtccctcagagtgacctgtctgtccacactcattcagctgtcactcagccctggtccctgttcgaaagtagcaatgtggtcctggcctggcagagtctcaaaaagaatcttgattctgtaaaaacacaagcatagcattgaaataaaaatttatgaatatcataggtagctggagagagacaggaatgagggattaaaaattgaaagagacagaaagggcacagaaagagcaaaagaaaggggactaggggacatggtgggggcacaaagacacacaagaccaaaccctatccttaggacgtcttgaaacttctctgactgtctccaccccatttggctacaaggtgcagatggaaaaggaaggccgggaggccgacatctaggccaggatgacctgagagggggctgcaggcatgtctgtgggtttagagctcaaccttggccttggagtctctagctctcctcccttcccccccccctccagtcccaacatgtgaggcagtggtgtgttcccagtgtcagcttctgtttcctggggagaatgagcaattcctgttatctggtgctgaaggccaaggtcactatgacatgtttcagatgctctgagactgtcctcggcttccagaggagccctttctaaagggcacatctgccagagacggtttagaattgacagggactatggcctctgagctctgaggaaggatagcactgtcagagacaaaccagtttgttcagtgattgttgctgagggaggaaggggcacttgttcctgaagaccgcccatgtactgaggctcaaagagatcagggaaggtcagtcgattgaagaggtcttgattcatgttcaggttctgctcctataggagacaccaagaggaagggtcaagacatttaatgcaagagtctccatgagactactgctaaggctggagtagtcaggacaggtttcttggaggagatgactttgaaggaacctggtggcttaaaacaacagatttatctatcagtgaggtccctaatgtgaagcccaagtgtctgtcacaagggctggattgctttctggaaacttcatggtactagagatggaatccagggttctgctcatgctaggcaagtgttctccagcccttcgtggcactcttgatgcccctgagagcccgttcttctgcctcatttcattttaagagattgggacccttggcttatgtcactacatgccctgcttctgatggagcatcttcactcccaacctagcctcccaccttgcacaatggtcccccattgtgatgacacttgtggaccctctaaccaggttatcccaacctcaagaccctaatcacttcttcgaggtccactgctgcacaaggtggcatgggcacagggctgggaggtagggcgtgaacatttttgatgagaacaaggctggagacgagcatctctgctagggactcacttggctcaggcagtaaatgcttcattgatgcatttgaacctgttgctgcagatctctcacttggctcctgattatgcatctcagccttccggggagctgacctacttctgacctgagtcagtagtctgggtgggagtggtcctgaacatcccagagctcccggacaagctgaggccttggtgtgctttgagccatgtggcataggaaaggatggttctagaaaagctgggtccgcagaaaacagccaggttccatgttctcaagaacctgactgttgacgccagaattccactccaagtgccccattacatcccacagggcagcctctgaggatgtccactgggaccttgagtcaaagcctataagacatcctgacttgttaaagggacttagatcattgtgactttgagcagctcactcaccatctctgagcctcggtagaaagactacaggatgcagtggggctgacagttactcatctgatcacaggacgtgcctgacagaagcaacttaggagaatggttttagaagcccttagtcaccatggcggggatggtatggtggggatggggcagctttctgtgctgccaagcaggaggcagatagcatgaaccagaaccagggatgtgtatgtccttcaaggcccacatctagtgacccgcttcagctagacccaaatagcaccatcagctggggaccaagtgcttgttcaaccatggaagcctgttggagacatttcagcctcaggctatgaattgtggacaagaaaactcctcatatacttggctctgataaggaatcggagccaaaggcctttctctccagttaattttgaatattggctctcccgcatggttgctaagaccctagcattgagaaagctggtgattcaggggctagggatgtctccagcatgtggtctcggtaccgcctggggccttgaaatactacatccatagtcaggagttgggggtgcctattagcaaaaacagagtttgggaggctgaagcaggaggttcacagattcagggtaacctggactacctggagagactctgtctcgtgaataatcaaccaaacaataaccaaaaccaaaaagaaaacaattctgtgcccctgtagtatcagggacagaaatggttttaaacactgtcatgtgggctgtaaactcagggaggagccataaaaggctgaggtgccaggccgggtctgtgccaccctgtcagtgtgtgctctgttgggcggtagccctagcttcacttggccacgtggcggttcaggctcatcatgccacgcccacccaatttgcaaataaacttcagaaaactggagtttgatgaggcctttcctatttttaaatgttgacaatgaatgcagatatttttaaaaatattgtgtgggccaaacaagacatttctgctggttggattctgtctgctggcagcttgtgtgagaattccctgactttcccaaggggaaaactgaggccccccggcagcagatggacctccaagccctgccttcggagcttcaaatagagggatgctagcaacagggctaggtctgttggtccctctgcagtttccctttctggctatcccagtggacctgcccttgagttcccattctgtaacagagaatgctcaaggagtgcagtgagcccctagcctgcctctgcctctgccttcctctgagacagcacatcccaccctgcagtgcacagagagcctctcaaatgcaggcaggctggggtctgtgactccagagattctcctcttgcttcttcaaggccactggccttttcttggcagcccacaccttctggtcactgatccccctccatgctgacatttcaaaagaagcagctgtcactgagccattcccagccccagtagactggctcgcgtcatttacatgatttaacacgctcccttcagggcgctcgctgccgaactcagcccacagccaccgtgctgtgacttatcgatccaatgtattaaactgatgaattcttatttatttgttttgaggaaaaagaattgtttttttcccccttgaaacaccttggtttcctgtgactttgcaactgttcccctctgttcccttgaaagactttatctgtctaagggtgataggctgttatcctagacctgggtgatatcacaggggagcattgaggatcatagtaggaagagctaaggcttcacatagcatgtgcagacagagagggactagcacttgactcaccaatgagctacctaatccttagagtgggccaggaaatggctgcagagaccccacttacagaagaaacactgggactcagtagtagtatgtcacctgcccaggctctctggtaaagtccaccatccacacttctctgtcttagtattgattattatgacctgattttcatgcataatacaggagctgtagctctgcatggtgatggctactggcccaatcccagccccccccacccccaaccaggacacccacctacaaatgatcagcaacaacttgctgaacctgtgtaatgacagtcacatgcacagcactgctcccaggacactataacggaaccgaaaattccctgtcttgacatcccagaactccgctcttctgcgtgtggtggtgctgaccctaacaaatccagcacactgacagtcacatggaggcagggaatgtcctgttacgtatagcaggtcatactggataaggatagtcaccgcaggtgcctacatatctagcattctatactttctatatgtgggtggtacacctgagggtatttttgtatatctactattgtatattttctgtgtgagtgtggtatatatgagaatgttcacatatctaccattctatgctttctccctgtgtgtggtgcgaatgtgggagatttacatatacttcccatgtgtgtggtcctcttggggatataggtgcaagcactcatgcgcacaaatgcagggcaggaggagaatgctgattgtcttcctctatgatgcctcaccctttctttacttttttttaggatgggatcgttcggtacaccttattaatcaactaattagacatattttagatagagtcttatgcatctcaaacgagccttgaaccacacagagagcagaaaatgaccttgaactcctcatccgcctgcctccctgagcctaagtgctggggtcagaggcctgcgctaacaccccagctgtggtgcttcaccttcacggttacttagtgtggaatctacatagaaacatgtctatcgtgaaagtgagcctttctagggcatcgccttccaccgagaggtcacgactgaccagctgcatggctaggggcgtcgtaggtgcatgttgtgcccacacagctcttggatggtgtccctatttgaggtctgactataacttaataattatactcatggctttcactctcatgcgcacacgcacacaggcatgcacaccagcatcaagcccacagcacccacaggtgcttgcttctgcactgtctgttattctggctccgtgtctacccggcccacttctcaaatgagggcagtgagggacggaggtgagcccacactcaaggtcactggaggctgaggctggactcccccaggtgtctctgagcccagtgaggagccagccctggcgactctcaactgggaaggggctgcagggaagggaaatcggtcctgcaaacccatcaattccatcgatgtgggtcagagttgaccccgccaagctgttttttaaaaaggcaaaaagtgcagctaacaggattaactgtcagctgggccccacctgatgagaaatctttccatttcttctgcccctgaaggtcacccattctctgctgcaaatctagccattagtggcagcagcaagttgggagactctcctgtctttgatcacccctccccataaccaaggcctggctgctgctcctttctccgcccgttcctggcgtttcatatgtctcctgccgcttcattattcccaccgtctgcgccatgtcctccagacaccaacactcgcctttccagcatgggcttatgtttacccaagtcaactctcttttccatatgtatgttgaaaaggaagcttggagcctccgagcctgagcatgcatccacatcctgtacagacccattacagtcagaaaaggctctgctgtcagctgggctgcctttcttgtctctttgtgtgttaattagaggatattatttgaaaaagaaaaaagacttcactatgacatttacatatgtaaataatgtatttccatcaaatccatccttctggtaccctccacagtatcccttctattttaatttgaatatagatttcggtaatgagaagaaaaatgttatttgcctttctcagtctggcttatttcacttaacacagtgactccggttctgcctacttccctaaaaatgatgtaatcttattcttcctttatgactgaataatactccactgcacttcattttccatatctgctcatctgctgctgatgggcagatatatttatctactgtgaataggggagcaatggacactcttgtgcaggtgcctctgtgacatgctgagtgggactcctttgagcataccccaggagtggcatagtgggtcacatagtcagttatttatttatttagcaatgccctccatgctgatttccatggtgactatagcagtctatagaaaacagtgtccagtcccattgtatcaggtgaggcccaagattctgcatgcccatcaccagtaacagtgcttctatatgctactgggaccactgacttggatctagctctgatggaagaccaggattgaccaccacaaaaagatgaaccagggagggtccttgatgggtgggggattctccaaacagcacaggaatcattctggtgagagggtccctgggggaaacattgttcaaatggcatagagaagttacttttatggaattgagggctccagtatccccaaaggctgacagtagtgggaggctggtactacctcagccaggagtggaggacacttagagccaagaaggcagaacacagcaaaagcagtcctgggcaggatgacacaggcagaaagacatgggtgtctcactagtcctgagggctgagccatgggtccaggatgctcagggtcttggcacagagcatcccctggcagaggcatgggaggatgtctgggtgggcacagagggagggggtagggtgaagataaatctacagagaatcaccagcatagcaagtaactgcacagaagatgctgagcctgagtctcagcctccctgtgacagttgatagtaagtaggggctttggatgtgactcagcgggcagagaactcacctagcctgaatccagggatatagtttccagtaccacatcaaattaggcatggtggtatatcatatgggtggtggaggcaggaggatcaggagttcaagtctatcctgggctacatagcacgttggaggccagcctaggctgcacaagaagctgacttcctcatcctcctcacagaactgagaagtgataggaaggttttaagaacacattattaatggaggtaataataacttttagaatatgaggctaaaactgcttcgtcctttggttcaactcaatgtttcagtctttgagaggaaatagacctgtgtcaccaacatctcagccgtagattcgggggactctttattgtcactgtcttgactcactagctcccagtaatgacacagacaattagtatctattatagctttagcttaggctatttcccaacaagctcgtaccacttaattaaccctgtctatactagtttgccatgcggcctgttacctctatgtcccagtatatgtcacagaccatttgatttccttcatgtcaggctggcaaatattattccccagccccaacccccacacctgattctttcccagagagcctatctctgcctggaagtcccatcttttctctcctgtcctgctataggccatcagctctttattaaaccaatcagaaggtgatggagacaaatgtttataagatactcaggcaggtgacaatccagtaaaaacaacagtaccaaggtcaaggtccttgtactctatccggtgccagtacagaaatcaacatctgaataatacaaagacaacctttacacagtgcacaaaaaagattatcccaacaactcttatgtgccccttgagagtgatgttgtttccttggtggtcagggcatcactagaaagtcagaagaaggtgccagtgtggagcacacctggatctagggcccgaggttgggttgctgaggatggagtatctagcacccgttccccagaactaggctgggctgattggctagagtagctccttatcttctcactgggctcaggagcacttgcatgagggctccacccatctaaccccagagccaagaatcataacaacaggatgggcatggtggcacatgtaatcccagcaccgtggaagggggatccagtgctaggctagccggggctatacagtcttatctcaaaaacagaagaaagataataatcatagaaattgtaattgtcatgccaagagtagcaacaacagccatgataaaagtgggcacgaggtattcattacagagccaacgataagggagcctggtgtcccacaaatctctagtgcccatagaaggctttgtggcacatggagccctttctgttcacccatctgaacatgcattttcctctgtaccctccagccagggtggccagtgaggagtgaaatgagaccctggtagaggcagctctgagatacggcttcccaacacatacccatctgtccttcctgcttccccacatctcacccatgtctcttggaggcatttcctcaagaaggactgcagtgactactgttctggggaatagtcacttcctggatcctcctcccacatacccattccacagaagagatcactgaggttctgagtgggcctctgctagccagtgaaacagccttgatttgatcccaggcccctagagtccccagagtttctgggcaaggacaatcccttcagaagcccgctctgccattcttggaggcaggaatgggaagcagctagtcgcatgcatagtcaagcacaaagagaatgaatgaatgaatgaatgaatggatggatggatgaatgttttctggaagagaatgggtgtatgcttgctggccgctcagctctttctctactcacacaacctaaacccaaagaacgctgccatccacttaggccactgtctcacatcaattgatataactaagataaacccctcaggcacacccgaggtccaacccattctgagcacagagactctcttcccaggtggctctagattgtgtcacgttgacagcattcactagcctcaccttcccagctttgagccagccatctctcttgtagccagctctcccagcactgagtggtcttgggtccatctccaacctgccaggcttggctcaaacatcctctagcaaatcaacgtggcgtagatgcaaatgcatgttggatggatctccattcccactgtttactctccacacccttccatggacctacaagttcaccctccccgtcaacgccatctttaatcttgatctctgtcagaagcccctgggctcctcccacaagtcagcatgttccttccacacaaaagcatcagcaggtcggtgaccaggtccctcgctgggctaacttgagtcttacacagtaccaagaaactgtttctcttcagtgctggcaccatggctctaagtatgacccccactttgaagatgaataaactgaggcacagaggttcattcctgagtcctgagtgggagtggcaaggaacttggactggccagataggaattgtgtgcttaagacatggtgccaggataggggtctgcaaggaaaccaggtagaccagaggaaagcaggtgctgtgcaggtggcaagcataaaggaagaagagagggtgacattgtagacatgtgtggggcaaaaatggggtcctgcgtctgctcggggctaggaccactgggtgaggtggacgctgggtgggggtttgactgtacgaaaccccatagaaccaccgagcaggcgttggactgtgagaagccatgggatccctctccggggttgaggaaagagaacactctgaggtcctcgcggaactgctggagtcggggctcctgactctcaggcaccacagaggagccagttctgggatccctgggctgcacggaggccagggacgacaggttctcgctcttggacattccagacgccactgtatgtcgcagaagagctgggaacaggtggggaccctcaggcggactctgatccgggnnnnnnnnnnnnnnnnnnnnnnnnnnnnnnnnnnnnnnnnnnnnnnnnnnnnnnnnnnnnnnnnnnnnnnnnnncaggtttcagcagggaggagagagtctggctagttcaggtggctagtttggctggcagcttggtttggctgctggcggcagtggctgataacgcagagcgcctcctggagggaggttagatgcgcagttcttcaggggaagacctgctccattgctgcagcacggaggatcgcgatgagacgaggcagtccatggttttaagacgtttattgtagaaagggagagagtagagaagcagaggctagccagggccatgtggattgggggggggggaggcagagagaaggggagcaagggagcaagagtcagagcaagagaataagaggtaagatagcaagagaacgaggaggggcaaacagctccttttatagttgcttgggccatcctggctgttgccaggtaactgtgggggtggagtccagactagatattaggagcttggagcattgcctacatgaccgatggctacacacttctggggggagggagagttgtgggaggctgtagctgcaacaggagccaggggcccaggaggcatggccgaacaccttccgtcctttagggtcaccaggtttccaggcctgtgctcaaatggggaccaggctatctgtgcacagctcactgctccacagacaggaaagctagcaatgttagcagcccaaggtgggctgatatggggaagaaactgtggcaacccagaagacacaccaaaccactagaagggctggaggggcagcgtccttcgggaagggccggaactggtgatttttctcactggaaccctgtgacctcccgtcctggactatctcagtgacatcatgctcagagtcctagaggaaggcagtaacaggtcagtgctaggtcagtgaccaatcatctgtgtccaggagagcaagctcacagccaagcatggcagcacctgggagaacccaagtcaaagtcatggacccagcagtagtgctttccagaaacaagcagggcagggtacaggggagaatgtagggccagcaaaggtgtaggcaaggcttgtggtcaggtaacggggtttagggacctttgtggctcaggtaacagagggtctctctacaatggacttagcaatagaaaacttgcccatgtagagtctagagcagggtgcccctcagggctgggatgaagggaccccataaagactcctcatttggatccactttatacccgcagtgccaacctcatcccacgctggtccttcagggcgccatagcatgggagcacatagagctgcatttgggtttgcagtgacctgctgttctcagtgggtggtgctggcctggtgaggtggacagcctctcacctgctcttacctgtctctccaggggtgctgtggctgtcggtggtctctgaggtgctctacatccttctgctggtggtcggcttcagtctcatgtgtcttgagctcgtccactccagcagcgtcatagacgggctgaagctcaatgcctttgctgcggtcttcacggtgctctcaggtaaggagcgtgggaagtagcatggtggggggacacaactgcttatctccttttgctcagcaccaggggatgctgtgtcccccagggcctgggcacagccctgtgaggatgggagagcacaggctattgcatctcctctgagccctgacctactgtttataaatatccacagtatgggtgccacaaaggacaagcatacacagcaagggccagccttgtgatgcttagcatgatgtggggtgcagtgggttgtgtgtttgacttgggcatgagacaagggggtgataggaaggggtgcatggacagggctacagaggagaggaccccttctggctgacattgatgtttagtggtagagcacattcatagcatgcctgaagacctaagttccatccctagcaatgagggctaggaaaggaagacaggtacaaggagggagggagagaaggaaaggaggaaggaagaaaggaaaagacttctctctcttgagcttcctcctatgggggtgctaaggaagaaacccacctcccataggattcagagaaattgaaaaagaacacaccaaaaacggatactggccccaagggccaggtgtctagaatgacatctccagacccatgtcccagagggctgagcagggagtgccctggaagaatatcaaggtattgtcactgtccccaaagctggctggggacacacatcccttaaaaagccacatgcaaattgaatttctataaaccctacaatcccattcttcatgcgctggaagagctgccgtggaatgaaacgggagcaaggagctcctgacaaggggcataatcacctctaattgaggtatatatagaaaccagagggatttcttaaagaacagagagctgaattcaacgagttacagcctgctccccagatgcactgcgaggacctgggtaattcaatttcgcaatagcagtgcagcatcgggcttcatccagttccctgctgctctacactgagacccctcctgccctttgcctccatcttttatccatttactcagtcaacatccactgaaggtcttctgggctccagctactggcttgagtttagggaaaagtgaaggaaaagaactccctcttgtgaagtttgccatagaaggattcgaggttaccatgatgcggcctgggtatttctctgtcccaggcaggaggggcatcctcaccttcccagggactgtgtggctgaactgaggcgtggaagagctgtatgcagtaggacttgggaagcaggctgtgttcccttggcacataactcagggagggactgacacaggcaaaggggttgggaggagtgtaatcctgggacttcaggtattcagatggcaagaagacagagatggatgtgtgtgggggggcgtgttaagagatgaggcaggagagatgaggaccttgctgatgtctaaagccccccaagttcatcctgcaggcaacatggaggcaatgagcagttcagagcaaagggatgagggaactacaggagccactctgcacttgggggtgggtctgggttcagggtggagccctgatgcaaccaagtggaactagggagctgggtacatttcagctaggcggacattccagctattgtggaaacggagataggaagctcacaagtaccaagactagattcaagaccagtttgggtaacttagactcggttttaaaataaaagattaaaaggagagctggggatatggctccacagtaatgcttgcctagcacagtaccatctctagtacttgggtgcggcgggaggtgggggtgaggatgggggtgggggtgggtttcagggaacagaggcacagagagacagggagcctgggaatagaggtagggaggctgctgcagtaatcaaggtgaggaatagtgggtacaagagattaaaatggggaccccctccatgcagaaggtgaaacccctagcaacttgagatggaaaaggagcagccattaggaaatggcagagaggtgaggccaggcatgagtctgaagagttcagagtctgtgaaccggtttggaaaacaatttatcccttatttctacagcctgtaaattgtcacttgtcatttcctttcactgtgatgatggggcaggcgccaggatgctgtgacctgcagcgcctatcctttctttccgcatccctcggcagctgcttgcaggtgttctgatgcgcagccttgggagcggggcgtttatcaggcatccaccgaatcttgtttaacatgctcacaaaacagcgtgcatgttcccacatgaggaatctgcgtgctttgccaagttatttcctgcaattggttccctctgtcaccatatgcatttattttatgcagctgaaaatattgttctgagaaggggggtggtccatggctccaaatggccaaggagtttctgacccagttgtatagatcctttcctagctggcctttgcctttagataggctgagcagtgggacgactaagaaagggtgatcaggaatggggcagtgagctggatgtaaagtgaataagtaaattaataataaataaaatttaaaaaggatgacaggaggaatcaaaaagaaggagtcagtgatgtagggggttgggtgtacctacggtgcttgcagcagccccctttcttccaccttcccttcccgctgcccctccaggcactcctctcacagccccaaagcatctgcccacccctctaccttcttcagtccaaacaagtacatgtcagttgtcagctaaagcagctagaacggttaatatcatcaactggacacgatctagaatcgcctaggagacaagcccctgagcgtggctgtgagggaggattagattgggctagtgaacccatcttcactgtgggctgggcttgcaggcagcataggaaggagaaaggctgccaagcatcacatctccccctctgcctcctgatgctgatgctgtctagcgctcagcagccatgatggatcataccctcgaactgtgagccaagaaaccaagcccttccttaagttactctggtaaggaatcacactgatgaggaaaggcagctagcacagcaggcatgccatccccttgagcttctgacggggttgctgaggtactctgtcttcttccgcgggctcatcacagcctttgcccatcagaaaaaataaaagaccttctgcctcccagcaggaaggcctactgctagagctgctggagtgaacggctgtctccataactccagacatctgaacagcccaggctcagggaggttaattggcttgctcttggtggcacactggaattaagccacttcgaactggcttcaaagggtctgcactgctttcatagaatcttcctgtgggtgtgactaggtaggaggacaaagacatttttttttccaattaatctgcagaaaatataaactcaggagtcagtagcagccaggtgaaatagtgaagacagaatcagcaggtggccgagagcgagggtttactattctttcttagaggcagaggcaaacttcaaggctatttacaaaggaagattggtgtctcacctactgatggaaagattaaggaagctggctggggtagacccttgagtatagcatgctctgggccttggaggggtggagtgatgttggtgggttccccctgggtaggtgagggaattactgcagtccaggaagagaggtagtctaggcttgacaaaggccagtgctgactcctggggtgcattgggccctgccatctgctgcaccagatgagtccaaggtcaaaatgtttctctggtagaagagaaagcagagccaggcagcccttatgcaaaccagttattagggttaattagcaattatgaaaattagcccactgattgtcattggtcgcgatggcagcattatgggagagacagactcctgtggcccagtttgactcagacccctccgagttttcctgctaagcagtcctgaccttgagctctgtctttggcctgcttcatctggttttaatgagaatctggctgggttggttgaataaattcttgcacccttagccaggcatggtaccacactctgtgaacacaacattcaggaggctgaggcaagatagctatgagctagaggctagcttgctgtctcaaaataagaaaggatccaactgcatagcaacaggctggagaaaggtaaaaaaattccaagtccaaagtttctgtaatacataccaaggtgatgcctagaatcatacgaaggtgctctgtgttcattgttgagctggcctcttacgatgtctttagccactgtgtctgtacacctctgttagcagtggtgctgtgggtgggggaggggctgcagtggggcaagcctgctgtgagttccttctgtttactcctcagtgattggtggtaaggactggactaatgtgtccactgtgcagatgggaagctggctcgtgcaaagtcctggtgagagctattgaagtggaacctggtgctatcgggctgagccacccagagcgaggcgtagtgcctgagacccaagctgccattgccatcattattcctggctgaccttgaatatctgagaggtggatgagggatacagatatcagccttctctggttggggcctggcccaggaactcacgtgggatcctcagtatagggagtcaagctagacatctattcgatgtctccccaacagcagtgattgttacaagtgttgatccagaggactagaataataacgttgtcccactgggcccatgagttcgctggctgtcaaggagtctgaggtgtacttgcacttgtagggatgcacaaagtgctctgagttcagctgcttaaaccagaagagaaaattaatataataaataattaaatgagtgtggttagagggagaagtaatattctaatgttattgtatagaaccatagttatggttgacaataattaattaattgtcaatgtgttacatagcaagaccctgccagaagaaaaaggggaggtggaaaaaaaggaaggggaaggagggagaggagggagaggaggaggaggagggagaggaggagattctcaatggttccaaaacagggaacagctaattgttcgaggtaatgtgtattggttattatttttcttgttgctgttacaaaacacccattaaaaagtcacttgaaggaaagaaggaaggaaggaaggaaggaaggaaggaaggaaggaaggaaggaaggaaggaagaagggaggggggagggannnnnnnnnnnnnnnnnnnngaagaaagaaaggaggaagggaagacgggggaagggaaaggaagggagggaggaaggaagcatggagggggaggaggggaggaagaaaagggtttattttgactcacagatcaaaggtgcagtccatcatagtggggaagacccagaggcaggagcataaggcaacgggtcgccctgtcctcaatcaaaaaccaaaagatgaattctcattccatttccccttttcaccgcagctcgtggagtggtagcgcccatgctcacatgtggggtgggaggtgtctccctgttctgctgagcctttctgggaacaccctccctgacatacccggaggtttgtttccatggtgaaacaaactaaagcttatcagggtgataaggattcaccatcacagatggatatgtcaactcttctaatcatttcatgccacacgcatgtgatgaaatgtcacaccacctcaaaatatgtataactacagtgtatcacttaaaataaaaataccagactgaggtcacagctcattggttgaagactctcctagctcatccctagcctggcattcacagtgtcacagaagtgcacgaattactttaattaaaaattttaaattatacgttttcaaaaaaaaaaaaagacaaagttgtaagaatgattccagattgtgttatatttatttttatacaattaaaagtcaaccaaagagctaggcatagtgttaagcatctataatcccagaacttgggcggcagggcaagaatatggaaagttctaggctatcctgagctatatagaaagaccctgtcttaaaataaagcaataaaaaaaaattcagttccgcatccatgaagggactgtgctcaggacccacagaaaccatggtgagaccccaaagtgggccacagggtttctggtgctttggagactgagggctggaacctcttctacctcccagggaacagagccttagccccagaaagactctgagagcaggcaggatgatctctgctttcttccagctcctggggaaagtgcagcggagctaggaaaacaagccatttggaaaattccttcacattccagctcactgtgggctttcagcaagatccacgtggcatgaagagacacctgtccgtttccctggaaataaccagctgtgtgacttcagcaacagcctgttttgttatgtaacgagaaatggaactttagttaacgaggacttgaaagccaggtttgggggcaatgttttaaaggcaagctgtgggtctaagcacaggcccccgggccgggagagatatggccaccaccactgtgttgtgtctcggcagaggacctgggactcttgagctcagtgattttcctgcatttcagatacctttagcctgaggagcttggtggggagagaagagtggctccccactcccctccttgggtcttgggagccaaatcacccttgggtctcgctccaactcatctgcaaagactccatctcaccacctggtctgtggtggtgtttatgagcccacccccacctgtgactggcacgtgaggcttctcttggctgtaggaggctggggtggcatgtcatgctcatccccaccctccctcagtgacaggctcacatgccacccttccctctgttctgtggctctggagctcactctactttggtgacttgtgggttcacggtgggtttagttcttgctgtagcctgccacagacaagaagagttccctgggaccccaattcctctcttcaccttaccatcaaaacccatgctgaaagaacccatgacctcattgcatgactctcaccttgccgtatctcactgggtctcttacccacactccagaggaaaagtaacttgggttggcttacaattgcgcagggtgtcacaatggtggctcatgccatgtcccaggagtctgtggcagaaggatcatgagttcgaggccagtctggacagcatagtgagaccctgtctcagaaagaggaggacgaggaagaagaggaagagtaatatgttactttcctgccactgtggcaacccctgccagaggagctcattttgactcacagactcggaggggtttcagtccctcacagtggagagggcagggtggagtaatgtggccacagttggtcacatcatgatggcccaggaagctgagagagcaggtcagaacctgagtcaggtacaactctccaaggccccgagtgagctatgtctgccagtcagtctccactccctaatgtttccacagccttcaaaatcatgtcacaagctgggagccaagcacttaaaacacttaaagcctgtgaggggcattgaagatttaaatacagtgcagagggttcaagtcacataagtgaatatttgcatattattagaatccttttggttgcaagtgacaagaaccgagtcagtcggatgaaggcagagagggtagtgacagagccagtttgctcaggaactgcgagtgtgtgctgccaagcatcaggcacggccacgccaaggtccttagaactccgcctgcattagcagtcattctcaaactctgtcagtgtggagagagggctcatcgcatgacttcagacgcacagaagtccctgaggtagaaaggtctgttggagttttctccgtgctgtgggcttagcacagggccaagcagggttgtggacaatagtaggctcaagggaactagttgacatcagatccaaatgggttgttaagtcagaggactaacagatggcctgaggtagagccaagggactcagggtcccagaaataagcagttctttcaaaaaactttttcatccttaggacaaaataccaggaagattttttttttttaaggatgtactttgactcttgtttccagaaggttcttgctatgggctggctggttccattgttttcatcctgtgtaaggcagagcatcatggaggaagggcatgctgtagtagggctgatctcatcttggtgtccaggaaggaaaaagagacagacagacacagagatagaaagacaaacgcacacagagaaatacaggaagagagacagagacagaaactgagagagacagagacacacagaaaaggtaatagagaggaaggagagagagagagagagagagagagagagagagagagagagagagagagagaaagagagaaagagagagagagagaggaggccagggcaagatacagcctccaggaacacacccacactgacctacttttttcagtcaggccttattctgaaatttccagcaactccccaggtgactataagcctgtggggacagttgatgttcaatctataacatcctacacttggtcccaaggatttgtagccatctcataatgcaagacgcatttagtctacaccccagagtccccagagtgttagcaagtcccagcattgttcaaaagttgaaggatcaagcccgaggctcaaggaaaacacttagcatggggtcagagttttaaacctcaacaagatgagcctcaaagaacttgccacacactccaaagttcatgcaactgtacatttctgttccaaaagtggaaggacaggaggatgacaggccaatcagaccaagctcctgcagctccctgcgtggcacctgaggcatgtgatggcatgataccaatgctgaaggcctgggcagcatcagtaccccgccagctttgctgcttgtggtccatctagtttctatcctgagctgcttccgtatttggtctcagcagagcctgcatgcttctgacatctccagcttcctgtggtctccactggcagctcccccactcccatgctcaccctcacccatatagtttcacaaaccactttctcaggggctgacttcagggaatctggctcaaccgcatgatacccgtcctcttggaccttcctctgaaatctgggtggaagcctttatgtccccagaaactcttatgttctggaagcccgcaaaactagcatcgtgtggctgaagccagggtctgccagagtttgaactgtagccaggaccttggatggcagctgaatgcctgggtcctggcataggggaggggatgctcctttgcagtgtattcccttaaagggacagtcttttgatccaactgcacagagtctgcattttgttggaccatttacacacatgcacacactcaaatgagtaacatgctcaggtcatatttactcctcaatgcttttatggattttttttaaacagtgcaattctccttaataaccacatcctccacgccaacagcactaagtgcgatcctcttcagatcaaacaacaagccttacaactctttctgctctgccctgtgctcctaagtgatcactgtgaacttgttcaaagccaccttccgaattcctcccaccagtttccaaaggccgctgcctttagacttagctttgcagagagtctagggacatgaaaagtgttgaccggttctttgccacagtgcaacgtgaatgtcatctagtacagttcccaataaaatccttgttcccaagtgaaggtcctgcggtgctgcttgtctgcactcctgcctctgtgctggtccgctgagctccctccagaacccctcacttagctaaggtcacagctggggtctacagcttccctagcctgactcttcaaccgtccaaacttctgtattccaactgcaaaaccttctcaagcttgtgtctagttcataggagtgagctcacttctccagtaccacatttctgagtgttaatcggactttacgtgacaaaacacccaagaagccagtgtcggagggtcctgcctggtcagctggctctctgcttctagacctggagttaggtaggacaacatggtgaacagagatgctcacttcatggagaccagaaggcagggtggtggtggtcagggcaaggtatagcccttaaagtcatgtagccccacctcctaaagtttctagaaccttcccaaatagctccaccagctgaggatcaagtgttcaacacatgggcctgtaggcccgtttcatacactagccttagctgagaccctaagctgaacttccttgggaggcaatcccagggagtgtgaggagcaaagggagcactgctgatcaccgctgggcactgggtttataggaggctcagagtccaggccgaactgcttgctccaaggtctctctgagagacggttggttattcatttagttcccacccagcaacagctcaggattcctccttcactatgagattctcctcatctcccacccaggagaccaagtgctaaaggaaggaagcccccaggtaacctcaagctacacggggcctatggcctgggccaaggagacatgtgttgggggctactgggggctgccagagaaagtcacctgcggagcagacaggctagtgtgacactaaccaatgcagttctggtgcagtctacatggatgttttagttctttctggattgttctaacagaaaatcacggagtgggaagttcatcttgttgccatgtcttatttcttaggcatccttgttgacttcagtcctgccaggcttgctcaaagctccccaccccagattgttctggggaccagatccagcaagtcacctcatctcatttgcataagctcatgcagagtgcaaggggctcttgaataacacatgttcctgctatggagaaatacgtaggatttaccatagctcctcgtcctcctccaattggggacaaagccaaaagccaactttttcccccccctaacaagggtctagtgggcagccaagctagcatgggttcttagcttggaaaactaacagcattagagcagtggtttttcaactgtggactatgactcctttggggtctgatgacccttgcatgggaatcatctaagacaattggaaaatataggtatttacattgccattcataacagtagcaaaattacagtcatgaagtagcaatggatataattttatggttgggggtcactacaacgcgaggaactgtattaaggtcacagcattagggaggttgaggaccactgtagtacccatggctgctttcatctgaaccaaggcttacaggggcaacacaccacatctgcttctgcttgggatggtaattctgactctaagtgcccatactccagggctggtggaaatgtacaggccctttcccctactgctacagtgctgcaccacgtttttttgttgtttttttttgttgttgttttgttttgttttgtttttttttccgagacagggtttctctgtgtagccctggctgtcctggaactcactctgtagaccaggctggcctcgaactcagagatccgcctgcctctgcctcccaagtgctgggattaaaggcgtgcgccaccacggttttatagtctgatgtgatgtcatgcaaagcaggacagggtttggtcctggtcataatcctcttctttatacaggctacagttcccagtttcctggggactaggatgctctggaattcagcagtttttggacttgtaaggtaacatagcacacagactgcccattccacagcctgacagcacactgtactcacatgcacacatttacaaatgataataggacctgtttctgtggtcagcagcagtctctatgagttcatgccaaactatggccaaatgagttctagaaaagctcccaggtttcagaacttctggggattataaagtgcagggcaagatattatagtcagcctggtgtggtggcttatgcctgtaatagcacccaggaagctaaggcaggagaattgtgagttcaaggccaacctgggatatacagtgagctccgggccagcttgatctacacggaaggccctgtctaaaattatgtatggaatcactaatttacacttgttttgcttccactgtgtggtagccaggcactatgatgttgctattttacagctgagaatgacgagacacagtccctgtcagcagctctagcattaaagcctgatgctgtgctcagcctccaaccccacccgcctttctggcccagctcgcatctgttgggggacagacatgggaaaggggaatgaagctgggaacttcagcgcttgtggtctaaccactcagactgaggctcccacccattgtgcaagcattccgtatgaatgacacattagcaaagccacccaggtatgcctcagcaggcagtgcagtggccagggtaaacttagggacgcatgtcccacggctcatcgttaccatggagacatatacatggcattcagagaaagccaaaatctgggttttttatggaaggttctccttacttttaattataaaaaatgttttaaaaacaactttattaaggtgtaatttgcatatcataatcttttcccatgtaaagtatgggatttttaagtaatttttagtaggcatcgtgatagtctaattaaaagaaaaaaaaaacaacacttccattaaccttaaataaatctcacacccaatagcagctgttctccattctcaaccctgggtgaccattgttcactctttagctccataatctagccaagtcttgacatctcgtagaaacaggtcatgcagtgtactgccttttatgactgtcttctttcatttagtgccttctgtttgagatttatccatattatagcatggactagaatcatattcctttttattgctacagaagtgctcattgtgcggacataccacccttcctttagagactcctcagttgaagggaactgggctgtttctacgttcaggctgctggaatattgatgcgtggacattacaaacaaatgtttctctggactcatatttttgtttctcttcagcataaacctaggagaggaactgctgggtcacacaactcagcatgcttttaaccactgggtggccaaggaaccatcacccaggccctcggcccagtctcctgcctgtccaagggaaagtcatgaaggtgacatctaactctttccctgcctcaccaggctagaactcacctaatccctcatctttccgccctaccctcaattcctacccacccctaaccccagcagaatctgctcaataaattcgggctttgaagacgggaagtaaggaggaagccttttgccaataggttttgctttcccctttacttcagtgaggggttgggcctgagattccagggagtgctcagcaaaagcaaaagaaaaggggaaaaatatagaaaagtacaactgtacaatcagatttgcgttttactcaagttctattcccttaagagatgtcacagtctactgagtcatgtttgcccttggcctcccttaactggcttggatctatcattctcatgggtgtttactcctttgcgagaatgaaacccaggctccttggcatggacacagcctttgctggcctctcagtatccctctcatctcttggtgttctctttgctccatgttgcccgactctgggagcttgtccctccttcggtctggcttgctttctgacctctccctcagttcctccttcactactcggctgtagctcacttccaccttccccactccccagggaggttctatgggctggggaagaggcatgggagccatggggaaggggtctgtgataggattcggtatatggtccacgtattaggaacactgagggacatctgcccagctcctggactgtgaggctggaggcagaaattacagtggaagaacctactatttttttagggctctgtagcgtgatagtgggggagccagagaaagggagagagagggcctaggcaggaaggagacaggaaacagagaaacatagctggcggtcaggcccactgtgacagagggtcacacctgtatggagggagacacaagaacagaaagggaaagaatgagcaatggaagaagtgtgagacagacaggcaggacacaaggacacagccacatgggcctatctcacctgctgccatgggtatagctgactggttatcaaagtgagcaggggcctatcatgtcacctcctgagaaggcaggattggggtctgccaatggaggctagagggtgcaattcagtggtggagtgcttgtcttataggaaaggccttggcttccatcatagaggagccatagacccttccccttctatactaaaaccctgaggtgccttctttgtcccccatggtaattcctcacccaaatacttgttcttagctttctagggtgagtgcacagacacagacggaagccaggactcacctgagtcaagagctcctggaagtaggtagccccccttactccccacccctcaggaaagcaggttcatctcctcacacacctgcggttccaagctcccttccatttttgaagttgttgggaaggccaagccacacaggcctatgcttattccttcatgtaggagcttaaatgccatccgcagcctggaaagaaacgtgggtatgtgaatatgccggggtattgtatgactgccaaggagagtggccaaagtgctgatggcaccagtgtgtgccttctatccaattcccttccatcagatcttccttcagcctcatctgagcttcagctacagagcagttcacagaactcaagaggaaagtgttgccctagtcaatgggagccagaatgagaagaccagacactgggccctagaggttgcaaaaacccaggatcctgacattggcagcttggatgcctgctgggatcttcctggtgtattaactgcaccttctagctacatctccttgatttggtggaaccacaaagatccacccctatgacttaccttcccaagatctacctgctgaaacctaacttctagcattgtggcccgtgaactggggtgggatgtgcaggccaaagcagctgccaggaggatgggaacctcctgtgtggccacatttctgacttttataagagaagccaaaactcccatattttaatggaaatcctccagcttttaaatgttggccaaaagcctcatccgttctcctggctttcaccagcacctgcaggttggattcagccctccggctgccagcttcaattgcggctgcacgtgtttctatttctgtatatgcaatgattgattttacttcgagttatgtccttttcctcattagcctcagggaacagccgtgccaaggctccggtgactgtccccatgcttggcatttagatgatgttgcatgttagtgcagtgactgaggtagagggttcccagcatgcaacagcccccatggggtctgaaggttctagtgggaagccaggcactgctggctggaacagcctggaagtggggagaatcctggctgcaggacagacagctcctggtcatttgtgattcaaattccatgatatcctttgcacactcctgcaagccggggactgtttaggccaccaggccattcatacagatgagcctggcctcaggcacagggccaggtagaaactggccttctgggggaattggaaagggtaagaattttaacaagtttaataaaaatgggaagtaaaacctgagctggtggaacggctggtttctgtcagttataatggacttagaggactgttggagcaaaggatgctgggagctcaggagtctaggagaggcctgggaggcccaggaataagtcctaggtcttatccaccttcttccgagtggccaggaacatgtctagcatcagccctaagggaagggcttaagtagtcagccagtagggaaactgaggtcaaaacctcatggcaggggtggaaagtcaagcttttggaatctgttagatgcaatgtgtaaaccatactccagtatgtccaggaaagttcacatagccaagaaggacccaattaactctaggcctcccatcccctatctctctaccaatgtgctctgccttctgggcatgacacccacttttagagatgaggaaaaacaagtcgggaaagatcagctagcatgcctaaagtcacacagccatgggtgggagagccagacccagagtcctgcaatgcccactcaagactgcacatcacctcatgtgtctctttgctccacctcttttctccactgcctgaggccagggcttggtctgtctcctttgttcccacacctttatacttagaaggggatggtttgaactttgtcaggatccaagacattcctggggtgagcatacacatttttttcccaagtgaaagaaggctgacaattactctgtggttggctctgaggatgacggctacacaaagtccaggatgtcctctaccagtttccagagcctagtgacataccctctgattcacatgatggatagggtcagagaccagaagttacagagatggatggaactgtctctgtgtgacaggacagagagacagagagtcatagagaaaacctaaagagagacagagaagttctcactgaggctgagagacagatatggttctaatttctgtcactgacaccatcccaatgtagttgcttccacaacccccaccccacccaccccacccctccatcctccctatgcagcaagtgctgcatccccaaggattgaaagggtcctgggctcctggtcaaatggtcagagcagccagaggttggttccagcttgtgctgatataaggaccccttaacaaggtaaccaggaggtacaatgtcaaggttgattcccagtgcccagaagtccagtttagaaagagacactccacagtccaggccagagcttgatgccccacagcacaagggcactaaatcaaggttggtaggaagcaaagaggattctgggattgaagcttatggtgcctgggagccttgtatgtgtagctgaaataccatctcaaccccgagcatcaggcagcagagctggacccaagttgaggagtcctgggaatgcatacaacagctgctgagcccagagtggtgaccaagtttggttatcttggtgtctctgatacttcctgaaccactgagagccagcctttctgagtgtgtcatctgagaaagttactgggtatctgtgtatgtgggtgtgtccttcctgtgtcccgccaccagggagggccttgccgaagcctcataggccgagattgagagcttccttgagagccatccatgcagcttgtggccttcatctttgctgccaaagccttctggggcctttttttcaggcttgagatcaacttgacgtccagacagctgagacttgaccggggacagagtggtagttttctgaaggtcgccatataatttcatctcatgatacattgcttggtggtggctgcaggtggcagaggagagagatgacagctgctcctgagaagattcagtccagccgatgaccttgggttttcaaggcttggtttagaactgcagggaaaggctgttatgggggttggagtgacaatagggtctcagccctaaaggtctctgactgtgctaaggttgtgatgttcctggtgagtttctgcctttcctttctgctttctttaaaggctcaggctgtgccttggaaacttgttctccagtctcaggccatgttgatcacatcctacccctaccccatagcctggccaatccaagcactcaagctccaccactgccatgcttgatcctggggtaaacatgtagttttcatctgtgggatactccgttagactagcagccatgagcttggagcttgtggggtcactataaggaggaactatggctgagcacaggagatgcaggcccccttcttaatcaccctaacacccatctcatgctgttcctgtgtacatgttcgcatgtcttcagtgtcttgagttgttgtagcttctctcacttcagttgcagccgtgacaacaccacttgtgaccatgacagttctaacagtgctgagatggctatcttctgaataccaagtccttggtgaggggcaggtaggggggtcttcatggagctacaggatctttctggaatcttagttctgctttactgcctcactatgatgagtgtgaactttctgaccatcacgtcagagccatgagattcctatgagctgcctagagctaacttggcagcctgagcctctgggatattggtggtccaatcatcaagtactgaagctgtgcaaagaaatatgaattaaactaaatgtaaccgggttaaatttcagcaactagcaggaaataaaaacaaggcagacttaacaagaagtgtgctctaagagaggtagatgttcagactagagaagaatgggtaacaacacacctggaaaacaggagccaaagtggcctgggcaaacactctccttatctgactaaacagaatccaaaaagatcataagggtcaaggaaagatagatataaaaaagaataacaaatcaagaaagcatttattcatcatagttatgcagttacctggcaacacagaatttagagtgccaaatagttgcttctcatggtgtcctagcatgacaaaatggtgatgacaagtaaaacaccaaacaataacctgtgaaacctcaggaagaaatagttaaccgcaccgtgtgatcagagatgtttaacatgctcagaaacaaaagacttaagttagaattactaagtatataaagggttatattatcccaaccccagataaagccctggagaataatatgtccgtttcagaaactcaaaaagtgtgttagatctgaacccagctcacttggttttccaaagctgtgtatcattcttccttgtgtgggtgagagcatgggtgtgtgcatgtgtgtatacatgagtatgtgtttttatgtgtgttcgtgtgcatgcagtgagtatgtgtatgcttgtgtgtgcatatacatgtaagtgcatgtatgggtgtgcacttatatgtttggaagataggatctggtaaagaggaactgatgaaaggctggagctcaggctgtgggattggtctcaggaagggtggtcccagatgtctgtgtggtgtagattgagctgagaacttggttctcccagcagacctagtgcagtgaagtgtaaaactaatactaacactaatactagtgagatgaggctcacagccattgcctgctttggctagcacacctacaatattcaccaaacttttgcccacgtcctgagttacctattattgtgtaatgatactgctacagacttagcgacttagggcagtgcacattcagtggctctcagatttgtgggtcaggatatggtttagcttaggagggtcaacagttaaggagctaccaaaccacaatctctctgatgcatatctggtaaagggtttgcttcagtcctgtgtggttgttggtagaatcccatttactgtggtagatttcagggcttcaggtctccactgtctgttggctggagatttgatgtggctacttacacctttgggccatcctggaacagatgaactccttagagtagaggcaccacgaccctgtgctttcttcccatcatctctataagagcgattgaggagagaaggtgcctcacatgttgttcacccatgcctcaataaaaggcaccctggcaaatgtggcaaaggatgctctggggctaaagagttaaacggcatttaagtcatctgtcttagtcaatgttgatgtggctgtgaccatgaccaaaagctgcttgggaaagaaagggtttctttgacttccatatcctgaatcctaaatagtccactgagggaaatcaaggcaggagctgatgaaggagtgatgcttattggctttctcagcctatattcctacaggacccaggactaccagtcaggatcagccccacccacaatgggctgggccctcccacatcaatcactagttgagcaaatgtcctacaggtttgcctacagtctgattttatggaggcattttctcagttgggattttcttctttcagataactctagtttatgtcaagttgacataaaactagcctgtccactatccctctagtttgagtcatcttggaagcaggtgagagtttcctaggatgctggtttgcctgggctcagtggttttgttaacgtggccacgtctccaatggctttttcaaagctcatggaacataacctccaaatgccctagacataccatgtggagaagcctgacacagaggagtagcaagatatggacagcagagaagactctctctagtaatgaggacagtaggtacaaaagtccttaggcagagttatgcctcaggctgtctaagggtaacacaaaggccagaggggtgagagccaagatcaggactgactatagacatctcccattgacatagcttagtcagcccctcatggtggatttttaggggtttctagatactgtaacactcacccttgactatatatctgcccatgggtgaagtgtatctcaggacataacccaagagctggagctggtaactctaaggaagtggtgtcacctttatagccattgccaaagtcccatctataggggcagcccctgtgctagctgggtaaagggtcctttctgtccctttcctctgtccttacttggtcatcttcccccacctccactccagaagctgtttgtcttcttgggcctgccttctctcatcccatcccatctcccctcagatggccctggagtccaagagctctcagaagactccgaggacatgtctcttgatagaaagtctacactcggggacaactcccctcatctacagcctctgtggtctgctcttccagaagctgccaactccccatcagctattttgagatgaggagtaagcacaggctagtctgctatttgtccctggaaaggtggcggctggtggtgtcagacacagaacagaaggtgctctgcctcgaaggaagagctctgtctcccgggttccgcactctggatagagccaagtcataaattgcctatctggcactataagattttgacaggcctgggagtctgaaactcgtcccctggacatggttagtgcctgaggttgacatctggactcagggttgatcatgcctgtgctcaaatacacacttccttttgtgctgtgctgcctgggtcggatgtttttctctctgggctttagtgttatctgtccaatagcctgtggccatctcagtttgcctgggccgagacaaggactgtgtgggatggttggagtgttttgcaaactatgcttgagaattgagggtattattgcaggctatctgtggcgtgctgcaagacagtagcctgccccctcgttttccttgtgtgcaagcagtttcctgatcggaagtccagagcagggcatgctattcagctgatgccagggacagagggatggaaaggctggtagcgaggcttcagtgggcaggggggaagacgtcgtgtgttcaccctcaacctgttgtggatgtgtccttgtgcgtgcagcactgcttatgggcaaagtgggagaaggggagagaatccagtgcggagctgcaaatggggacagtttttggcttgcttatcttgtgggcagatgagctggggggcctgggaggtgggagaatactgagggagatagagaggaaaaaaatcagagagagaatcaaagagacattctgagaggtagaacagaggcagataagagaggaacaggccagggtgacagagaaagagacgagagggccctgaagggagcctgggcagggtcccacgcaggttccagaggcccctgtgcctcccaggaggtctttctagcaggctgcattctctggctttgcttttgttttggggacttgcttgctgtttagtccaggctggtcatgtaggttgttatgtagcccaagcccagactgatctcacactcaagagtcccctgcctctggtgtccaaatactgggactgcaggtgtgagtcacacatctggttcaagtgttcacactcagttgccatgatcaacaaagtcaagccagccccttcctctggtgacacacacacacacacacacacacacacacacaagcattgtccctactgatgctggaggaaagctggctttgaacctctgccctctgggtgctctgcctcaggattctcaagcttgtcacccacaggtaggtcacacttctagagtgtgtcttaatgttctagagggctgctgcagcccttgcttctggagtgcccctcatctcccttccccaaagactcccccaacaactgttaccactgccataggccaaactcacttccactgacttagcatctttgtctaagtgacttgagttcaatgcagctgagatttttctcagaaagggaaaccctacatcttgctgggaaaccatcagtgcccctggcagtggagggaggaagacaacaccaagcattgtcactgagaactggtgttgtacatgatgatgggggactcccccctctaggacattcggcaatgtctgcatacatgttatgccgacagtatgtgtatgtacatcatacccatgtgcctttgggtgctgtgcttcagttaaccactgcatctagtggggagagcctgggatgccacaaaacagcctgcaatagtcagggcagacccacagccaacatcactcaatgtgtgtagtgctgaggtttatagatcccggcccataagcagctggagccaagcaggtgtgtatgcatgggacaatactgaccagcttagggcctctgcctccaggctctgcagaaacacctggagacgctttcctggcccagaaaaagaacccaggacaacaggtccctgctcctaaattccaggcccttggtggatcttttaaaaatgtttctttttattttaattgtatattattttgtgtgtatgagtgttttttcctgaatgtatgcctgggcagcatatgtgtatgcctgatgctcagaaagatctgagaaggcatgtgagcccctgggaccagaattaaggtggttgtgagtcaccaagttggtgctaagatgctggtcctctgtaagagcagcctgtgctcttaaccactgagccagggcaccctctcagcagaggaggatttatccttgtagacaagaccccacatcccaagtactgccagttccccactttacccctggcgtggaggtgactgttcatagtaccctcttacccgctctcaaaagtcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcctctcctgcctcctagtcatctcttcccctcccccattgcctcctttgctccacctcctcctctctgtgcccctctttcttctccttgctcctccccctcttttccttagccccatcctcctctctcctctctctcctcctctcattcatcatctttctcctcccttgtcttagtttctgttctcttccctctccccctttccttctgtttcctccccccccactccgcaatccctctacctccttttacctggtggaggagaaagctgtttgattatgtattctgcctgtcctgtttccttggtgcaggcctttgaaatccccaaagccacaatttgcctcttgttttctgcctctcctgcagctgagccccgaggccatgaatgttttatatctagctgcccagtgaggagggcatgggctaccaggagatactggatgagagacatatttgttaatattaaaaatcaccccctacatatttaccctgagtcaccgagacccccaggacccctgtggacctcacccgcacagcctgagctcctccatagcctcaggctggatgggggtcggtggagtgcacaggctgccgggagcccaggaaacccactgcgtgacattggaaggtccctgttaaatgccacctccgatttgggccacttcactttaaaaggcaggatccacacaagagcagtgctaatgactcaagtggtctgagattagacctgtggagaagggcagagagagccgacagtctctgctgagcgggctgggtggagggcgtcccactaattgccacactctggagaagatgccagccagctcgagccctcatcctcagagggcagagcgagaaattagctcaaattggagctggaaagatttaggttatatgtaagaaggaactttctcaactctgaaatatgctaccaagagaggctgcgggttctccacagagaggctaaaaatagctcattctttaaaaataggtctgggcggctttaaacactgccagcacaggcatggggatggtttgcagggccgtctctctggccctctgcccctctgccccagacattggtccctatggggatggcatctgggtatctcagatttgtgcagagcagccttttctacaaccctgctgaaccaccccagctcccagggctctaacagggaaggctactcgctctggccagttgctcctcatttacttctggttgctctgaccctccctgttgctgtaccccacttctgagacttgccagggcagtctggtccacctcctgcttctcagttcccaaagggactgaccacctccccagagaggacagcagccctccccgctggcttccagcctgctttttcttctaatcccttccccactaggcagtcagaggagacttctaagaagcacatctggacttggggtgcagctcagtggtagagtgtggggtcatgcatgaagctctgggttccaccactacccaaacaaacaagccaagtatatcttgcagcaggaacatgattccccatgctttcctcacaggatctcagaatcaagtccaaacccccgatggcttcgaactttccatgaaggatcctattttcccctccagcatctctcactcctggcatgccctacccaagccccatctcagctccactttgcctggaagctgcaacctagcctctcccctgctcctttcagaccctcagcttggatggtacccactgtaggggcttctcactctacaaccctggacctcctgttttgactgccttgacacagacgtccccatcccattttgaggcaagcccatacatccacccgtagtccatgcctcctgctcggagaggcctggtgcttccagccccaaggactctgaagcatacttacttggagtatagaggaatagcaagatgcacactgctcattggggtgggtcgtgcctgtaactgaggccatcctgggctagagagtgagagtctgtgttgaaaaagccaaggagtggggggtgaaggggggcactgccatgtgagtttgccttatgaagcatcttttacaaacaaacaaacaaacaaacaaacaaacaaaccaggcatggcagtctgagatcctagcactttagaggcagaggatggacagaggatcaggagttggagggcagccttggctactggagaggcactagagggagagggagggtaggaaagtgaaagggagacaggaaggaaaagggtgagactactgagcagtctccctacagtgtcctgcccctctgtccacagctgaccaggacagactgggctgagctcagggcagaccatagaggaggagacattggtcacaggctttttctccaggctgaccctgagctgtaggagccatttagaacagaggggacaattaacaaatcaatttggttgtatgacaaaggggaaactgaggctgggagtgaacccagctgtacactggggagtcagtgtcccttggccatgaaatacagatggaagtttcaggttagtcacagcgatggtaaattggtaaagtcctactgtgttcctccaacagtaccccatagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgcacttttctacatctggaaagactacttcacatctcctccatcctccagcctccgatgccccatttgcctgcctagcctcactcatggctagtgaccttaactcacccttgctctgtggtgaagagaatgggagcttgtcatggaggtcagagcctgttgttatctgagcaagacctttacaagatctggtctgttcatgtttcctcatgggaggaggaagatcctgagagcctcacctgaggtcccagccactttcttgccatccacttacataaagcctggcctgattacacagggcctgaggggaggggggaagagttaaagtgggtggggatgggtggaaggttgacagggaaacagaggtcatcttgcagcatcagaaggtcattgtccacgctgtctgagcttctcattggtgcaagagtcacccacactcctgaaagtaacccagacttgggtggaaaccatttcttatgtcggtcaatgccctctgaatgggcaactagaaaccatctccccaggaaagcacacaacaccattcaactcaaatcttactcaagttcccgttcccctgtaccctttgggtagagcatctcagttgccagctagctactggattctaagaccctctctcatctgttttgacactttctgtttggcttctaggattggccttgagtttccgtgcaccagatgcacacaccccaccctactgctattacctgatcatctaagtaggaggtagaccagaagctccatctcccactttgacctctacccttttgcacagtccctcccctgcctgctactctgagaccctgagcctggagcttcctccatcatttccaattcaattattctcaatccatgccctccgagaacccatccccacacaatactccagtgggagcctgtcatggccacctgtggtctctggttggccagtccatgggtaactttactatcctgttcacctttcttctgatatctactctcttgagtgccctttcccacggaccccaagctaccccagttttctttccaggttagcttcctcggctggtctcctggctctgctcagccccagatgcttcatctcctctcctctcccagtctttctgctgactctcccaggctgccacctcatttcttcttctatgctgatgatccctctccagttctgacagctcccaaccacagagtgtacattgactgctcactcgatatctacaaagacagaaaataaccatttcaagcaaatatggcccctgaaagtttccacccacctagacatcctcccttcctctcttgggcttttctatctcaacaaatgcattgtcatctgcccaatcgctcaaaccaaaggccagcctggactttaagacagccactccacccacgtccacccacgtctacccaccaacaaaccctactggcatgaagcctcatcttttttctgttgctgaaacaaaatactcaagactagacgttgatatgaaatagacgtttatctggtgcatggttctggatccgtgaagcctgggagcaggatgctggcatccactctgcatcagaatgttgggtctgacagtgcactggcacctgggggaggcatcatatattgatagagtaagagaggcagcttcctctgctataccaacatcatcatctaccttaagcaccctcagaagtcacacctccaaatgccattagatccaaatgtaggggttacatttccaacacatgacataactgttggcgggactctgggtttcagtcacttgcccagcccagcctcttacctaggctcctttcttctcccttccccttaaccatcccactaccctacgagcagtaattgcagtgctctttaaaaaatagtggactggatttgaggcacaatggtggagacaatggtggcgtgcattcctagcgtgcatggccatgggcccggttttcaaagcagactctttaaaatgcagagttccactgtgtctttcagagatatacaactttcatttattgagctttcttaaagtgtggcccttcctgtttggagataagtagaattcaatctatggatcaatggtgttctaagccagtggttctcaaccttcctaacgctgcaaccctttaatacatttttttatgttgtggtgaccctcaaccataatatcattttgttgctacttcataactgtaattttgctactgttgtggatgtaaatacttgatatgcaggatatctgatctgtgtgacccctgtgaatgggtcatttgacatccaaaggagttgcaacccacaggttgagaaccacggttctaaaccaaggctgtagaaatgagttactctgccagcagctgggtctggccttggtgcatagctgggagatcctgtattaggtcctgtgcagccctgccgactctcccctaacatcaggaatgccgactcctgatgctgccttaaagtctctgcggtgaaatatctgacacaaacttaaggggaggaagatctactttagctcatagtcttggaaggttcttggcacatgcccttgagcagagagcatcgtggtgtggagagtctctggtggaggagacactggaatgggccagggccatcatctaggaaccagtccctgaacatgtgagacatttgggggacacttctcatctactctgtaactgttctcactaacgtttcccttctgtctgaatgttcacagaggctttttactgatcacaccaccaatgtatatttacttattattagtgtgtgtgcaggtgtgttggggtcagaggacagctttcagtagttagtgctctccctccacagtggtcatcagacctgtgtagaaagggttttcactcactgagccaccctactggcccccattttacaaaccaagagatcatactcctgagagtcctggtgactcttaaatcctttgggcaagggcaggatacacccttgggaaatcgactggaagaggctcagggaggcaggaggtaggatgcaggaaggctcatccagggggcagggcttctgagaaggcaacaatatcagaccaagtgagccctgggcaggaacacaagggaaagccttctccttccaggccatggctcccacagtaaagtgtaatgattaaagtgtgtgttgacacaacatgcgcagtgggtgtctggattggtggcacagagcacaagtgagacaggagcagagctaggaaccagagctatgtgtgttaggagacctggaatatcatgtgggcgagcatcccccccatctgaaattctggggaccagaaatatttagagtattttttcgacctgaagtatttgtgtatgcaaatgaggtatcttgggagggacccaaggttaaacaggaagttcgcttttgctttttctccgcctaaggcaccattgggaggtatttttttatatgatgctcacacctgtgttttgactgtgacttgtcacatgaagtcaggggcaggcttgccacttgtcagcactgaaaaaagtttgcgattttagagcattttgaattttttgaatttgtgttattctcatcctgcataaaagaatcattcaaagccagcggagaaagaaggagtcattctgttagggttcaaagcgacgagctgatcactgaggaggtgacatcaggtcgttccctcacaccatgcaacaggctgaactctagatgcactaataaactcctacaggggtgttgggaaagtacaagagaatgtgttaagtagacacaggaagcaaaaggcagaaaaggctgatagaggactcagtcagatgcagaaatgtaaggcagaagcagctttatccataatggccgaagcctcgaagcaaccgacttgtgcttctatacacgaatggataagcaaactgtggtccacccagatctcggagatctcttcagacataagaacaaatgagcactccacccacgagaagacatggaaggactgaaacccttactgcttggtgacaagcaggggagacacagtatggactccaactctaccacacgtggaaataccacagaggagacaggaaacaaacgtaaggctgctggccgcttgggggccgtcaggaggaagcagatgtgccaggagggttttagagacttggaactcttctggatggcactgaatggcggacatgcatcactacagagttgccagccccacggctgtgctgcacaagcaggagtcaaggggctcgctgtgagttttagtgactagcagtgtgcccaccatggctcctccataggaaagcgtgtcccaccccgaggatagaaagtgacctctgaactgatggtgtggcaaggatgcgagcactctgtgcctgccaatcaagctcctctggaaaacaaaacttattgctgaaaaaagaaagatgtgtgcagagaagactagcctcaggattagtagcctgagcacataaagaacttataccaagctacagggagatggtgtgtgtgtgatgtgtgagtgtgtgtgtgtgtgtgtgtgtgtgtgtgtgtgtgtgtgtgtgtgtatgaatgtatgtggtgtagtgtatgtatggtttgtgtgtgacgtgtgtgtgtgggtgagggtatgtgtatgtgtttgtatgatatgtgagtgtgtatggtgtggtgtatgtatggtttgtgtatgtttgtatgatcttcgagtgtgtgtgtgtgtgtaggatatgtaagtgtgtgtggtgtggtgtatgtgtggtccctgagtgtgtgtgtttggtatgagtgtgtgtgatgtnnnnnnnnnnnnnnnnnnnntgtagctggagagaagagaggtaagcaggatccagttgcccagcttggggtctgaggcagagcccatgaggaggagagagagagaggaagacaccatggggaggtggattgtaagaacatagccatgagagctggccagtctgagtaggagcagcctggatggaaaatggcaggtcatatctaagggttattgacagagaagtagacaaaatagcatcagaggttgatatttgtccagctctagtgcttttatggcttattataaatataaaggtttgtgtcttttatttgggagctaaataatctaaggtgaggtagaaacccctaaacaactcagggggataagattaaatccaggctattctgctctgtatagtaatagtgaagcaaatacaaaatggaaaacaagaaaacataagaaaataaaacaaactacacaacaagaacaaaactcaagagtttcggaatctgagcctgtcctggttagttttttattttgtttcatagtttgttttttatcaatttgacacaatccagagtcatctggaaaaagggatcctcaattgagacaatgcccccctccatttgacttggcccatagacaagtctgtaggttattttcctgactgatggttgatgtgggtgggcccaagcacaccgtgggaggcgccacccctgggcaggtggtcctggctgctatgagaatgcaggctgtgcaagacatggggagcaagccagtaagctgcatccatccattgcttctgcatcagctcctgcctgcaggttcctgccccgactccacccttggtaggttaactaccttggatgctacctgagagccgtgacatgttggtctcctgtcttcttctcatcatctacccccttcctcttcaggattgtctccctccttaagtctgagtctgtagcttgaagctgaccgcacaggaggcctcagatgagatggtctataacctgctccccaagagaaatgctgttttgtaataatcctgggtggttggaatgatctgtgcctggtgggcatcagataccgaggctgccttattttgggttccttgagattctccacacttgccacaaccttcgtctttggaaatgaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggggaggggagggagagagagagttagactaatagttatcttgaatagggatttcaaaaattcttcaccaaagaatggcagaaaggagtccagaatatatgtaagccacgttgaagaaagttacccagcaatgaagacttgaaacccactcagagccatcaaccgcatcagcagccaaagaaaaaggaatgtcacatgattatatcagcatgcacatgagctagttcatgttctaaataattctcccagaaaataaagatgaatgggaattcagcttgataacaagtgctgataaatgtctgtagatagcattgaaataaagttgaggggcatctctgtgatactgagaacaccactggaagtcctggctagcacaattaggtataaaaggcaataaacaccatacagatcagaaaagaaggaacaaaccacggccatgtacagataatgattgtgcagaaatacccaaggaacgtaccaaacattctacagactggaccagtgagttcagcacagccatgagaggaaaacagagactcggttttatttctataagcttacaatgaaaatttggacaaaaacttaaaatataattatatttctactagaaaagttaaatgcataggctttagactaataaagcatttctagaactcatatgctaataactgaaaaattccaatgaaagaaatcactggtcttgatagtagaccatgttcatggatcaaaaccctcgacatgaggtccatagcagttctcaaagtagaacacaggttaaatatgattctcatcaaaacttcaacaagacttatacaaaatttcaaaatgcagatggacatagcatttgaaatgtaaatgaagaaaatatctaataaaaactttttaaaaatgcagatggacacgcaaaagaaacagaagagttaaaaaaaatgtttaaagaagaagtagggtgactcagtctacccaatttcaagacctattagagctacagtaacccagactgatattaatgtgtgtgtgtgtgtgtgtgtgtgtgtgtgtgtgcgcacatgtgnnnnnnnnnnnnnnnnnnnntggtctttctaacacaggtgtcagcacatatagctgcaggctaaaaccaactctttttctgcattgttaagaaagtcttattggagaaacacattagtcaacatgactcccatagccaaatggacgagttaaatagtttttaaaacagacaacatggcccttagactcaaagttttcctttttggcacccttcagaaccagtttctaacatacacccgttgcttaaacttggaaagggctagcctggatcctctggtccaccccactggctcccatcctctgctcccttccatgctctttcctaattctaacagttcagctggcaagtggctgggggcgggaggtatcgtagagatgggacaagtccttccctggatcctgacgcctgctctgctccgcaggtctcctgggaatggtcgcacacatgatgtacacacaggtgttccaggtcaccgtgagccttggtcctgaagactggagacctcattcctgggactatgggtggtccttctggtaagtggcctttcaccttcaggtaccagactctgagttatgctggatacacaaagggatgtgtcagggtcctgtggtttgtggatggcagaaacccatgctgcctagaaaaagttgcttactcagaagccaggatgaggtggacaggggtgaggggtggagggtgggcatacacaaccagctgggactctggtttgttaaaaaaaaaatcccctgcccaatcagcctaagcgaagagactctgtagcttcccccaaggccagtgtgtcctccacaagcacagatgaggcccacgtctctccagcatgggccgaggtcctgaacttccctctgatggacacagatgtctcttttctgagtggttaaggcagctggggaatggcttggaagttgtggctcagtacacgtaggccaacctggagccagggatgagtcccaaggtgtccagcggcaactaggtggatcccatgctgtgtgagcccctgcagggtctgcttcaggcacagttggatccaggcacagctggatccgggagatctggtgatttcctcaaggacctggtctttctctccctcttcctctgtctttcatagcttcagactcaagcagcttccctcaaagtggtggcaaagatggcaggcaagcaccgcttctggtacagccccttaccgagcagcgtgggaagatggggaatgggaagtgggaggtgaggtgggtccttttctgaccttgctggcaaaatctctcattggcttagcaagagtcaggtgactatccttaagccaagatttaaatactggggaaatgtgaaggacctgctgggccctacctgagtcacatggtcctgagcatccttttggtagggagtggagagggctacgaggacgctggagataacattggagggcactgtggctcagggcagctgttctccacggtgctgccggggatgcagctgtggtggctcaggtcccatgggttccaacagggctcagggtcaatacttagggaactcaagaaacctgaatgggaaatacagccctgttagcagaagggacctgagtcccagtggtctggtgctcagctacaatgagtgacaggaattctaggcatggtgctccatgctaaagctaaagaagtccacagacttcttagactgctgccatccaggatttgacatgacagtgacttcctgttgactagtgggaaccaaggctcagacagagtagaacacctgccccaggccacacaactttaatgcagcactaagattttttttctgtaccccaggacacttagcagcccctggatcccattatagcactggacttccaagctgagtttgcggactttgactctggccctgtttcccttgggcctggctccttcgcccacactgtctcccacatagtaccagcttcctcaggacttgttaaagccgcctaacacagggcttggattatggctgacacaatcgtccgtgtcacagaggcccaagggataggtaactatttctcattccgtgggcaaaggaaaccaaggccataggaggccatctcttttgcttaatgaatgtgaagccagttgtcacagttctggctaagcccccttggctcactccaggcagggtgtaagagaccaggtttgaggcaggaagccccagcctccagcttcaggaatcacgaggctgagcccttggaacattgagcgttcaaggctgctgagcattctctggaggacacggttaggtgtgtggtgaaccccagtcttaatgcattttgagccacccagcaggcagagttgagggtggccaacagtgagacattaggtcaggttcaaggctgaccctaacccctgctagatgtggatgctgccaagtcccttacccctgtgtgtctcagtgttgtcggctgtaaaagggagatggccatttctgcctcatggggctctggagtggcaggcccttagctctgttagtgggtagcataccacttagcatctactgggtccaaggaaaactgcacatcacctcctatggctttgcaggctacctaggctcagcaggttggtcttagcttggagacttccataacaatctggttcacattactgagagatgactaaggtgaccttagctcagcacaatgctggctagcatcagttggtggctggggcagcttcttgtgcctggcggctggtacccagggtcaacatcccatgatcaaacatttcaggacacccaggtggaagctgcaggcttggtgtgtgaggtcctgtgtcactctgctgcactctgtgggtgaagggcaggtgcaggagctgcagcccctccctggttgaggctctcatagacagaagtgaagaagggagacttgctttggggtcacccgggcgccgactgaggtagtcactcaggcttgacggatttcctgtgtgtgtgtgtgtgtgtgtgtgtgtgtgtgtgtgtgtgtgtgtagccagcgtatagtagccaaacaaggcagatgctctgtgaacaaagggggcatgaagggaacctcagccactgcactcagtgccacatgacccagatatccaactgcccatatttggaggaacactccaggatgctgttctctttggctgtctcagctttccctagtctacccagaacatgcaaggcaagatgatggtaggcatccagctgagatgagtggatccagcctgggtggagtaaaaggtgagtgagccaacagctccactcctgggtcagaaaggtagagtgtggaatgcagtttcccaagcagccacacagctaccctcagaagctgcccgaagccccagcctgtggtgggtttcctgggcctcaacctacactgatagtatgctcatctatgcagagtgtggactgtggtgtgacacggtaggctcccggcttgtggcttgtgggaagacttgcctggcctgtgcctaactcgctttgtcaggtgacaggctcaggtaggactaacagtgactatcctctgccctccagctctccccagtctctgccatgacccactgcctcctcacctgtctggccctgttgggagggtcaaaagagcgcagatgcagtcctgaacaaacttttttgtttcctgtttttctcttgatcgaaatgcaggggaaagagaaccttcctgactttgagcggtctctctgcagattataagccagagcagccatccctagtgacatgttcctggaagcatttgggaggtgatgtcaggaagattataaatttgaagccagcctgggctacatgtgagtacccccccccccacacacacacacatacttgaaagacccagagaggctaaatacttcagcccaggccacacaggaaaagagtgagctgggtccctggaaagtttgtctcctggcctggccaggagtgaccctctacactgagccccttgtcctgtggactaagggagccttaccattgcccctccttcctttcccatctccctgaccctctgggagctgggacccatgggctgctttcttgttgaggaccactggacacccattctgcagtctggtcccaagcaggctcctctgtttcagcactcgaggatttcctgaggatccccactgtggagattttgctgggttggctggtgttctgcccagaggctgtgcggtcagcagaaactctggccttcttttctgtaagatcaagacagaaaaagggctgtggcccacaggtgtcctgatggtcataccttggagacccctagagcctgtgatcattttgttcctaatgctcttgggctcagagggtggcctggggtagtgtcctgtccctaacagtgatcctgtgtcctcagtctaaaggtgtctgtgagaggccttccccagtgctttgttgttatctgtgtggggcctccatggcagaccagtgcctctagatctgctctctagcagcctctgcacctctgcattgcctctgcgactcctggggataaaggaggtggatagccacactctcccgtcacaccaccttcactcttgtccccaagtgtccattgtgctcttagctgtgaaaccaggccagccacccccatacttccctgcagcagctcagcagtgtgaatagcagacaccagaagtttccagtcccagaggctccaagctgtgtcctctgcagggttggtggggtgctgccagggaaacagtgtgtttattatctgcttttaatctgtttttgtttcctctgagttaactcatttgtgtattcattccacagttgtttattgaatacctgctgtgtgccaagccctgttctaggtgccatggcatagcagtgaagcatttgggtctgtgaggggaggagtaatcacaaacaaatcagggctgccacatctaggaagttagggtggacgcgtctcccagtgcatgaactcttcatggctaagttcttgtgtgggccattgtaaacagagtcggatgattctggaagttggagagaagctaggagactggatgctctcatgctagagttggagctgatggcatggacgacacagacagaatgacagccaaggatcaggaagggtcccagtcctggtcatttctgtcaccaagataagcaaaaagaactcaagggaaaagggtttatttcagctcacagctcagatgcctggtccatcctgggaggttgaggtagcaggtgttgaaagcaactgctcacatcatgcccacagtcaggaagaagagagcaatgaatgctcgctcagcccactctctgttccatgctgtccaggactcaagcctagggaatggtgccaccacttttagtctggggtcttccccccactacggtgatcttatcagtgtagttcctcacaggaacacccagaaactgaacaatgcctcacaggtgtaccgagatacttgttttctaggtgattccaggacttgtcaggttgacactgacactacctcattagctgttagtggagattaaaactttaaggcaaaatttccccgttccggaaatccccgtttccccaccctcggcagcagagatggagctgagatgctaccttagcagaccacaatgaggtcccggcttccccatttgctgtgtggtaccagaacggggagccccacatctagatcagtagcgatccctcccactcagtacagtgaagaccatatgggacacaggaagttggggctcttccagatataacaaacaccccatgcacccacctcagaggcaccagtggggagccagggattttgccagcttagccaatggggatgaaaccaccttctccacagaatcacggaaggcagtgaggtacagggtgacatacccccactgctctctgccaggatgtgtccggagaggtatgctgggaagccagagccagcgtctgcccagagaaagtcaggaatccttaccatcctgagtggtgcctagtgggaaactgggactcttatgcttgctttctagttatcagatggggctctcatttttcttgccagaatgtggtcaaaggaagccagctgaagccaaagcttcaagacccaggatctctgtagaaatgtccaaaatgagccagactacagtggctcatccctgtaatcccagaatttggagaggcagactcatgtgttaaaaaataatagaaagaaaaggaagccatataaagtgtgtcttctggccacagtgaaaccaaacaaagatggaggaaaatcaggaaacagttgcaaactaaagaacaaacttctcaacagtgcctgagccacaaaaggggcctcaagggaaaactttaaaatacattaaatgaaaaaagctaaaatacaactcaaaaatctgtggagctaaagtagcaccgagagggaaaagaacaacgctggatgactagatggttccttatcaaaaagagaaagactgggactggaggggcagctcagtgcctaagagtgcttgccactcagtcacgaggaccatatatatggggtagagatagtaagatcactggggcttccaacctagccatgaaaatacaagctacgtgtttagggagagaccctgtatcaaaggaacaggcaaagagtgagagagggggatacttgatgccttctgtcctctgtctacacactcatatacatgagccactgcacacaagtgtgcatgcagtcatacacagtaacacaggtacacacaagaatgaacaaatgaacacatctttttaaaaggagggaaaatgttttaaaccagtaatgaaagtttgtgctctaagatggtagaaagaaaaagaggtttaaaataactccaaagataaacaaaagaaagataagagcagaaatcagcaaaattgaaaatgaacaacagcgacaaaaagaaaaaaaaagaaccagagaaaaatcaatgaagcaaaaaatctgctttttaaaaaacatgacaaataaaattgacagaccctagctttttcaaaactaaaatgaggtacggccgtgacagaccccgaggacatcaaaagcatagcaaggacatattacaaatggcttgggacacgtgcacttgacaaatggatggaacagagcagagcagttcttctgaaagcacagatgggtacttctcacccagcaggaaataagtcgtttgaatattccagtaactactaagaacactgaaataatagtttttaaatgttcaaaaagaaatctccaagcccacatgatcttattgggacatcttgccaaatatttaaataagaattaatacctattatctgtcagataatagaagatgagagaacatttagcaatttattttatgaggttagtgttattctgatactaaaaccagacaacgaaagtgcagagagagacagaaagacagagagagagagagagagagagagagggagagagagagggagggagggagagagagagttagactaatagttatcttgaatatgatttcaaaaattcttcaccaaagaatggcagaaaggagtccagaatatatgtaagccacgttgaagaaagttacccagcaatgaagacttgaaacccactcagagccatcaactgcatcagcagccaaagaaaaaggaatgtcacatgattatatcagcatgcacatgagctagttcatgttctaaataattctcccagaaaataaagatgaatgggaattcagcttgataacaagtgctgataaatgtctgtagatagcattgaaataaagttgaggggcatctctgtgatactgagaacaccactggaagtcctggctagcacaattaggtataaaaggcaataaacaccatacagatcagaaaagaaggaacaaaccacggccatgtacagataatgattgtgcagaaatacccaagggacgtaccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgagaggaaaacagagactcggttttatttctataagcttacaatgaaaatttggacaaaaacttaaaatataattatatttctactagaaaagttaaatgcataggctttagactaataaagcatttctagaactcatatgctaataactgaaaaattccaatgaaagaaatcactggtcttgatagtagaccatgttcatggatcaaaaccctcgacatgaggtccatagcagttctcaaagtagaacacaggttaaatatgattctcatcaaaacttcaacaagacttatacaaaatttcaaaatgcagatggacatagcatttgaaatgtaaatgaagaaaatatctaataaaaactttttaaaaatgcagatggacacgcaaaagaaacagaagagttaaaaaaaatgtttaaagaagaagtagggtgactcagtctacccaatttcaagacctattagagctacagtaacccagactgatattagtgtgtgtgtgtgtgtgtgtgtgcacatgtgtgtgtgtgcacatgtgtgtgtgtgtctccgggtgtgtggggaggtagacacatccatcaatgggacagaacacaggaatccaagagcagacgcaaacaaatgcctgctatttgacaaatgctgctatttttgacaaacgagatcgtcagttcagcggaatgagagcaacgttctccacaaatggtgctgaagctattgtatactcataacagaaaaccagcattcatttaaattctgcattaaaacaggtcacaggcctaagcataagatgtaacattataaaagttttagaaaaatacaggaggaaagcctttgggaacgagggcttagcagacgttttcttcgatttcacttcagaagcataaaaggaaaaaaaaatcaatcaatcagtcagcctattaagaggctggcaagacatgctatgactatgagtgtctttaatccacacatctgacaaagggctaacatctgacgtggggttttgaaagagagatgccccctataggctctcataatttgaacacttggtccccagatggtggagctgtttggggcgtatgcggtacagcctcgctagaggctccatcactggctttgaggttagttatctccaccccacttccaggtcccctctctgttctgtgcttatggttgagggtgtgagctctcagcctcctaggcctgctgcttgctgccatgcctccactctgccatgatagagtcaaccctctggaacctaagcccaaataagctcttccttaagttgcctttggtcatggtgtcttaccacagtcacataataggaactaatccacccagggcatctaaggaagtgaactctgaaaactacgaggacgcaagaacaacaaaaccccccattaataagtgaactctggagcagggatacagagcgtgcaaacaagcagacaaaaagttcaacacctttagccattaggaaacgcatttaaagccacgatgagctaggactgtgtgtctcttagaccagctaaaataacacatactgacccaatctaatgctgcggggctgtggagacacacacatctctgcaccaaagaagaaaactattgatggatacaatttgagtcactctccagagaactgctaagtgaaaagagccggccggggcatacaggtcgtatgattccacctatatcaaatgctggaaatgtcaagattctagaaatgaagaacagattagtggttgccaaggaccagaggaggtcaggaaagaagtggatgtggctataaaatggcaagagaagggatccactgtgcactgtagtttgattatgagtagtgagaaccttggtcctgatactgcaccataattgcactcattttgtaatgtgttgtaattgccggaaactggctaaagatggtacgactcctcccatctctccatgcgcgtattagagcttcatttgaatctataagtatctcaatttttaaattaattttaaatcaaagaattattaaaggggggggaggttccaagaagattgtagggtgtggtgaggactgaggcttagtagagatggtgagagtggggactgaggagtgacactggaggtgaggagtacacagctgggctggaggcctggggaaatcttggacaggagggaggcctgagtggggcaggggctttggtgttttgagaacaaagagggtggttggtggctggaatgtgcaacactaggctagcccagggaacactctctttgaattaatgtcctacatgaacagcagatggcatgtggacatggcctacaggtcagttgcctttgtgtctgcccagcaatttctgtctgcctctgctctatccctgaagcctctgttccctctctatagcctgggctccatccctacagccttgtctccatccctacagccttgtctccatccctacagccttgtctccatccctacagactagactccatccctatagacttggctcaatccctacagcctgagtctatccctacagccttgtctccatccctacagccttgtctccatccctacagccttgtctccatccctacagccttgtctccatccctacagccttgtctccatccctacagcctgggctcaatccctacagccttgactccatccctacagccttgactccatccctacagccttgactccatccctacagccttgtctccatccctacagccttgtctccatccctacagcctagactccatccctacagccttgactccatccctactgccttgtctccatccctacagccttgtctccatccctacagcctgggctccatccctacagcctaggctccatccctacagcctgggctccatccctacagccttgtctccacccctacggccttgtctccatccctacggcctgggctccatccctacagcctgggctccatccctacagcctagactacaacctgggctccatccctacagcctaggctccatccctataggtttggatcctctctgtcttagttaagcttcagttgctgtgatgaaacactataaccaagagcaaactgggatgaaagagctggtttcatcttatacttccaggtagcagttcatcactaagagaagccaggacaggaactcaagcaggactggaactggaggcaggaactaaagaagaagccatggtggagtgctactcactggctcactccttatggattgctcagcctgctttcttataccattcacaacctgcccaggggtggtctgccacaccaatcaataattaagaaaatgcacccacaggcttgtggtgacaatcttatagaggcatgttctcaagtatggttccttgttcttagataactcttaactgttttctagttaacagaaactagccaggatgggcttcatccttttcagccccttgctttgcttggatctctgcctgcagactttctgcttcagcctctgtttgggatcatgcagagtgtgagtgaaggtttattaaagttaatatttctgactgtaagaactaaaaattcaccctaaaacgaacttatgtgaaagaaggtgtttctatagataagtaaacaaggatttttgtcacctgtgtcagaaaaccaatgagaaatggctgatgagggaaaaacttccaaagaaaaggattgggttcccaagagggacaggttcaaggacaatggaggcagctccttactgtctctgctttctcctgggccagcttaagtctcaggttgggaggtgacaagactgtccccagcatttacagatagacagctctctcagtaacccaggagagatatgggctcttcttctctacagcttttgagatggtgcctccatgttcaggcctagaccatgggcccatccctaaaggctgaggcaacagaaagcagcacttggattgcccaggcctagtcaggtactcacccctagaggctaaaagcaggccaggtcctcacaagctatggccctgagaggatggaagtaccattaccagaggcaggaatagatactgggcaggttaaactaacactgcagaattctccaaacaagctcacttcttcattttcccacctcaggttgtgagttttcgtcagaaggcaaccctgacttagcaacttagctggcatcttagctccattgctcaggagagagcacttgattagatcagcttcagccacagccctggtgcagtcatccacaccccctgcagtgtgtgtgtatgtgtgtgtgtgtgtgtgtgtgtgtgtgtgtgtgtgtgtgtgtgtgacacacattgcacactttaatgggtctggaaatcctcagagaggctgacaccttaaaaatgtctattatagacactccaggcttctagaaaatctaaattagcttcaacagatgtgaggaacctattagtgggttaggcatggccggaaataggtgattattggagatccatttgagaaaggctgaatccgcaggcctttcctttcctctccttctggagttcactcaggctgttgtcaagagggaggcagggctgccctgaagcagggattagggataatggtattcagagaccacaggtgagctgttggcaggtaacaacctggaactctcaggtaccgtggtgctggcagagcagacacgagcgcataaactgagatcagaagggattcatccgcctggaggaaatcaggccagtgggactgaagccaggtgggctccccactcctggcactaagtgtgagtatacaatccagatcagaagaatcaggcaggataccatttctagaactgagtctggtttgggggtgagttcagtgcactcatctggtagggcagccaagcagtccagctacaggaggtacaggcagagagacagtggggagacagccaagagggacatcagagcttcatctcccagtgggagtgcctatgtcctgaatcacaaagaagcaggagttaagaatgcctttccaggtagtgacagtaatgacagcgagcctttcctgagggcctccacatgctggaccaaggctggttggtatattcaagaaccatctgccttaattccattcacaagactggatgtgaggagcacgaggcacggaggtcaaaggtattttccaggggtatctgggagcaaaggtgactgtaaccctcatgctcaacatgcctgcctcctccagaatcaacttcagcatctttaggcatccccactctagcatccctgcctcccaccatgtgctcatggactctgctacctcatgcctccgtagctttgcatgctgttctcttctcccaggatgtcctctggccaggacttcatcttcccagggccagtgttgttatcactgtatcctgggtaactgttcccgattcttaccctgctctcacagtaatggctaagtagatgtgtctttgtcacaatgtgaagaccactgtcattcttccagatcaacatggagtgggaaccaagtcttagggcttgtagctatgctaagcagacaaataatgtgtggatgaggctccttgtccatgcccaccctcactgtggcctctctctctctccctctctctccctctctctccctctctttctctctctctctctctctcttgacagcttggcctggggttcatttacctgctgcatggcggcatctgtcactacactcaactcctataccaagacagtcattgagttccggcataagcgcaaggtctttgagcaaggataccgggaggagccgacgttcatagatcctgaggccatcaaatacttccgggagaggtcagtgaacacatggtcccctctggccagtactaggagtttaaagaccaaggcctaacctcagtaatccaaagctcttattcaagactggaacaaatggtctgattgaggtgatcttggaagtgggacaaactgggtaagatagagtatggacttttggatttctgggacatcaaatgttttgcgggcataagattgctcaggaattatatgacccgattatggaaagctcaaaaaggaacaacatgtgagtggtagccattcatccccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaactgccccagtaaggatgagatgggctcaagtctgtgcagttgagactctgagcctattcggagctggccatgtccccgagaatcagagcatttgataggaggaagcagactcaccatcaaactcagggatccgcttgtgcccacataggcgtccatatttgccccgtgttcacagtgtatgtgggggtgccaggggcgcttactacagatgtggggggctctgattcaggagtcagccttctcaaaggcatggtgctttctagaatgtccagggtgctggatgcggtcagcagtggtggaaggaggcccgggcttcctactcacaggagtaggaacactgagcttgctctccgtggaagctaatccctgagtgggagcctgccatgagcacacctttcctgatccttgcctccttccctgtcccctttcttctctcctgtgtttcttgaagccaccttcccgatacaccctgtcccctgtccttgggtgtgaggagagggggctgaggaagaggtaaatgcaatactcccagtgggtgtggctgagcagccccaggagcataccctcagtgtgtgtggaggagtaaagggaagaagactgggccagagagttctttagaggctgaccatgtatgccagccacatggagtgggggatgggtccctgcatgattattccagacctttctctgacttggtctttcctctgcctcatcccttccaccacaggtgctccaagactgccctattctggggttttgcatctgtagtaccccctgggatacacatcagttcaccctcttcctggtcacttttctgcatgtatgccttgcatacttaatgctggagttagtgtcacctggtctccagggttgtgccagaaaccgagtgggaactcatgaggtactttcctggcgaccaaggattactttcctggtaatctttgatgcttggatactgcctcccttttgcctggcggttcactccggtctccttatctgcagacagtgtcctggcagagaggaggccattcattcccagcatgctcaagagcttgtcccagctcagcatcagtagccaggaccggagatgggcaaccctcagaacctaaagctgtggtgaatagcctgaagcccccagtgcctcattaacaccacaactgcgtgttatactttcatgtgatccaactagggaaattgcaccctgcgctgcgaagggagcagctcagatcgtgcataccccaccctggcaagcggcttctcatcaagccccagttcctgaagccctggactgctcaggctcgtgatgagtgcttcccggcatacgtgcggaatatcactttgcacattcataacttaacattatgcagaggttcatcaaatttgatttcccttccctccgaggagaatgtttcagccctgctgctctgttctattttcttcctctcccccccaccccgccccccttgctctttgcctacaagcagctctgagcatgtggctttgttgcatggcttttgcagggcagctgagagacactcaggagagccgctgggaaacagagtgctgtggtctgacctggctcttcactgctgtgtgacttggctctaggcagcaaacaactctgggcctgtgtcttctgcacataaagagaatccaggtcccttggcatctggaaatgctgacattttgttcccctgtggtgtaatgggctcaaggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataagcttggaaaccacctgcttaggttagaggcaggatagtgcttcagatgggttgttaatcttgtaacagctcagcctgacccacaccccctaagcaccccaagtgtgactgacttattaatgcccacagaatctctaggaggtatggaaaaagtgttgtccctactttacatatgccaagttgagtcccagaggggtgctgtgatttgtccaaggccacacagctggctagtaccatcccaggccacatagttaccatggcatttaatcttgatccttgatgactattgtgtggcaaggacagagtagccttggcagaggagtctccgggtagaggagcctgggtggaggagcctcaatgtgagaggcaggcagggccagcacacgcaggctgggaagtgtgagcacctggctcatcacagcacagtgttggttcccacttccccattgtcaccatcaagaaaggagtctgcatcccaccctctatatccccgtggggtctggaaactgctgctctgggaagctgttgggcagatcggcctgggctgtctcttccctacctcattcccactcttacccaggtccttttggaattttctcaacaagagtccttcaaaggtgtgaggggctgttaggtgggttctgagtggctaggggctttgaaacattgtgtgtgtgtacatgtacacacatgtatgtgcacacgtgttaacgcatagcattctcatgggaaagggcaggtcataccaccaggctggctgacccagcccctgaaaactggcaactgggagtggtatgtcctaaatctatgaagcctctagaattctaaaggcttcttgcccactgtcttgctgccagctgtccccaaggagagagtcgtaactggcctcctggggagtgggtgggagctgttgaaggtaggcacatatttgcaaatcaggggttcttttaaatactcaaatgctcagatctggtttaacagcatgtgagaggaaataagacctgttgggtcagaccctggagagaactctaccacactgaccaagcagcctgcctccctgtgggtgcggcagcctctgaggaaccaggagcccagagctgttgagaggacactcccactcgggtggcctcctgccacctgcttccctcctgcttcttggctcttctgatgactcatagcacatgctcattccttgactcagctcgaggcatgcagctcactctgctcgccctgtgtgtcagcctttcccgaagggagctcactcttgctctgcagcccgacccagcccctggatccacaagggctctgcaacaccaacattgttaattagcagcaggtcagccggggtttcccatggcagccgtgtcttctagctctctgcctgccctgagccctgagtccttgtggaatcagactttgagttgagtctgcgagctacgcttggtggcagaaattgtgggagtgagaatggcaagttcaaagcctgcctggcctacagagtaagttcaagggcaacttaatgagactctgacttttaaaaaaaaagtaataaataaatttaaattttaaaaaagagggtgctggatgtgatagcagatgctttagccccagcacgtgggatgcagaggcagatgcagttctgcaagtttgaggccagcctggtcttcatagtgagaccctatctcaaaaatgaatgaatgaatgaatgaatgaatggcataggtttaatcattagtactgcaaatatctatacacatacacatatacatgcacatatacagcatatatgtgtgaatacatatatgagaaaacaagtagaataaccttaggggcacgagtaccctcaccaagttgcttcacctctggggagtcctgttgtctggctggggagtgagtgtgtcctacctcccagcatggtcacaaggtgactggagacttagtaggagcatcctctcttgctccccgctagacttctgagatctccctctgcacagggagaataatactacccccttaggaagaggggcatccttcaagccagtgtttcctatccttgtaagcatcctagcagaagagtagggactctgggtctctcctttgatctatctgacttctaaaacagtgggccccaaggaattggaattttctgggaatcccatactgaagtctgctgcttccagggagtggcctgtctcctagggagagatttcacagggtacttgtactggctagttttgtgtcaacttcacagctggagttatcacagagaaaggagcttcagttgaggaaatgcctccatgagatccagctgtaaggcattttctcaattagtgatcaagggggaaaggccccttgtgggtgggaccatctctgggctggtagtctcagctctataagagagcaggctgagcaaactaggggaaacaagccagtaaagaacatccctccatggcctctgcatcagctcctgcttcctgacctgcttgagttccagtcctggcttccttggtgatgaacagcaatgtggaaatgtaaactgaataaaccctttcctccccaacttgcttcttggccatgatgtttgtgcaggaatagaaaccctgactaagacagtactgaaggcttatcagacaccttgtagaccagaccagaccagaccagaccagaccagaccagaccagaccagagcccacacagtgatggacagacagacaacaccttgatatggacacatcttaccctctatttaaaccaaacctccttccagggcttcaaagatggttgtttggggtttggggtcatcatttttctgtgttagatcctcttctcaatgtggccacattgagtgagtctcctttctctgtgtcacatggagtagaaaccattgcaaaagtccctccctgaagccagctctcagaaacggcatttcccagacggtcacaaagcaagctgccctgcatgtcaggggcctacatgggacattgtcattcctgcatggtgaagggtacctctgcctgctcagtggccaaacatctcagcagtcccaaagggtgttctgagttcaccccagcaccacaatcccttcttctgcctgctaccgggctgcgtggaaggcctctctcccatcctcacttcccactcatgacactacccacgccaatctgtctctcaggccctcctcaacccactaaggcactctcaacagcgagtgcaacacactctaacatgactgcccagtcctgactttcgagatctgttgccctggttctgtagctcccacttcaggcaaccccagtcaactattcccctgttgctcttcctggtgttttcccaggggcgatttctgccctttccacttgcagggtatctctgggactctttgaaacacagcagtgcagtaaccgaggcagaactgaccacccacagagatcactcagattgtggacatggtcttcttcatttcctaccctcctctccttggtattgctgagtgccatgcttccttaggccagggagccctcctcttcttccctcagtgaccacatggcttgggacacccacatctcagaatcccactctttgatgcagctacacttcctatttcagcatctaaaagtgactgcccatcagcatggctaaactcactcacatgcttgccccccaaacggagcctacttgcttctctgccccaattgcatgtttctttcatagttgttcaaactggtgaaaacagggtccctggtcccatagctcttcttaccccaagaccagtgaattctcatcaacacaactagacctctgccttagtccctgttttatttctgtgaagagacagcatgactaaggcaactcttacaagaaagtttttaattgggggttggcttacagtttcagaggcttagcctgttctcatcacggcagggagcatggtgctggagcaggattcaagagctacatcctgatacataggcagcacacaaaggcactgggcatggcctgggctctttgaaaccaccaatcccaccgccagtgacacacttcctccagcagggccatgccccctaatccttctgatccttctcaaatagttccactttctgatgactaaagcaccacagactcccttacccatgtgccacctctgcagcttcagggacccatgaaacatgggaagttacagaagtcagagaatcattggtccatttttgactcccagtagctgttgctcagcaatgctctgatgtgaccaggataatggcccctcctctccatccagagtgctgatgggacttccttggtcctcagggcatcatgggaacattccagccttgccctgtgttctgcctcattctttgcctgccctggtgtctctgatctatttgcactctgggcatccaagcatgagcacatgatcataccaaggcatcatggcttgtggacggctggctgtgctccttccccctgggagcagtcctcaggatggtggaagggtctcctccccatgaatcaggaggtctcatgctgtccatggagccttgcaataggaggaagcctgtggacaccttgaagaaggcatggaagattggcatttggaggggactaatgctggagacttcatatatttccacccttgccattcacaagatgtctgcatgcctctctgcagaaatggagacaaaataaagcactcttcaagaccaggccagaactgaatgtggtgggggaactgctctttcctgatatattccaaatgactcatcatgcaaaagaaagggaaaaattttgaaaataaaatatctttaagacccatcatgttctccttctcttggagctgcccttttggtgggttgctgtggaatcttcatttaccatctgcaggtcatttatttcttgtattccttttaattctatccttcactcctttctaaattgaccatttaaaaccaatgtgttttcagtcctctggggctgtcttctggatctgtaacttctgagtctcagatctagctttgaggaggctttgatgggacttctcggggctccttgcagggcactgctccaggctggggtccttgaaattgttattccagggaggagtgtgtcccccaggatttagagattggtgcccagaagatcccaacacctttgaattgcgccaattgatcctgcggatccacaccagcattggaaggcatgacagagagtggggtgggggtgggggttgtccatagggtaggaaatggtggagggagtgtgaagaagaacatctggaagcaacatctggaagaaatggctacttcctgaactcctcagcttcttcctaccaactagctgggcagagaaacagttgtgggaaggtcttgagccatgcctcccctcttgcaggtcctacattatgggaaagccaggagagccaggcttagcagttgttctgagattcaactgggatttgcaacctacagtatggacctccatggagcccatgagaaagcataatctagcggattctcagagtctacgtaattgtggctttgggtgatatctgtgcccattaagtttgggaaacattgggctgtgaagcagaacagatagccatcctcaggatcccaggaggcaatgtggccagcaagggtcagcagttgggcagggactacctaaagtgttcagaattgaaatgtattcttggtggatttgtcctttgatgagtatgaagtgtacttccctatctcttttgattagttttggctgaaagtctattttattagatattaggatatctactccagcttgttccatgggtccatttgcttggaaaactttttttttagccttttactcagagtggagtgtctatcttcgttgctgagttgtgtttcttgtatgcagcaggctgatggatcctgtttatgcatctactctgttagcctatgtcttttcattggaggaatggagagatattaccactgattgttagttcttattattctgatggtggtatttgtgtgtgtgtgtgtgtgtatgtgtgtgtgtgtgtgtgtgtgtgtgtaagagagagggggctctcttcttttggtttgttggcatgaagttattcatttctgtttgcaaacatcttcagaacagaaaatggcggccagtgcaggctctctagctgatgctggtggcagttcaagcctacgtgggatgcatgtgcaggggtgcatactgaaaatggagaggaagagatcctttctcacagaagcatggagtcagatagtgccggcagtggctggaaacaactggcctggggtcagggaagggaggctggctttgaggatggttctgatgggatattgtgcaatgaggccatgcagggaatgaggcaaagctgatgatgggtccttgcccaccttgtccatcttggctccatttggctggagcccatctaaccacatgagaagattcgacctgcagaggtctactgtgccctcgtttcttctccctctctgagagccaggtgttagtgttcaggacccctctgcactgccacctcccctgttgctcttttgctttctggacactgctctcggctttgaccatgacctttgcccttggacctgggagagcaactcggtggcttcggtgatgtgaccatcagtgagtcagtccactgacagctcaaagtctttcctctgcgtccttcaaaacatgaatgttggcgcaggcaaggcagaggaggcctctcatcccagcacgcatgagacttggaacaggaggatctcaagttcagtgccaggctgtataatgggaccttgtctcagaagtcatcaagaaagctaactgggatgatggaagaagggcacatgtgctaatgcagcaaaggagcacctctctataactggagcttcgtggtgacactgggtgtgttgccgatgacgagaagactctcagctatgggaataaagagggcaaatggcaatggaagttgtggatggatgagtttgcctggtgctacccacatacagcgttaagcagcaggtaatagatgcccacccactggatggaggaattgagacaggggacatggaagacatgtacagacctaagcagccagcacaaggtagagccacaactcaggagaacctgaggcctgggaaggtacacgtgccacatccaatgtccctgttcccgcctgccacccatcagagtgtgggttctgccaagcccctttcagtccttttagacactttctgggtctcttcacacaaagcagaattacttcccaagaaatttctgctcaaatcacctcgtgacatttgcagctgttttcaagcaagagcttgatgtccctggggaatgtcgtggccaggagcagccaggttgcaggctactgtgtgaggaccagcagagacttggaacatgagatgacatctgacccaacaaaccagaccaaagcctagccctgccgggaatcgcactgccctaccccccactgcctttgcttttctcttctctcctcttaacttttgttgagacagggtcttgctttcaaattcatgatgcccctgtctcagcctcctccgctcccagcttctgtgtagagtcagttctggtagattctccagtgcaggtccacatctgctggccctgcggagctgtggcagagcttgtaccttaaagagaagggctgagcttaaagtggctctgggtggcagccgaccacccttctactacagccttctgggggctgagtgtctgcttccagcaggaaaacacaggatccaagtgacatctgaagatctgggacactggggtgggatgaactgtggacctcagttcaacagtgaccaggcagtgagactctgtagctcccagctcccctttacctcatcttccctatgtgtttggtgggtgcagtggttgtcgttgctgtattagtaatagcagccaccacatcgtggcctctgctgttagtaatgacagccaccagagcacctctaatagttgtttcaagaactaaataaagcccaggagctgatacaatatgaggaaggaagacccacatggggtttaaaactccatttattatatgtaagtacactgtagctgtcttcagacactccagaagagggagtcagatctcattacatatggttgtgaaccaccatgtggttgctggggtttgaactcaggaccttcggaagagcagtcagtgctcttacccgtggagccatctctccagccctgtttaaaactcctaatgggtaacttctagcaatagccaagttgagacccactgggttggcacaagcaaccttctgacaggaattaattttatttatatatgtgtgtagcgcatccccctttgtccctgtttccctctttccttccctctctatcttcttcctcttcttttccccttcccgtgcacgtgtgtgtgtgtgtgtgtgtgtgtgtgtgtgtgtgtgtgtgtgtgtgtgtgtgtgcaagccctggccatgtgtatggttactgattgctttgcagcccaattgtcccttgaatacctgtttcttttccatagatgggaaaagtggtgcccatatctcagggtgtgggcaacaggtagaaggctactttgaaagttgtcatggtgcttctccagccctgggtatgctctgctctgcctgccttctcattccagtcttggggttttcttttgtttctttccaggattgagaagggggacgtgagtgaagaggaagacttccgccttgcctgccgccacgagagatacccgacccgtaagtgccacgtggtggacagggagctgtagcagcagtctcctcccgacacacaccacacatgggaagcctggcagctccgggcctggcctgacatccccagtggcctttgagatcagccctgggtgggatccaccgaggcagggagaaaaacattggacagattagcttaggggctccgagcacattcacttcaccagcctcactctgacggacacattaggaaggatgcggggcagccaggagaacaagtgtcagctccagacgacaaagggaggcagagctgagtgttcctcacatcagataggagctgccaaagacagcaggtgaggcagtcacatctgcagtgagcagctttcccttgccagctcccattgcatatgtgtgctttaccaagcttgccacgatccctaacttactaactacccacaggcaggaagcttagcaggtaagtgacttaagctcagagaggtagagacttgccccaggtcacacataccttgctagttagcacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacaaatacatactcacatacactcacacacatatacactatctcttttacactcatacacacactctcatacacactcacatatgcacacacacacacacacacacacacacacacacactcacaatgacaataacaggctgtatccactgaacttcatcttgcttaggggacccagacatcataagctggaatggacttgggactcaaggaagaggtgagcaattggttctagctgagaacatcagggcagtgacacaggcctgatactgtctcagctacgacaggaatttctcaggtcactggtggtggctaccagagtatggagccatgctgttgctagctggcactcagcaggtatgcccacccccgccatgatcattagagcaagagcagggagagaggagccttggggtcacacagaacttctgcaggagccttcaaaggtgtgtgtcaccatcaatagaagagtttggtaagaagtcttgtggctttgctggtgttgagtctgggggctgtgggggcatctctgaggtagaaggtggatggagggagagcacaggcccactggagggatatgaacttcatggctggtgctgagacactacaagatcatctctggagaagggcacgtgcagggatctgtgcccaaaggctacaaagagtgagtagggaaggctttctccattctggcttcacaggagagaaaagagtctcagttcccaagcatctctgttcagtgtcctccattagggcagacagtagagatggccatgctcctggggcttgtggggaccaccaggagtcctgaggatggatgcctgtgtcaaagcagggatttgcttctctaaagaagtcatttctatgatgcatgtgagacattcacttgttcccttacgtatccatccacccacccattacccaatccatccatccatccatccatccatccatccatccatccatccatctctccatccatccatccatctctccatccatccatccatccatccatccatccatccatctatccatctatccatccacacacccatctatctatctatccacccactcatccatccatctatccatccacccacccatcacccatccatccacccatccatttatccatccatccatccatccatccatccatccatccatccatccactctcttatttaatcactcactcatttatccctactcataggctcctctgggccctagaagtctgtaagacagcaaggcccattctgttgctgcacagtgtgtcaagagccatggtggagtccccactagccagagaaatcagggtgtggcaccttatctagggcacagtgcaggggcttgagaagatgagctctttcattcactgagtcaattcagcccggtggacaacagaacaaagaatcctaggaggccaagaatagctctggccagacatggtggcacattcctgtcatcccagtattcacaggccaaggtaggaagatcataagtttgaggcccgcctggactgcatggtgagaccttgtctcagcaaaccaaaagactgggcttacccaatatcatatagtcaggcagtaacagaggggatgaaggctcagtagtgtggaggaactgtccgtgtggacccatctctccaggctgggtcccgaggatgggaacccagcaagagtagagtgctaacagcctagagaagcagccggtccccagaacccggcctcttagcggctgtggggttgctgcccagaaaatattttggaatcgcttgggcgagttttgcaatatttcctcatgaagcagctgctcagatcctgccgggcacagcttgccggcaggaggcatgggggaggagggtgtcagggagccacattattaaacacttgctgtgtgcgctcagcaaagctcctgcctgctagctctttgatgactgatccggacgtaagaaggaagaattactaggcaactttgctgagcagagagacctcacataatccagtctgcgatgaaacccagctcggcactggagatgtttctgttcaccgagggctccagcttatgccccaggaccccggcctcaccatcctcctcccttttgccaccttaggcagcagctgcaccatgtttaagctctttcacttcctaggacctttgtacttgctagatgctctccctctaaagcttcgtgtggttcgctttgtctcctaagctgtggactagtttcccaggtgccaggttctttccttcccagcatctgactctccccgactcaccctgcttcccatttctctcatctctctgataaacaccttgtccatcttgtccatgtctctagcccaagcacccagttcagcaagtaccacgcagttggtgctcagcgcttgccactgcacctcggagcatctcccacaacttcctcccagagcagctagtctgacaagaagagttatataaactttctttcacttctaactactgccaaagttgctatttctcccttggtccttctatgatttgattctgccacagtttcttgctctgctctgcagtgccaccagctagtttgggagcacatcagatgtgacatttgatggaattgatgctgccatccgatctgggtatctgtgtcatcctctggggtgactggggtttgcagcgcacggctcctgtcaagtctgatgccttggacaagcctttgatttgccaggtgtgtcgtgaggcagggctctgcaagagcctgtcattgtcaggacacagaggcagcttgtgggagctctgtcaagatgggctttggccatagctgtcccccagaacagcacaacgaattttaaggaagactttctgtgggcctagagcaacttggcattttgattagatcaaaatcaaattcaatagaacactgcgagagttgtttctgttattaaaatggaagcagaccagaccatattttcaaaataaatatcaaggccaatttcctggactcagacaggcacgcagcttgaggacatctgagaccctgccatctggaggtcaggggtcccagctggagttagtgctgctgtgctggggtggagagtcgaatggagaatgatcccggttcaagctaggtttcttctgtattttgctttgaggtagaatttcactatgtagcccaggctggcctcaaacttgtcattttcctgtctccaccacctggattgggatggcaggtatgtggctatgttcccagcaggcttctgtatttaaaatgggctgcctgtgcccttggggcccactggtcgcagagccagttcagagtggctcctgcctgctgcagtctgcttggtcatagactgggaggacattgctgtgtctagggccaatctccctgacccatctttttgagatacaagcctgactccattttcccagctcagagccaggcccctccccacctggggcatgggtggcatcccccaggggcctcttcccatggctcctgcctgctgctcactctttgacctccaggctagcttgttcattccactctcttcccaccagagtgttgatattaccagcacaggagcctgctgtcgttcagtggtcgttgtgtatcccccatacaacagtgagtcccccacaaggtagtgccatgcgtccacacagtaggtccccatgaaattctgatatcaatttggtccctatgaggtcatcagcattctttctgtcttgtagcaaaggaaccggctcttgggactgtcacttggcccaggttacaggcctgctcaactctattcatgccgatgcttttctgtttgtctgatttttgatccaaggcagtagtattccagtcatgcccgttgctaagaaacacttggggactctcattaaaatataggttgctgcaaggcagggtaacccatgcctgtaagccaagcacagatgagaggcagaaggattacaagtttgagggcattctgggtgacatagttgagatgtgggggatccaggcttgtaaagtatgatggcgtgtcttattacagactcctaaagccttaaggataggatgagtggtcctctgaacctggtgcagccctggattccctctgcaaccatgtgtgttgcttaccttcctccaatgacaagattgctgggcattcacacctcctaaaagcttcccagggctgccaagaatctatttcacacctcgttccttctgcctgaaatgacccatccctgccctctaacaaggcagtaaacagattgcaatagaacctggagctattgcagagtccagctgcagagtctgggaatggctgctaccacccggtgtcctgcatcgagagcggcgcatgtctccatacgctactgtctggggctgtgaggttgaaggtgaggatatgttaggtttccatgtctgtgacaaaacacttcacagaaacaacctaaggaaggaagggtcgattcaggctcacactttgagaggattcaatccatgtttgcttggccccattgctgtgagccttggtgaggcagaacatcatgggggggggagggggggaagttgttcctttcggtggccagacagcagaaatcatatggggctaggccaacatgcccttgaatggttcgtgccagtgacccatttcattcaagccggctccacctttccaggtttaccccgcgctatagttgtacagatttatatttcatcagtgaattaactagatccattaggtcagagccctggtgatgtaatggttctggaaccccctccatccctccccaccccccaggcaccctgatctcctaggcatctctcagtctagtgcactggcaattaagatgtcatagtgcttgtgagactagagtttcgggttcacatcccaatggagacaccttgggtaaattacttctcccaggtgaggcctcggtccctcagctatggacaagttcagcagcaggcagctcctgccttactgagtgcagatgacaagagttggtttcaggtgactgggacagctgtagtagcgctgctgtcatcactcacagtcgtgcctgtctctgtcccctccctggaagcatctagaaggcagacagtgttttccacgtgtataacccagcagtcattatgatgggggacatgcttgatccaagggcttggtggttctggggaagatgcatcaggtagacttaagtatgaggaagagaccagggtcagggaaggttcagaggcccagggtctcaggcagagcagataaagccaccctcctcagactgcatcctctccttctcaggtgggttcacttaagcctggtccttgtctccagcccatatcacgtattcatttgacagacatataccatcagcatggggccagtggctgggagcctgctgtggatcccagcagagctggcctctgtcctagtgcatctgaaggccctcctgctgcgtagaggtgtatggagaattaggagccacactgatgttgggccatctagagcattgtagtgtcacagacggaccgggccctttggctagagctgggcagatattatgcgtgttcatggtttgatatctatttcaaaaaaaaaaaaaaaaaaaggtctgggtgtgatggggcaggcctgtaacccaacactcaggaggctgaggcaggaggatcataaggttgaagctggcctctcagcacagtgagaccctgtctcaaaagcaaacaataaggaagacaattgaaagtaatgaaaaatcatctttctagagccttgcacacatcaaggctctctaagcttaggggagggagggtctaaggggaaattaaagctccatgttacccgccctcccaggggggcttgagccaatttctttccgactatgaacctgtgtttccccatctgtggagagaggtgctgagcccagtcctattgaacatttgcactttgttattttgtcattgtccagagaccaggtgctaaggggcctcagggcaggggccagctgggctttctgactcctgacctctatctgctcaggctcaaagaggtgaggctgcctgacaaaagccacacagctttaaactcgtgcatggggccaagaggatggctcagctggcaaagtactcgccatataaacataacgcctacggtgggtacccagcaccctggttaaaaaaaaaaaaaagaaaactccacatctggggtgtgcttgtgaactcagtactgggcaaggactggagaaaaaactctggactcactggctgccagtgtagaactggtgagctccaagctccatgagagacacacatgcccacactcaagtatgtacactcacatataacacacacatacacacgggcacacacatacacacacacacacacacacacacatacactcatgtttctgtacccacccacccacacacatctcccacatgtgaatacacatgtacacatacttcccacacacatctcccacatgtgaatacacatacacatgcacccttccacacacacgtcacatagcttgtgtgtgacagagcacagagttgaatcgaagtatagttttacccccttagccattgccagaagacggaggtggaggacagctgtactgtacacacaggtaggatagagtggtgggagatcaccccaagtttagcagcctccattacctcttcttggcttcatttcttaagaaaatagcagcttaggacttgcttggaccaggcaaagtggagtgggctatgggctcccatctgggcatgcagatggtcccaccccaggtaagttgctctgaaggcaggagctccgggatgggggcaggatcagggagagttcactgtttcccaggagagtacaggaaagatgggggtggggagtagtgggtaggatagagttacctcagagggtatttctagctgggggacagggtatgtgaactacaggacagagtccacaaagacaggctggaaaacagtcaggcagcacaggtggcctcccttgggtcaagtcaggctttgtggcctatactgtcgctgaacatattttacaaactgcagttctcattaattaaagctggatggttttattttgaaaccccagatttcagtgtctttgaaccttctggaagatctgaactcaggttccctgtggtaaatgtcggttggcggggagcaggctggttctgtccccacttgtgacatgtgcagggctgagctggatcctgaatccgagcacaaggcctctctggctgatgacggcctccatgaagaggccaggagagaaggtggtgggtggagggccttatggggctgatgggacataattccaagggacctcagacctgaataccttctaggagggggggagccccagtctgtgaagggagccccagtctgaccccagagcaaggggtcagaaagcctcattttatctctaggagtaagatatattctgcctgattatccttaacacacacgcactcatgcacacacacacacacacacacacacacacactttctctgttcctttttgcagttttgcctactggctcctgtgagagcaactacagtcatttctaaatattcatttagaaaaataagtcaaacctttctatgcaccaaatatttgcttctcattaaggggaggggggactcaaacacctttatttcagcaacaagctcatccaaagactgcaactgttttggtagccggggccaaaacaaatgttcctcccccaaggccaaatgattccagaatgtttgcaaaatgtttttcattcctttaaaaatacagcaaaatgtacaaagcactaccattaaagaatattaaaaacagaaggggagaaaagccaaaagaacaaaatgacacacatcttgtgcatctcccaacttctgcatccagtgagccgttcttagtggctggtcccatggggacagaggggcagtgagctctctgtcatgagaggtatgcaagtgccagtggtatgctcagaatctcatcctgaggggttctctctgagctgtctgaccctaacggatgtcgtagtcactggagctcagagtacaatgtctctcggtggagaaggttggaatcaggaagtgttgacccacctagctccgtgtggctgccatgctggcccagctgctgatctgtggttggcctctgcccttcttgtgttatagggagacagtattttggtctggcaggtgagacaggcaggctccccatcaggaggtggtacgcactaagtctagaaagctccactggacagcaagtgttgggacacttaaagtggtccccaacgagtgacaggattggtttaggcatatcagagaaactttgaggatacctgagggaagatggggtagatccaagaactaatggggtacaggagggagagtgtgggacagggagggcctttatgttctcagcttgccaggtctcttaagagcagggcagtgggcagtgttgggtggggacaacatactcaaggtcaccttgggttcactgatacatactcactattgggatggggcataaaacctaggtgcgtgaggagcctggctctgaggtggatggaaaggctaagagatggtagggtgaggggctggtaagtgggggagagaggactcagtaaatctgctgggagaactgttgaaggggatcttaagggatgttgattagggtgagtgactagggatgggtggtcagtctgatatgtgctattgagcctgtgggcacacacacacacacacacacacacacacacacacacgtaggtgggcagacaaggcagtgaacttgtctgttggtgggtaagtgcaagcattagagcctagattacaggcagataggtaggtaggaagagggctggtgggcatgaagtggagtggaatggggtgatggtctgtggggaatggggggtgggtgtgtgggaggggcatgagtgggtttgggttgtgggcgagtgggctggcactgagcactggctgcatttccatatgctggtgagtccgtgggacagtggtttgacaggagcaggtaaaagcaagctgaggctgggccagaggtcaa

SEQ ID NO: 998 - DNA, 552 bp, Mus musculus
gtgagaaatgtcgcagcttcattgacctggctccagcgtcagagaaaggggtgctgtggctgtcggtggtctctgaggtgctctacatccttctgctggtggtcggcttcagtctcatgtgtcttgagctcgtccactccagcagcgtcatagacgggctgaagctcaatgcctttgctgcggtcttcacggtgctctcaggtctcctgggaatggtcgcacacatgatgtacacacaggtgttccaggtcaccgtgagccttggtcctgaagactggagacctcattcctgggactatgggtggtccttctgcttggcctggggttcatttacctgctgcatggcggcatctgtcactacactcaactcctataccaagacagtcattgagttccggcataagcgcaaggtctttgagcaaggataccgggaggagccgacgttcatagatcctgaggccatcaaatacttccgggagaggattgagaagggggacgtgagtgaagaggaagacttccgccttgcctgccgccacgagagatacccgaccc

SEQ ID NO: 999 - protein, 184 aa, Mus musculus
  VARIANT (1)...(184): Xaa = Any Amino Acid
EKCRSFIDLAPASEKGVLWLSVVSEVLYILLLVVGFSLMCLELVHSSSVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERIEKGDVSEEEDFRLACRHERYPTX

SEQ ID NO: 1000 - DNA, 256493 bp, Homo sapiens
  misc_feature (1)...(256493): n = A,T,C or G
ttgtaataatccccacatttcaagggcggggccaggtggagataattgagtcctggaggcggtttcctcatactgttctcatggtggtgaataagtctcatgagagctgatggttttataaaggggagttcccctgcacacaccctcttgcctgctgccatgtaagatgtgactttgctcctccattgccttccaccatgattgtgaggcctccccagccatgtggaactgtgagtccattaaacctctttcccatataattacccagtctcgggtatgtctttattagccgtgtgagaacagattaatacaccatgctgtaccctctgtcccatcagcagtctcccctttgacagtatcatctgtcacagtcacaataaggtcctgaaaacactttaccagttccgccgtgtctgtgcctctgtttcctcatctgtcaaagaagactggaatcatacctgcctcacagggttgcttgtagatgtaatgagttaatgtgcgtgagtctgcttacaacagtgcccaacacataatcaggattttttttttcttttgagacaaggtctggctctatcgcccaggctagagtgcagtggcacaatctcgtctcactgcaacctcctcctccagggctccagcgattctctcagctcagcctcctgagtagctgggaccaccatgcaccaccatgcctgtctaacttttttttgtactttttgtgaagatggggtttgtccatattgcccagtctggtcttgagctcctgacctcaagtgatccacccacctcggcctcccaaagtgatgggattacaggcgtgagtcactgtgcctggtccagaatcaggactttctattgttgtttattattattatttataaattactcctaaaaatatgactttcctagaagattcttcaatgacactttgttttgagatggggggtgaccatgagggtgactcaaaacagctgttgagcctgaagatgagtttcattattttcttttatgataagacaaatgctttcatttactgatgtcttcttcgggtgacatgtgactgtcagctacttgtccccctccaaagaaagcacaggatccgccccttcaaggagaaggtgatttttaaacaatgaatgagaatgtgagtgctttttgagagatactcacgttttggaaagagcattttgaaagcagatgtttggaaatgtttccattgttatcagcttttattgccaaaaagcaaagaaagtgtgtttccttttaaaacctccccacgtctgcacacttgaagaactgggaaacagaaaattctagccaatttcaaaatctttcaaaagaaaacttttaggaagttttgaatccatttattacaaatctgcaaataccaattttctgaattcttttcaagatgaaatgagggctatccaggaagatggatgtatacagtactagtcaatttcaccaaaaaatagttccctatttggtgaatgggattaaaatacgagtattgatattaatatttagaaagcacagcatatggcacttcttccatttgaatttacaaatctttgtgaggtatcgtttgcagctctaatagccactcaaaccaagtatggacatcactctccacagaacgagattctcatgtcaccacagcacgtaccgtgctttccaaacctaagctttccaaaaaataaaaaagattcaattgcattgctatcaggaaaagaacatttggaatgctcaaatgaaagccaaaaggtgagttttactgttagcaagtaaaataaaaatatttcaaagtagtgtttatttaatcttcatgtcctccgttaagaattcctagtttttatacaggttgagcatccaaaatttgaaaagccaaaacctaaaatgctccaaaatccaaaacattttgagtgctgatatgatgttcaacagaaatgctcactggagcattttgaggccgaggtgggcagatcccttgaggtcaggagttgtcaccagcctggccaacatggtgaaaccccgtctctgccaaaaatacaaagattagctaggcatggtggcactcgcctatagtcccagctactcgggaggctgaggcaggagaatcgcttgaactcaggggtcggaggttgcagtgagctgagattgagccactgcactccagcctgggtgacagagtgagactctgtctcaaaacaataacaacaacaaaacaacaacaacaacaacaacatatttcagatttccggatttgggatgcttaactggtaagtacaaagtggatattccaaaatctgaagaagttagaaatcggaaaaagtccaaaatctgacacacatctggtcccaagctctttggaataagggatattttatgctttatgtacagctcgtaatatgttagtgcatcattgtgtaattcataaatgttcctgcccagttggagatctctgctcttagtcgtttcattaaatcccaagtccctcacctgggcagttttcgtgtcttggtggtggatggatgagtgtggaggggacgctcttactggtccaggggatcaagactggcggtcccactcttggcccctaggaggcagcagagggaagcaaaacaacagctttgaaacctactctaggaaaacagccccataagggctggtgcaggagacaccttataatgtctcctttctccccaaccttcctcgttctccctcctcaggaatggagtaaaataaaccatctgcagcccctgaggaccgagaaaaatcccattgagcgtggggaatacggaagggagtcactgacccccaaggctcattttgagcggtggggctttaacctgaacactgcatttatccgaagatgacacagagctggcccacgacaggtagaggggaccccgggtggtcctggactctggccactgtcctgctacttcttgagctgtttctccagctgagatctagtaagaattccataagggtcgatttaattgtatccctttggctaaagcgcatggtatacagtcggtgccaaatcaatgtgtgcagtctctgacctgaggagtaactcttcctcatctcatttgttactgctctatcccacccaaacctatctgtgacctgtcacgcatttcctttctgccctgggtgttggagtcagggccagtttgcgggctgctgtgtccctgcctctgagagcattttctggcagatgtactaaagctcttgtgtggcgggttttggcttgattcttcgagaacgcagctggggaacaagtgtgaggttccttctcatggctcagagcagacttcagtacttggcatggactatgcgtgagcctcctaacacatccccacgatgcctcacctcccatccaaccgaccgcgggtccccagagccgccttccagaaacgcagcgtcgtgcgcctgctccagccgtcgctggatcctcatggctggcggagtgagatcaaagctcctgggccggtcttgaaggccctgggataggagtgccccccaaccgtcagccctccaagacacttctgtctacgtgccccacgcttctgtcacgtaggcttggtgcaattgatggagcctctctgagcagcgtcagtttcctcatctataaaatggacacgactaaccccttgaggattgagaatgacgagagatgggcgaccatgtgtggaaatgcgttcctgtgctgagacactccacacatattggtgtccttttcccgccctcatttcacagacgaggaaactgaggctctgagcgagagattgggaacagatccaaaaacacgcagcccagatgcagcagagccaggattaacactcagaccttcccagttatctctaaaaattaattactttttaattttataattgacacataataattgctacatatttctggggtgcagtgtaatgtttcagtgtccatgcatatattatataacaatccctcatcagtgagggtcccccagtagatcttttctttgttctcctgcacagattaccatctatgcatttggggaatttatcacccacttccctgtttattattattatcattaaagacaaggtctcgccttgtcatccaagctggagtgcagtggctcaatcatagctcactgcaacctccacctcccaggctcaagtgagccttccacctcagcctcccgagtagctgggatgacaggcacgtgccaccataaccggctaactttttttgtatattttgtagagacgggggtctcactgtgttgctcgatgatcttgaactcctgggctcaagtcatccacctgtcttggccgcccaaattgtcaggatgacaggtgtgagccaccacgcccagccccttgtttattgttgtctccccttctagaaggtaagccccatgaaggcatagacctggcctgtcttgttcactgaatgcccagcacagagcaggaggctgataaacacttcctgaatagacaagggctacaacagtttccaagaacacacaggtagccccagctgatcactttctaatgaagctggttcctttcacctccggagaatctaccccctgggatgtctttgattgcacagagcttgagggccttcccttccctgggaacagtggccctgaaccacgaacagcctggtaagcataccagcactgtgaggctggctttccccagaaacccggagtgacgggttaaccaggggagtgaagtgggcattaggcttgcataccttgggagtcgatgtttaaaaaacttccctgataattggaaattggctaatctcttgctataattaggagaggctggaggctggggatgttctgttttcccaagctctgttttgaaggtgtagaaaccaggaagtgacttaggaagcccagaagctaacaaatgaccgtagccacggactccaaggaaacatgaaatgcattggggacacatcccttcaaggcagattcatgtttcctgaaaagtatgaatttcattattaatagcaacaggttttctggtaaattttgttgagtataaaaacacgagccaggggcacaccaccacacctggctaatttaaaaatttttatagagataggatttaatttttttgccctgctggtctccaattcctggcctcaagcaatccttctgcctcagcttcctaaagtcctggtattataggtgggagccatctcgcctggcctgggagtctagattcttatgtgaactctcatgattctggaatgttggcaactgataaaaatttaacactctgtagaggccagttccatccaggccaaacaaaataagcttaagggccagatttggtctgcaggtgccatgtggggtgagctggaggggctcccaggcacgtgggggagacaggtgtgaaaacagacatcatggttcagagtgattcatgatattgaagatcagaggagggatgactggctgccaggacgtgggataggggtcagggaggattctacggcggcatgaggcttacaacagcaccctgaaagacgcacagaggaaggagagcaaggattttccatggagaggaaggaatgtgtgtgaaggcctgggttcagtttgagcaccaggtggtctgacgccgcacggtggtttggtgcagctgtggcagtgcaggggcggcaaaggggctggagacgtggacaggagctagtcactaggacctggaagagcgaactcagtcattgagcctttttgtcctgcagggcaggcggtgggagcatttggggggggtttggcggaggtgtgtggggctggtctctctggaggcaggtgcagggttggggtggctgagggacagcatggagacaggaggctgcagtgaggccttggcctgtggcagtgagccagagaggagggagccagggacttaggctcacatttctggcctcctaaacaaatcccattacctctccctgcaaccgcttccctctacgcccaaggtaattccaactatatcactatttgggataaaaatccctgtggtgatccaagggttttgctgatgagtttggattcacttcgaaggttgtgtagacatctgaagtggtccctccaagggtgtaatctccatccactgtcttcagctcatgggaaaggcccagtacaaactcagccagaattttggattttccctgtgccccacaggtctgcttctgactcagccaatagcaactccatccctgcgggaactcctgccgaacacatcggagtcatacttccccgtgttctatcgtgggcaaatcctgctggatctgcctttatttcactttcttttttttagagacagggtctcactctgtcacccgggctggagtgctgtggttcgatcatagctccttgcagcctttaacctgcccggctcaagcgatcctcctgcctcagcctcccaagtagctgagactacaggcacacacctccacatccaactcatttttaattttcttttgtagagatagggtctcactctgttgcccaggctgctcttgaactcctggactcaagtgacccttcctcctcggcttcccaaagtgctgagatgaaaggcgtgagccaccgcacctggcctggagctgcctttaaagctgacccagaacctccaccatgcctgtccccacactggtctgagtccctggcctcatgcactggaatccacacaccagcctgtctggtctctctgcttccacccttcttcccatagcagcacgtgcggtcctgttagacacgaaaccagacatgggtcccctctgcccagaccctccgccggcatgaatatcttgctcagagtgaatacctgagtccttgtgtggtctctgcattcctgtgtgatctgtcccctcctctagcacctcccgccccctttttttcctcctctgccctttgctcactcagctgcagccacactgtgctctcagtttttccccaaagggccagacaggctcctgcctcgaggcttttgcactggccatccctctgcctggaacttccattcccccggatgtcttcatggcttgcccctacatctccttcaaatccttgctccaatgtccccttctcagtgaggccctccttgaagccatccccactttgatccctccctgctgaattgctctccctggctttcacccctgcatactctgcagtgttctttctttttttctttttgagacaaagtctcgctctctcgctcaaggctggagtgcagtggcacgatctcagctcactgcaacctctgcccccgggtttcaagggattctcctgcctcagcctcctgagtagctggaattacagttgtgcgccaccacaccaggctaatttttgtatttttagtagagacagggtttcgccatgttggccaggctggtcttgaactcttgacctcaggttatctgcccgcctcggcctctcaaagttctgagtgatgttctttcttacgaactttgttcaccttctcttttcttcccagtgctgagcattcagtgggtggctcagtgagtggaggagcatcttagatggaaattccaaatccctctgtgcatcctcaggtgtttcttgagagagtgtggtccctgagacatatctcacctgggctctcctggctttgaacatgcaggacagggttcccagctgtaggtcaccgagccctgctcacatgcacaccaaccacagcctcgagtccaaagaagtaccctgtttagcacacatcgaggggctggttttcattggtacacagacactcatgatgaatactgcatgcccgtttaaaagtgctactggaggctgggtgcggtggctcatgcctgtaatcccagcactttgggaggccgaggcgggcagatcacttgaggtcaggagttcgagacaagcctgaccaacacggtgaaaccccgtctctgctaaaaatatgaaaaatagccgggcgtggtggcaagcgcctgtaataccagctactcgggaggctgaagtatgagaatcgcttgaacccagaaggcggaggttgcagtgagctgagattgcaccactgcactccagcctgggcgacagagtgagactccatctcaaaaaaaaaaaaaaaaaaaagatgctactggattctttacagctgtttggcgatgatgtattttctctgtcaaccaatactctcaatgccaccattatcacatggaggtcctctctttcaaaatagttgagaatctcttgcacagtgccagaaaagggctctaaaagcaagtttggagacccttggccatccttcgtgcctgctcttaccagggacgttgcccacaacgctttcctctcacctaccccccggcagattagcagcagctgacagtgggtgccggctcacccacaggagtaaggcaattcataatcggttaaccttgaattctgcaaggcctgccactcggcaagccgggggttgtcggagcagttctcagcttgggcagaattcaaatgagctcttataatcaacatgcaattaattgttgcacgccctgagcatctgggcagtaagtgctgtgcagcgcgaagggagttcagggagcgtggtcatcttagagcagaggtggggacggggttgcacacagtttccacgttgcacaggagagcctgaagaggtttgtctgagtttggtcaactgatcttggttcagatgtcagtaacagtgaattattaattgagtctactgtgtgccaaatgctttttgcagccatgatctcattacagcagcccactgtgatataccttgaaggggggggggtcctcccttttttatagttatggaaattgaggctcagagagggtaagtgacctgttcaaagccacacagctggtcaagccctagatatgcttgatcccaaagtcagtatgtttgaccaccctgcccccacccgaatcttgaagattctacccacattcacatggtgtgcatgtgagcagggttggcagcccctgtagggcaccactgcctggtagctgcaataactttgtggccggcatgggcccttctagggttctgctgtttgggatctcaggtgggtgcagtgggctgtctggggtaccctgttgccactcttcctgcagttgcatgccatggttgggagcccagatgacagtttcatccttggaggggagctcttcccagatgctggaggtgacacccaggagacagaaaaacgtttcaaaccctataacccaatactccaggaggggcgcctcctgacagattctgccactccaagtccagcatgggttgtcttatccagggggtcttgcagctccctggctgtgggaagccctgcaggctctgctgtttagaacctttggaaaaactcctttctcagggtctggtgcgggggtccttttggggatccccttctgggacagggtcctgctggtccgtgtccctcttggggagccccagcaggctctgcccttgtctcctggggcagggcctctctgggtctcatgagatgcccgctcccggcgggttttgttgccccacgtccgccgtggggatcttttctcaggagcgccttgcctgggattctccttgcgtctcagaccctcaccctggctcggatttctttcgggggcgtccctccactcccaggcccccgcccgcgcccggcgtggcggccccctctccccgtgcgggcgggctccggaacagtgtcgccggccgcctgcaggtgtctccccacggaggggcgcgcgtccctgcgccgtggccgctgccaggcgccagcggctcctagccgaggtgcactcgcgctccgggctccgggcgcgccgtagccgctcctccaccgccgcccgccccgccagcccgccccgcacgccccccgcgccgcgcccccaccccggggttggggggggcatgggcccgcgccgcgtccgccgccgccgatctcaggcacccgagccccggggcgcggcgggcagcggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactggtgccagggcacgcagcgggtccccaagccgggctgcggccagggcgggcgcgccaactgccccaactcgggcgccaacgccacggccaacggcaccgccgcccccgccgccgccgccgccgccgccaccgcctcggggaacggcccccctggcggcgcgctctacagctgggagaccggcgacgaccgcttcctcttcaggaatttccacaccggcatctggtactcgtgcgaggaggagctcagcgggcttggtgagtgcgcgcgggcggcggccagctcggctccggctcccccggggcggcgcggccatcgaggcccgagccccggacccgttcgccctcctcccgccgcctgggcccagctcccagcgctccgcctggctaggggcgacgttccggggcagggggcgcgcgccgttccggggccggggtaccagcatggggggacgtgcgggacgccccgccgtggagaggtgcaaggcagagctcctacccgctgcggacgccccgcggctttggggacgctcccgcgccccgggaaggcgcccacccccgctgccggtcggaggggcgcgcgctgctttccgctcctgaactcatctccacgctcgccccctcctcctcttcctttcgcggggcactagatgcccccacccaccccggaacgcccctgggggtgggggtgatgcagggactcctgctaccagccgcccctcctgccgcagatccacagacccgggagccttccacccccatcgccaacccacgccgaacctcccagacgggagtggggagtgggggagtcccgcgggctcccggaaagccgcacccgcccagaggcacccctattgccagacgccagggagccctctgtatcctggccccctcctgggagaggcaggctagggaactggggacagctgggcaaactccgggtcgaggagtccaggagggcttagcttagcacaaggctcctattaggttcggtgggggactgacttttcagaaggcagatcagactgtcccctttgcctggaccccctcctctaccctccagaggcagcctgggctggagtgcgtgttttggaggcagacagccgggctgtggcagggcccaggggacagctgccggacagctggttgtgccacacagcaggtagagctggcccgaaagacgtggtatctctgagcgggtgtccaggcatggacaccctcctcagtgaattgacctctttctccaaggttaaaactcctccctgcatgcctagctcctcagtgtggacaccacacatatgtgtgtgctcaagggtgggttacagcagacctccacccttagtttgccctaaataagccagtggcctaagtggtttagagggcagagggaggaagctgtgaagcgaacccagtgaaaagctccaggcctctgcacaggctgcatcctctgtctggaatgcccttccccgccccacctccttcttcaggggctcctttcactgggactctcccacctgccttccatgtcaggatactgaggagggacaaccttgtgagctccccgttggagggagggtctccatctttggatctcaccactgcgtttatctccctgccacacttggcactccctgacattttctggggcctgtttttggtcactagcttatagtacccactccccataggatgtcactctgtgagggccagcccggttggtcttgttcactgctgcctcccagtaatgtctagcgcatagtaggtcttcaataaacatttgccgggtgcatactggatggggttgggatgatgaaccggaggcttcctgcggtgctgcctcctctgtctctcttctgggggtggctgaccaaacttttctgtgacttgagccaggctggccgtttgtcagagatacatggtgtttgaatatggacctgcccctgattggtttcatcccatcagacccacttctggtttacactcaagactcaaatgtttactgtgggatgcaattaaaattattaacttcaaaaggcatcttggccaaaattccctgccttccgcacagcccaaccctaatctctcacacggaggcctcgtaacaccttgttgtcaggaacatcttcgtccttggaggtagacatcttgctactgtacatctttctccaagttcaagaaggtgtttccaaggctcaggagacccagccctggggagataccacctctgcctcccttcctctgtgcacacacctgaaaatacaatgaggcatctctggcaccggagtggtcctgtctctacctctgtggagtgtcctggtccaagctgctcagctgagcctcttaattgtttggagtctctgttggctgctccctgaaggtcacggtcccagtacttgctacaattatttccctgtagttctttcagggcttgacttgggatatttaagtattttaaaaaattattaattgaaaattatttaaaaaacaatgttggctaacatttattgagcctttaacgttcaccaggtcctgctgaaacttctcatctcctgaatcttgttgaatcctggccgccacctttgaggcagacacttctagggtacttgctttttcagatgaggaacttaggctcacaggggattctggcaagggagctggaattaccttctcgggaacagaaagaaatcagagtgaagggatcgtggaagagaatagtacagttgaggggtcagggaagttggcattttgggggactcagttaagaccctcactcccaaaactcagttagaaatgcggatggttagtttgttgcataaataaaagaaacccccagtttcctcttggccactgtgggctggagatcatccctcccccaaaatcacaattttcctctctgagagcttggaaaatagttatcagcttgtcagtgctggtgagaaatttgggaatcggagccagctggggtggtttctgcagctgatcctacagtgccaaaatcctgccttctccaccacggtggtcctgaaagggtgatagcaagtacctggcctcaaacttttgttgccatgacaacctttcctctgggttctgtgactattttatttttttactcgaagaggaaaaaaacatcccaatagccccctgaacaaaatctcgcctcccccacccctatacatcaaggctaaacttccctcccttccatcaaactacagcaaagctttctttccttctgtgtgtttcacgtgcatccaaatgcgaacaccaaccaggagatcctcaccgctccgtgagaaggagctgctaaatgttccctcctctccaacgcctgtttgcctgttcggccattcctttctaggctcagaaaaacctctccccactcgggcagccacagggaaatgtaataagccctttttcccacactaaaaatctacagtgttcacaaagaaaactgcagcctgccctaaacagacacactttcaccagaccctgcacaaagaaaccttttctccttgctccaagaagagcacccgcgtccttccacaaacagaaagggaagcgtggcctcgacacagagtcaccccaagcccttcacacaaattggatttctcttctggttgagacgctggggaggggtttggtggggagcagaagcaagcatcgttctagtcagtgtggtgggggtggctgaggagaggcctggaggaggggagaatgaaggtctgggttaggggcgatggtggggcaggtgggagcttgtgccagctgggagcacaggtgacgtccacatgcgttggacttcatcctgtatgcttttgagccgcaggaaaggggtggcttgggaagattggggggaggtggaggggtcttgggggacttgccaggctggcaggagggaggtgagactggagagagaagagagagaccagtcccagggctgggtggtgacggggtgggtgtgaagccagaagacccatgcaggacccaggcggggagccaacacaccccacaccgcggtggcccctcccacagtcccagagacgttggggtaggaaggagcatgtttccttcaaactcaaaaactctctcccctgtagaactggtggaagttcaaggctgggctcagcctcttactagcagcgtggtttcaggcaggaaactcccagggctactgtgtaggtggggatcagagcagctagcacccgccggagatgcaaggatttggtgacgtagggcagggagtggggagcaccacctcggtgttgccgccaccctgggctgagccacccacagccacccgtgtctcccatggacttctgcagccatctctccgcctctgccatcacccccactccccagttcatcctgcacccagcatccgagtcatcgttagatgtggggcacagcacctctgactgccctcctgtcattcagagtcaagtctccagctagccttccctgtacctgtcttgtcttcctttattttgaacagagaaccccagctcttctgcccagtcccctaaattatgctgctacagtgtcacaagtatgaggacccctgtgatgtccccaaccgggaggtttttggtgcttgggagtatgttagtgtcatattcgatgtgtttcatgttgggagcatctgttgggcaaagatttgcatgatggaaggcattgctctaactcctcgacatggtttgtttgttttttttttttttttggtcttgttctgtggctcaggctggagtacagtgttgtgagcacagcttactacagcttccacctcctgggctcaggcatcctcccgccttagcctcccgagtagctgggaccacaggtgtacaccaccatacctggctaatttttgtattttttgtagagacgaggtttcactatgttgctcaggatggtctcaaattcctggcctcaagcgatccgcttgcctcggcctcccaaagtgctgggattacaggcgtgagccactgtggctggcctgacaagtataacttcctttgtctgcataatagccctacgaggtgggtgccgtggttgctctcatttcctaggtgagtaaacagaggcacagagaggtgaagtgagttgcccaaggtcacacagctagtaagtggcaaagctggatgtgcacccaggcgggaggctccggagcctggctcttgcctgctgtgctgtgctgctcctcagtctccccagcccagctcactcaggctccctttgttcctccaaccaggctcgttgggcggagcactgcatctggagtcacgagccccgggtttggctccaggctttgatgccaacttactgagtggcttcagagaaatcacactccctctctttctggccttttctttccttgtgtgtaaaatggaggttttgttgagtgttttgtgtggatgatggaggtgacagagccctgtcccatgacccatcacagggtttgggcccagatggtccagattctagtcctcatactactgccagctgctgtgtggccttgggtaggagtctgccctctctgggcctcagtttccttggctggggcatgaggatgatcctatctgccccatgatagcatcgttggggttgatccagataacgtggtcccagcactccactggccacagccagcacttggtaaatgggacttgctgccatctgacccgaggctgcagacaggtggcccgtgcatcacatctgaaccgtgtatctgttttgtttggccctgcagtgttcccagtgtctttgaataagttgccaacatttgaatatggagccacttcatagaaacatctggatttatggcttttcttgaaaacttggcagatggagtctgtactcccaatgggagtgagtggagctgccccttgggggaatccacggtgcccccccaccaaccagttctgccctcagtttacacgaattgccgcccttcccttctaggagctcaggcctccaaacctcagtttggatgcctagtccattggtccaacctgccagccggtcaatcagaacccagtgcgtcccaccttgccccgcagctccccctgctcctggctttgacttcatggtccgtttctccacccggtggctggagggttccctgttccatctgaggcggatcacccccgttccccactccggacccttcctcactcagtcacagtcgaatgccttccaaggactgccaggaagtctgcagtcttctctgctgcctcctgcccttccccactcctctctgcccccacagtcactcttcttcagccacaccggcctccttaccggctctttgacaggccgaggcttttgtacttgctgttccttgcctccaggaactcttccataagacaaccccgtacaagtctctgctcaaatgtcctccagtttgtgaggccttcctggaccaccccactgaaattagccgccttgctgcccgccggcactcccctgcacccctgatgtccccactgctctgatcgaggtcatacccactgcgtatcacactgtcttctctctatcatccatctccctgctgggacgctggctccctgaggacaagccttgtcccggtcacatcgtgctgcccccagagcctagatgagctgacacttcaatgccgtaggactcagcatggcagctcatccaggctctcggaggcagcaccgtgtgacagggaccaagatttttttttttaatatatattttttattatactttaagtttctagggtacatgtgcacaatgtgcaggtttgttacatatgtatacatgtgccatattggtgtgctgcacccattaactcgtcatttaccttaggcatatctcctaatgctatccctcccccctccccccacccaacagcaggccccggtgtgatgttccccttcctgtgtccatgtgttctcattgttcaattcccacctataagtgagaacatgtggtgtttggttttttgtccttgcgatagtttgctgagaatgatggtttccagcttcatccatgtccctacaaaagacatgaactcatcatttttttatggctgcatagtattccatggcgtatatgtgccacattttcttaattcaatctatcattgttggacatttgagttggttccaagtctttgctattgtgagtagtgctgcaataaacacgcctgtgcatgtgtctttacagcagggactaagttttcaggagggactcagggaacacttgtggaatgtactggggctctggggacttctcagggcttctgtgggcagcgagaggccggggctctctactccgtgcctgtcattcccgtggacttgtcagatgttcttctttcttccctgctccctctcttggtttatttccaaggagaggtgtttagtgggatcctgtggggagctcacggtcactcccccgtgtttaaattctggggtgccagactcagagctgtcttgtgaggatgctgcaacctcgggcctctgctgccttcaggacggtgcaggttaagctcttttggtctcaagtgatggaaacaaactcgaccccagataagaataaaaggggaatgggccgggcgtggtggctcatgcctgtaatcccagcactttgggaggccgaggtgggcggatcacctgaggtctggagttcaagaccagcctggccaacatggcgaaatcccatctctactaaaaatataaaaattagccgggtggtggcaggcagctgtagtcccagctacttgggaggctgaggcaggagaattgcttgaacccggaaggcagaggttgcagtgagctgagatcgtgccactgcactctagcctgggggacagagcaagaatccgtcttaaaaaaaaaaattaaaaaaaataataaaagggggagtttattagaacaatgctagctcggcacaatggctcacgcctgtaatcccagcactttgggatcccttggggaattcaagacaagcctgggcaacatagcaagacccccatctctacaaaaaaattaaaaattagataagtgtggtggtgtgtgcctgtaagtcccagctactcaggaggctgaggtgggaggatcgcttgagcccaggagtttgaggctgcagtgagctgtcatcgtgtcactgtgctccagcccgggcaacagagggagaccctgtctcaaaaataaataaaaataaaaatagaataatgctgcagcaaaggtgaaatcaccacccctcagaggccagagccagggccactgggctcctggaggctggaccttccctcgggtccagagccaccaactaaaatcccacagaggccagcctggaaacctacgagagtgacgtgaggaaggagtagggggcctgcgggggctgggcaaccgctgtgtagttccagaagctttctcactgcaggagggggtggctcgtggagtgcctagtggtccatttttgttcaaaactcccagtttttatatgacatctgttgattgttcacatttggcagcaaatccatttttttttaaagacatctgatctgcaggccaaaataaaacactttcgaggggtgggtagacccttgtcccgtcaatttgcaacttctaggccagagttttgctcttgacaggattgagttcccagcccccagttgtttttctttttatgtaaaaatatttgtaataataatattttattattttattttattattattattttttgagatggagtctcaatgtgttgccgaggctggagtgcagtggtgcaatcttggcttactgtaacctccgtctcctgggtttaagcgattctcctgcctcagcctcctgagtagctgggattacaggtggctgccactacactgggctaatttttgtatttttagtagagacggagtttcaccatgttggccaggctggtctccaattcctgacctcaggtgatccatctgcctcagcctcccaaagtgtgggcgatgtgggtgagatatggaagaggacttggccccaagcttgcctggagggggcagggtcccttctcaggggccgtccttcttccccgatggtggggactggggatgggaggtgatggaggttgaggagggtcggtgcttctggaagcagagctggggtgggtatttgggctggagcttggcgaggacagtggccgtggcagccttgtcccatgtcctggcctcccagagtgtgcatcagagatagccacgggggaggaggggaggaggagggcaggagacacagacattgtgaggagtggggggtgacagacgcagggcgggtggcacacacagaatctgagagggatgcagagggaggctgcgagggggaccgaggggaccacagaaggagtgaccaacagagagaaaggcagacacatacagagggagcgagcgaggagagagacagagacacagagacccagagagagatgagaagacgcaaagggagatcgaggcacgtgcaccgcattgggtgcacacccggacagagatgcagagagcagcaatgagacagaaacagacagagatggagaaagggagaaatatgtgggcagagaaagagacacacgtgtgtgcacacacgcatgcatgcacagacacacacatgtgcacgtgcactcacacacagggaggagggtgcccgagaagctggagaggagagaggcgagcgaggggagcccgaaatagcccaggggaggcggtagcagcacacgtggcccttcccgcctcgccttgctcttttccaggaggcccctacaggggaagtgactccttgaggcctcagccccgggggagtggctgcgccccatccagacggatgaagaaggccagaccctccctcatctgactctgccctccagtccccctctgtcctcccagttggcagcagtgggtgggtgcagtgtttggaggatgggggcttcgtttcatcactgacccctcttcatgttgcccaaataataataataatacgctaataataacaacaaaaagaagtcttctgtaaagtgtgactagaagaatacaaacatcttaggaaaacagtgctatttttattagtcattcacactctaagcaaacgtggcatgtgggaagcagcttctccctaagtcaacttgattgcctctgtcccctctggacacatttgtggggcttctgcttccctttgtctatgtctgcatgccacccccttctctctgggcctctctccaccctggtttctctacaggggatccttttctggaagagggcatgggaggctgaaagccccactcctccagccccttggacaccactggccacactctctgcccccctctgccagccttgtcccaggcagctccacttggcccgggccccaccttgagggagacttgctgggtggtcctggaaggggcatagaggaggaaaaccctctccagaacacagttgggcggggcggagaggcagaagacttggacacgagtcactgtctccgcttggtggatctctccacatggggatctcacaggcatctcagattaacatgtccctacctaatcatctgttttctgccctcctcagccagggcagcctgggctatgctgttgcagctatctgcagcaatctgcagatgtgggaggttgcagacaaccctagttgacttcttactcccgtgacatgtccatagcaggtcagtggggggctctacttcatggtgacctcattggggacctggataaaggatgctccatctctgattttccatggctgtcaaggcaggaaagggtatgagtccttgcctagaagtggcacggaccatcctgcttgcatctcattggtcaaagcaaatcacatggccatgtctaccttttcaaggactggagaatttcagtcctactatgtgcttagagagcagagacctggggccagcagggtggcacacatctgtaatccaagcactttgggaggctgaggtgggaggatttgttgaggccaggagtttgagaccagcctgggcaacatagcgagacccaatctctaaaaaaatattttttaataataataaaaaaaagaaagtagaaaccagggaacactgataacaggttgaacattggtggcacagatgactcctccacaccccactcctgcccctctcttagccccatctcaacaaaagacagctccatctttccaatttctcaggcaaaagaccttggagtcatctttgactcctttctctctctccccacagacacaaacacacactcatcctcacacagctcatttaatctattggcaaatcctgctgactcttttcccaaacacatccagagtctcaccatttctccccgtctcctccgcccccctggtctgagcctgcaccgtctctggcctggatgactccagcatcccactcactggtcatcctgcttctgtttatcccccaccgtgctgagcaatcctactgcatactgctggagtccctctgctcagaccctccaatggctcccatgtcattcctggtaaagccaatgtcctcctggtagctacaagacctgccatcacctgccccattactctctgccccatctcccatgatgctcttcctcgttgtctatgctgcagccccactgtcctcttgcacacacacctccaggcatgctcctgccccagggcctttgcacgtgcagctcccttagcctgaaactctttctccagatttccacaccatcacttccctcaaacgttccttgtgaatgaggtcttccttggccaccctatttaaagtcgcagtcacctccccaccttattccactacgcagcttgtttttttttttttttcgtaacacttccccctacctgacatgctgccaattgctcgatctacctcaatgcctcagtgatgtgcaacccacgcttttgcaaatcactgtctgaaaatcaacactttgttttatgaacaaggaaatgcaagtctctgcagggagagacccttttccaaaccatcccctagtcaccggcagaactggcaccagaacctggagccctgctttctagttgctgatctttgtctatcccttaaggttctgctagaccttgaccttcagttttctgacttatgccctgttggtcagaatagctgttattcaaaaaatgcccactccaaccaaaagccaaatttcctgggactggtaggtaatgaacacttgggttgactcagaaggagagtctacaaattctcattccttctttcattcattttcatgaacacctactatgtgctaggctttgtctaggtgcaggggactgtagcaggaaacaagacgaatgagggttttagtttcatggagcttccattccaaaggaggaagacagacgacaggaggtggtttcttcatttgcgcatgtaacctaaatttattaagcccttacttgtggattcagtgggggacaaagcggacagtccttgtcttatggagcttgcattctggaggggacagacaatgagaacagatacattggtgatggtggcttatatgtcaccagttgcagatcagaaatgacccctggaactcaggggatcaggaagcagttgggctcctctgagttggtgaaggctaataggctcttgacagcataagccataacctctttgtgacttttgaagcctgctttacattttttctctaatggtgatggagtagaattttgagacccaaggtcatctttccaaaaggcaccaaacccttacctgctggccgagttgttccaacccttgaagtattttccaagatacctatttctatctttaaagatctgtcctcctagctgggtgcagtggctcatgcctccaattccagcccttctttaaggatctgtcctcctacctgggtgcagtggctcacgcctccaatcccagcccttctggaggctgagacaggaggattgcttgaggtgaggagttcaagaccaacatagcaagaccccatctctacaaaaaacattagccagacgtggtggtgtgcacctgtagtcctagctactgaggaggctgagatgggaggatcccttgagcccaggagtttcttggctgcagtgaattgtgattgcaccactgcactccaggctgggtggcagagtaagaccttgactcttaaaaaaaaaaaaagatttgctctcctttgtaataagaggtcatttggaaggagtttttggaaattgtcttgtctcctttggtattcattcattcattcattcattcattacatctattaaacacctattctgtcccaggtcttcttctaggcaccaggtttactaggtgaacttcatatataaggttcctgccctcaaggagcttccttccagtggagagagagaaaatgagtaagttaaaccgtagataaatcaataatttcatatagagatgtagtgcttgaattccatgaaacagagtcatgaggtagctcttgcaggtggagttttgcatacggtgttggggagacttctttgacaaggtgacatctgaactgagtcctgaacgactgtaagagggcagccatggagttcttgggggagtacaggggaggattctaagcagaataagttagtccttgctgattgatcactttagtcttccacttcttcttcttttttttttttttgagacagggtctcactgtgttgcccaggctggagtgcagtggtacaatcacagctcactgaagtcttgacctttcaggcttaggtgatcctcccatctcagccttccgagtagctgggactacaggcatgtgtcaccatgcccacctaatttttaatttttttttttttttagaggtggggtcttgctatgttgctcaggctggtcttgaacttcggggctcaagtgatcctcctgccttggcctcccaaagtgttgggcttacaggcatgagctaccacacagtccagttttctacttcttaagtcaatttttagtgagttgtcttttctcagaaaataatttcttcatcaagagttgcaaatgtatttgcataaaatttagcatagtattttagctatttagcatagtattccttttaaaaggaattaaaaggaattttaaaaggaatttaaaaggatttaaagaaaaagcctctctttgatgagtttccttttctcattcctgctcctgtgtatgttgtggtttttctcctctttctaatggctttgtcttgctcaagtctaccagtggtgatatgggccctgtaaaaattgctttccagacctccagagagagccgacaggcttgaaacctttacacaggatctgtactgagactgcgcatcctcaggccccaggcctgatttgttctacccttctccctttttttctccagcccaggtcttgccagcttagctgttttattgccccctcctccatcttttttaaaaaagcctcattactcttgtatttattgattctgtttttttaattttctgatacatcctagttttctttagtctgacttttctgaggtttgttaatgtttgcaagtttttacattgaaaactttgttttttcatagttaaaaaattatgaatgcatttaatgctatgagtttgcctctgagcaccactttagccatgtcctatgagtgcagtgctttaaaatatggtgctttctttcagatgattttctaaaaattatgcaatgacaattttgtttctaaaagttcagaaattttgattttgttacttcattgatccaagaataatttagtagaacgttaaaaatttcccagtataggccaggtgcagtggcttatgcctgtaatcccagcactttgggaggctgaggtgggaagatcacttgaaaccaggagttagagaccagactgggcaacatagtgagactctgtctattaaaaaaatcccagtgccttgtcttatttgcttaattttttgtcattaatttataatttaatgaatgatagagaaagtagcctatgcaatttctgccttatatttttttttcgtaaatgttttatttgaaaaagcaggtacattccctgtgtgcagtttaaagcagttttatagatagtattatttaagggctttatattgttatatatatatttttgaggcagagtcttgctctgtcgtccaggctggagtgcagtgacaacatcatggctcactgcagcttcaacttcctgggttcaagtgatccttccatctcagcctcctgagtagtgggactaaaggtgcatgccaccatgcctggctaattaaaattttttttttttttttttgtaaagatgaggtgttactatgttgcccaggctggtctcaaactattggcctcaagcaatcttcctgcctcagcctcccaaagtgctaggattacaagcgtgaaccactgcacccagcctctaaattgtcatttatttatctttactccctttatctgccaaaagctggatgaggtaggttaatctctttctcttcaataggattcttcccatttttacttgaatttctgatagtttttgttttcataaaaaagtttgagtctatgttgttcatcacaagaagattcttgacagttatattttcattgcggaattgtggattttatcttttgtcaagataaaatggctattttcccccagtgaatgctttttactttgcatcctatttttttcatattttaatattgctatccctgctttctttcgtttgtattcccttgatatatctcttactagactttttattttaacttctccatgtctttttgttaggtgaatatctggtaagaacatagagttagctttatttacttattttttggtacaatccgagagtcttaaacaaatactatttatttctataacaaatacacttggcctcacttctttcacttctttctttttgttgaatgttcccaatttttaggttttttttaatcttttactatatagattaggttttgcttctttttttctttactaatgttttaaaaagcatgcatactgatattaattctgtttttaatacttggacttccatttttgttataattatgaagaacaaaacagcatatattgcatatttcctggtaggatgagaaaattagttgctcttgaattctgttttttattcatacgtgtcataatcgttgcaacttaattccatgcttaactggtttcatggctaattgcaagtccctttcgtaaactttccccgtttttattcatatgggtgctggttggctttgaacgcaagatatgatggtctatgggctggtcactgtccacgtgctgggtcccatgatggaagctggattcagtgaagaggatgactaggttcctgtcctcatggaacttccagtcgtgtgtttgtgctcatgtgcatgtgtgtgcatgcgtgtgcatgatacacaaagaagcaaacttttccctctctgagcaggtggcatctgagtgagacttgaagactgagaggaagtcggccacaggtgatcagaggaaaccgtgtccaggcagaggacatggcacgtgcaaaggctttgcgcaggctttgtgcagggatagagcagggcgactttgaggaacagggacaaggctgatgcgccagagtgcagtgagcctgggagccagggagcggtgatgcgggagtggaagcagagacggccacgaagactggatttcgggccgggcttggtggctcaagcctgtaatcccagcactttgggaggccaaggcaggcggatcatgaggtcaggagatcgagaccatcctggctaacacggtgaaacccccgtctctactaaaaatacaaaaaattagccaggcatggtggcgggcgcctgtcgtccgagctattcgggaggctgaggcaggagaatcgcttgaacccgggaggcggagcttgcagtgagctgagatcacactactgcactccagcctgggtgacagaactagactccgtctcagaaaaaaaaaaaaaaaaaaaaaaaaaagagtggacttcctcctcaatgcatgtggcacactccccagtgcttgttttcctagcaatagctaacggcctgcggatgtggatggcctcgtggctgggcacagactccacaggtttaaacctttcccctcaatatcctgagggcagctgtccatgttttttggcatctggtgatgaggaagtgatgtctgaggtcagccccaatttttgttcctttatggacaacattattaatatttttcctgaaatcctacatgatttttcccattcatcttcaaaatagagaatttcatgatggaatatataaatgttgggtctttaatttttatttaatttttatttttctggagaaagagtcttgctctgtcacccaggctggagtgcaatggtgtgatctcagctcactgcaacctctgcctctcgggttcaaatgattctcctgcttcagactcctgagtaactgggattacaggcacctgccaccatgcctgtctaatttttgtgttttgagtagaggtggagtttcaccatgttgcccaggctggtctcaaactcctgagctcaggcaatccacctgcctcaacttcccaaaactgttgggtttttaattggcctggtacttgttgaggtcagcttaggaagacttgattgtattattattatttgagatggagtttcgttcttgttgctcaggctggggtgcaatggtgtggtctcggctcactgcaacttctctggctcctaggctcaagtaattctcctgccacagccccccaagtagctgagactacagaagcgcaccaccatgcccagctaatttttgtattttttgtagagacagggtttcaccatgttgccaggctggtcttgaactcctggcctcaagtgatcttcctgccttggcctcccacagtgctggaattacaggcgtgagccaccgcttctggccaatacacttttttaaagcagttttagtttcacagcaaaattgagcatggagtatcgacacatcccatatcccccctttcttcacatatgcatagcctctcccattatcaacatctcccaccagagtggtacattggtaacaactgatgggccttcactggcatgtcactatcacccaaagtccacggtttacattagggttcactcatagcgttgcactttctgtgggcttggacaaatgtgtaatgacatggacccaccattgtagtatcagacagagtcgtttcactacccccaaaaaatccccgatgctctgcctttttgtcctttctttcccccaaactcctggcaaccattgatccttttactgtctctatggttttgccttttccaaaaactgtcatagagttggaatcacacaggatgtagccttttcagactagctttttcatttagcaatgtgcattcatggccggacgcggtagctcacgcctgtaatcctggcactttgggaggctgaggcaggcagatcacctgaggtcaggagttcgagaccagcctggccaacatggcaaaaccccatccctactaaaaatacaaaaaattagccaggcatggtggcacacgcctctaatcctggctacttgggaggctgaggcaggagaatcacttgaacctcggaggcggaggttgcagtaaaccgagatcgtgccactgcacttcagcctgagtgacagagggagactctgcctcaaaaaaaaaaaaaaaaagcattcgttgcctgcatgtcttttcatggcttgatagcttgtttctttgtagtgctgataatacatgccatcgtctgggtgtgctgtagtttatctactcacctactcaagagcatcttggttgcttccaagttttggcaattatgaatcaagctgctataaacatgtatgtgcagctttttatttgggtgtaagtttttaacgccaactaactaccaaggagcacaatttttggatagtttggtaagggtatatttagttttgtaagaagctgccaaaatgtcttccttccttctttccttctttccttctttctctctttctctctttcccatcctcctgctttggcctcccaaagtgctgggattacaggcgtgtgccaccatgcctggctaatttgtgtgactttagtagagatggggttgtaccatattgtccaggctggtctggaactcctgagctcaggcagtccacctgcctcgacctcccaaaaatgttgggtttttaattggcctggtatctgttgaggtcagcttaggaagacttgattgtattatcatcatttttgttatttaatacagtttttttttgtttgtttttttcagacaggatcttactctcttgcccaggctggagtgcaatggcacaatcatggctcactgcagccttgacttcctgggctcaagcgatcctcccatctcagcctcctgagtagctgggactacaggcatgtgccaccatgccctgctaatttatgtattttttatagagatggggtctcaccatgttgcccaggctggtctcgaactcctgggctcaggcaatcctcctgttttggcctcccaaagtgctgggattacaggcgtgtgccaccacacccggcccaaaccgtctttcaaagtggctgtaccatttttcattcctccggcactgagtgggagctcctgttgctccacatgcttgccagcatttgatgttgtcagtgttctgggtacacttttacattttaagtgtacttttctcctattccagttcctactatttcataccatccatccaggctatccatgcaggctacccatcttcaggggcaccacttatttatggaattgctttctgtcctctgacctctatgtctctcgttttctctgtcataattttaatgttccttttgactccttcttttgtattccaaaatagtttagaaagttcgtcctccagctgttggtacctctgaatgtttgagagaggactccgagcctcaaatcctttatagttttctatgctcgtgatcaaagctctgctagaccagctttgaggatgcctttgcctggcctgagagatctcgtccttgctttccaccctctgggttccagcctggcttctgtttcgtcttctaaaggatggcaaaggaggcactttcaccaaagccagagaaggctctaggccctagttccagttccatctcagaaaagacacagaaaagaaagaaacattctctctgcccctagtgttgtacctaattatgtccatgactcatatcaaaatacctcgtctttggcagggaattaactttctggagctcggtgccactaacactctacattgttgattcaattttccgtaggattgagtctgctccttgtggcttcaaatgtgtattttcgctctgcgtttgcatttttagctccttttcagcccgtgctttccccatttggcttccacttcacctagcctgccttcctggcagctctccttggctaaatctgttgtctgatcttccgatctgccaagtcttcgtgatagagtttatattttcttagggacgcaaacacatgctttcgtgaatgattgtgtgtttcctctaacaagcacgtctcaaggacctgcttttattgtctaccttgagtatatccttcctctttttcaggtggtagaattgtccccagtgtcttatttgcaatgatttccccctttcttttctgtatggaaagatctctttaggcctaccctttgctcataaatagagtgagtgggttctctttgatacttctcgcctttcacctggttgcaatggaatcttcctgacatatctccaatggtactgctggttagcatgaacattactaaatggatttctctgttgttgggatttacttacattttatgacttttttttttttttttgagatggagtttcgctctgttgcccaggctggagtgcagtggagtgatctcagttcactgcaacctccgccccccgggttcaagcaattcttctttctcagcctcctgagtagctgggattataggcgtgcaccaccacgcctgactaatttttgtacttttagtagagacagggtttcaccatgttggctagggtggtcttgaactcctgacctcaagtgatccacctgcattggcctcccaaagtgctaggattacaggcacgaaccactgcgcccagcccattttatgactttactagctggagataggatctccctctcacctcctggtgatgtgatcatggaaagaaaagcaagacctgcatgttatttgaaggatgcttgtagttcctttcataacagaaatggcgaatgtaaaaccacaattccctccatgcactattcccacgtttctccacgtctttgcccagttttactttgcagctcaagatgttgagtggatggaagccagggggatgagcgatcctggagcgattctctcagaaacttccagccattcaacatctgcgatgcccagcgagggcacgaggctgagagggtaagtgaatgtgctttgcatcttgagttgcaaagagtctagtgacgtaaatgccaaccagcagtgacgctggtgctatgagaggaagaatctaacagcaaccttgtgaaaagtgagacgattcaggtaacccacctgctctatttttgagtaaatgccaggcctggggagatctgttaggtttggataaataggagggaagagtgtggtagacctcttcactgacttactatcaaaaagttgtgagtagagttgtggtccacttattcattcatttactcattcattccctcattcattccacgactactactaagctctggatgtacattagaattatatcaggcactccatccggatatagtatcttttttttttctttttgagagagggtctcactttgtcacccaggctggagtgcagtggtgtgatcgcagctcactgcaaccttgatctcctgggctcaagcaatcctccttcctcagcccttcaagtagctggggactacaggcatgcaccaacacacccagctaatgtttgtattttttgtagagaaggggtttcactctgttgcccaggctggtctcaaactcctgagcaccagggatccacctacctcagcctcccaaagtgctaggattacaggtgtgagccagcacacccagactctgatacagtatctttatcctgatagctatcagggatcaaagaggatacactgggtctttgtcctgcgaggaattcttccattgctacctccgtgtgaccttaagaaaatggttcaatctaacagtgcttcattttacccatcaatgaaatggacataaaaaccaaacatcttaggggttgatgtgagattgagaggacacggaggtgcagtcctcaccctagcacttggcacaggctcagtgcacagcacacatttgctgctgtggggtctgaataaggccctcggaacgcagagagatggtctgggatggggatactggatggaaaaggagtgtctggctgaacctgaactgattctaggagatgccctggcggccagtcagcactaccctgcctggggcgggcatgtggggctccagagccacctgcaagttcccccacctgcctgcaagcccagaggggccagagcccagtggagggaaggctctcaggcctgggggctctgagagcatcttcatgtcctgcgggtctcttcttaggttgctggaagggcatccgtccttgacatttcattcattcgttcatttattagactttttttgagtgcatactgtatgccaggcaccatttttttctattattattattattgatgttgagaatacagtggtgaacaagatggggtctctactcttccgaattcgtaattaattctgggggagtatgtggtgaggcaacagataagcaaataagatggttttagagcatgagaattacagtgaaagaaaagagaagtgatgggatggagagtgattgagaagagggaggcctctggggaggtgacatttctcttgagaatggaatgtcaaaaaggagcctccctgtggagatctggagaaagagcctcagacggaggcaatcgcaagtgaaaaggccctcgggtgggagagggacctgaagggaggcgtgaatggctggagtccagttaggaggcgactgcagcggtccatgaaggagacgatggcagctagggccatggtgatgggtgtggagaagggtgacgggctcagccattgttttgcaggaagaaaggacaggactatgatgaggccagcaggggaaggagaggagtcaggggtctcccttagggttttggctccagaagctggtgggtgatgccatttactgagatggagaaaaacgagggaggggcgcggggacaggttgagggagaaaatcaggaattttgtttttggacatatgaaggtataaatactcatgttgacttctgatctgctgttgaccaaggaaagaagcccaaactgttgtgtgtgtgtgtttatatgtgtgcgtgtgcatgtgcctgtgtgcgtatgtgtgcatgtgtatctatctgtgtgtgtatgtgaatgtgtatgtgtgagtgtgtgtgcatgtgtggggatgtgcatgtgtgtgcacaggcatgtgtagtgcgcgtgcatgtgtgcatacgtgtgtgcatgtgcgtgtgagtgtgcatgtgtgtgcacgcacgtacatgtctgcttgtgtgtgtgtgtgtgcaagtgtgggtatgtgcatgtgtgcgcgtgtgtgcacatatgtgtgcatgcctgtgagtgtgtgtgtgaatgagtatgtgtggatgtgttctgctgagggattctcaactttggccctgttaacatttggtaccagatcattctttgctgtgggggtggggggccaatcctgtgcatcgtagagtttttagaagtctccatggctcctaccaactagatgccagtggcacccatgaatctctccagccattgccaaatatctcttgggaggcaaaattgctcctggttgggaactaacatgaaaccttcataggggcatttcccacgtcatagggtggaatggaaaatacacagcatgggtgccagcactgcccccttccttccccatggtcgacatccttaactgatcacattgttttttctacaaatctcagatgctccctcagaatccttcctaacacaggtgaccaggagccattatcaataactaggattggcatttagatgaaacccacttattctctcttttctaaggttagaaaaagatcccaggatgatctctgcagcccccacaccaatttgcagtcaaatcctagacagcaacctttgcacatctgtgcctcagtatccctatatgtaaatgaaaacaacctgaattgctctctgtggatctgatagagccttaagtgggaggatcaatgagataatctcgataactcaatttgagtttttgaaggtgggcagaatgttacagaaatgtgcagcgggatcattatctcaagggatgccatgaaggtgaatctgtaaataattagaaaacatttagctggtataacgtgccaggtttaatcatggcataatgaaaaaggcaggctctcagaagcgggcgggcaggttggaaggccctgcagtctgctctctctgggtatcgccaggaggacggatggcgatgcttgaggttacggtaatctgtgtgtgatgttttgttcgggctcagggtaaccatggagacagactccccccaccgcccgtagtaccaattccacactcctgtgcatatgtacacactgcacatgcacgtccccacttccctccaccccagctccttctcacctggaaaggagggaggattcaggggagaccctccagaggggcagcctcaaggccgctggactctggggttgtgggttcagatcctgcctcttccgcttcctgagcatgatcctggaatgtcacatagcctctgggagtctcagtttcttaatctgtaaaatgaacttaaaatactttttccccagcagggttatttgggggggatcaaattctaggctggatgtagtagtgtatgcgtgtggttccagctacttgggaggctgaggtgggaggatcacttgagcccaggagttacagaccatcctgggcaacagagcaagatcctgtctctaaaacaaaacacaacaacaaaacaaaatttatcagcagtgaggaattctctggatgtggaactgcaaattgtttaactgctccgtgccttagctcctcatctgtaaggtgggataataattgtacctacggcagagagatctgaagcccatggtgagtagctcttcttggtgctgatgagattacatttaatccatgacctacaggagggattggggcccttggatccaacgtgtagataccaggcagtcatgggagggcttagggttcagagaggtggggagaggctggaggtggctgcatcccaagaggggaaatattagatggaaaaatgtacctcgtgatactcaggtccaaagagggaacaaacaggatctaatgggtgagtccagcaacatgtgagagactccatgggactttggtccattgcaatttgatagaagaataaggattggctcatagtaaagatacatgtgggtttttatattattattattacattgttgctgctgctattgttgttattgttattttgtatcaacagtgaaaagtggtttccccaaaccagagcatgacctagagttacatcaatagaaatattatatatagcatgagggaggtgatggtctgtctcttctctgccctagtaggggaccacctgaagcatttgtgtttgattctgggtggcttccattaagagggacattgatgaactggagtgggtcttctggaggggaagaagtttctccacgaggaaactgaggctgtgttttcttcatccactaatggcttgtggttctaagaattaagaaagatacaaagataaatttgcaaggctgggcgtggtggctcacgcctgtgatcccagcactttggggggccgaggcgggtggatcacttgaggccaggagttcaaaaccagcctggcccacatggtgaaaccccatctctgctaaaaatagaaaaattagccaggcatggcggcacatgcctgtaatcccagctattcagaggcccaggcacaagaatggcttgaacctgggaggcggaggttgcagtgagccgagatcacaccactgcactccagcctggggaacagggcaagactctgtctcaaaaaaaccccaaaaccaaaacaacaacaacaacaacaaccaaagataaagttgtccctgtgaagtgcacactcttctggggagtacaaaccaggcatgtgactgtcacacatgtgggaaacgtagtttccggctacagaaagaagcattttaaagaaatgcttaaggaaagaggagactgggagtgggagtagcctggggacatctgggagctgtgttgaaatgcatcaggacgtctgtagggaaaagcgtcctgatttctcctacgtgaccccagagtcaccatcagagagagacagtgatggagaggcccttatagaaacaagctcagctcaaagcagaactggctgcttggctgctacctggctgggtctcccagaagacgaccctaaaactaggatttgagaatttgcatttgagcagttgatttgggaagggattccaggaagtcctggtgaagggggggacagagtgatgggaaaggagaggcagccgaagcagtgtcctggggcaacttggaatcccagtggagggccctgggagactgtgaggagcgtgcctgagttgtcccccagaccaggggggaactggagtctttctccactaactcccatctaccactggttgaaggcatcattaactttcagtcggcccttggtgctgggtgggcacataccagggcatgagaaagctctgacagagggagtcgtaggaacttgcagtgaggaacctgtggcctttaggggactggcaagcactgggggcctcaggcagcttcgggaggtggtagtgagtttcctgacacagggttatataagcggtgccttcctgcgtgaccacgtggtggggagccaggcgagtctactctgggtgacagagaatctttaaaccattttgtacgtgttgcccacttgagagatgatgtaatcccaggccttgtcatcccacggatgatttggggagtttgcgtgtgggtggatgtgggggaagaataacttttttcaagctgttttttcccctcctaaaccacccactcctgcctcactcttgggctaattctaaataaaggggcccactcaaaggctcagctttcggtcagaagggcccagtttgctgatccaaatgaatcccacatggattaatgatgttttcctgagggactggggtctggaagcagtgaagtggccccgtaagctgggagaaccactgtcatccccgctttgtcctttatgagctgtggaacgtcagatgggtcactctccctggggtggtaggagctcagactttccatctgggcaatgaggggttgtatgaggaaatctctgattcttaagttgtcatttgcagcctctggaaaactttgagtaagacttgaaagcaatttatgacttgagctgctgttaagctacaaagacccttgtgtggaggtcggggctattatcatgatggagtacttacagtagcaaagtgcttcccgatattttattaattaaacatggtcccggtacagcccccactgcctgctcttgtgatggggtacatgtgtgctataaaatcagttgggtctatgtgagggagatgagtagatggtaaatagtaattgtcactaagtcatgctactgaaaagctagcagtggggattcccatgaaagaaagatcctcacctattttattttaatttaaaaggcactctaaaagccatttaaagtacaaatactttaaaaaatacagctgaggataggcgtggtggctcacacctggaatcccagcactttgggaggctgaggtgggaggattgcttgagaccagcctgagcaacatagtgagaccccatccgctaaaacaaaaacaaaaacaaaaacaaaaacagcattagctgggtttgctggtgcgtggccatagtcccagttactcaagaggctgaggtgggaggattgcttgagcccaggagtttgaggttaaatgatcatgccactgcactccagcctgggagacagagtaagacactgtctataaataacaataataataaaacacagctgcaattagtgagtacatggggtgggtagagatgttgtctgtgtgctaggcactcctctctccattgtacagatggacaagctggcagtcagagaagtaatttgctagtataggggttctcaactgggggcaattcccctgcacctccaccccagggacatttgtcaatatctggagacatttttgtttgtcatgactggagtgggggcgttataggcagccaatgggtagaggccctggatgccgctaaatatcccacagtgcacaggatggctctcctacaactaggaaatgatccagccctgaatgtccacagtgtggaggctgagaaaccagatcagctctgcgctccctgagtcctaaccttggcctctcccctgcctgtgttgtcaccccatgggatgacaagtccaacaaaggatgcagacctctgagaaatagaaagggaaaaaaagaggagacagatagaagaacaatgggaagttgagagagatactgaaaccagttgatgttatatgagcacctggatccagctgagactgaagccccgctacctttttcttcacataagccagtagaaatttgtctttttgcttgtgctggtttgagctggattttgtcgcttgcagccaaatagatttcccaattcatttttgaatcccaatgcccagaccaggaactcgggaccatagggataggatgggataggatgggatgggttgggatggaatgggatgggatgggatgggatgggatgggatgggatgggatgggatgggttgggatgggatgagatgagttgcattgggatgggttgagatggggtggaacgggatgggatgggataggctgggatgggatgggatgggatgtgttgggatgggttgggataggatgggttgggacaggatggaataggttgggatgggatgggatgagtcccaagtctcaagtcctgcatgggaaccctgtgagcctcagtctggtctctgatctctaagatgggctgagatattgccaacatttatgtgtgtgtgcgctgtggactcccttgaagaggggatgggagctagggaacttctctcttcaacaattttccgctttccactgtgcgattttctcttcttaatatactcttttgtagtctgtttttcattaattatccccataaacatttctctgaatttccatagtcataataatgatcaatattaatggcttcatactactgcatcttaaccacagagcactatttcctgagtaattcttgggttgttggacatttattttattttaattttttgtttccttacagtttaatacacaatgattattttcttgaacagaacaatttatttgttgcatgacctctttaggagaattccccaagagtattttttctctctttcttttctcctttcctttctctctttctccctttcccctcctttcctcctccccttcctaccttacttttttcttttttatttgatttaattatgttctttggaataataacatgaaccttggtttaaaattcaaaggcagtacaaaaaatctcattcccagtcacccacttccctcccaggggcaaccgctggtggcattttaaagaattcatctgttaatatttcatttttaaaaaataaatggcatcacatcacactctatccactgttctactctggcggttgtagatggggagctgatctccttcagatagtgaggtcggagaaggcttctccaaggaggtgacacttgagttacctagaggacggtaagagagggaagaagtggtccagcaagaaggattggcaggtgcaaaggccctggggtaggatgcagtgggcagatttgaagtactccatggaggctgatggggccattgtagaaggagagaggtcagattgctagagagggaccctggtgtgcagaacctcattggctgcagtataaaatttggactttattctaaatacactggggtgcctttgagggcgtttaagcaggaaggtgacaggacgtggcttacatttaacaaaagtgcattctgattgaggactggggagtaatggatgaaggcaggcagatattgaagggttaacaggtggggggccaggtgagatgatggtgcctcggccttgtgggaagatggagagaactggatggactcaggatattgtttgaaggaagagccaataggatctgctgacaaattggatgtggagtgagaggggaagaggcattttggacaactcctagatttttggcctgaagagatggttgtgcccattactgagatagagaagactgaggtgggaagaggtttttgtttgtttatttagtgggaaggaagcgatcttaaattcagacctggccgggttatgtttgttctgtctgtgtgacagcccagaggcaatgtcaagtagacagggagagaacaaaatacatctcagagcccagaagtgtgatcaggctggagacatcaacggagaagccgccagccccaggatgggctgagacgcctggaagagcgcgtcgtgcatacatcaacgtatgaatctatttgtctcactctcactacgccagctctgcatgttgtcattcgtgtttgttattcgttttgtaattttctaattttcaaaagcaaacatggcctgtagtgaatggaaagaaattgtgcagctgcttgtattcggatcctagaggctttcttacttgtttcagtggctttacctaatctaaggtgagaatccaagtctgacggataccaaaattaagaaaaagagcctttctgggtttcccatcatgttcatgcatctccagctatttctgccctgaaagtcagaggtgctcactggagaggaaccttccagtaaaagagccggagctgtctcttctcttccgtgtctcctgaatacccaagagatacagttcccctgtgatcttgctgtaatgaattctggttgctttttcattataagccctaattttctccacttccagattattttcctttccagtggggttataattccttgttggagccccagggcatgtgtttttcccctccgccatcaaggcaaggaattaggaaatgcgtgatctctgtggagtggctgctctcaggcccctggcatggaggttcgtctgtcagaaacagctctacgcacattcagaaagtgaatcttgtatttatgttaacttttatataaggcggcattaactaatgtagctaacagatgtttatggagggttatccgtgtgctggggtcagaactgagcctgtctctcagcttgccacagagaatctgagaacttaaagtaggcagaaaattctaggccacctttgtgttcaagcctctcattaatgaacaaatgggtgcatccattcataacctcagggagcctcaagctcttggacaccctgctttgggaaagttaataggtgagtgcaaataataatgttcctagtctcagcatggcatgggtgtggttatcattatgagccaggctgaatcccattccattccattcccatcccatcccatcatcccatgccaacccatcccatcatcccatcccaacctatcccatctcatcccatcccatcccatctcatcccaccccatcccatctcatccaatcccatcccatctcatcccatcccatcccattccatctcatcccatcccattccatcttatcccaccccatcccatcccatcccattccatcttatcccaccccatcccatcccatcccatcctattccatctcatcccaccccatcatttcatcccaaaccatcccatcccattcccatctcaacccatcccatcccattccatcctatcccatcccaacctatctcaattcatcttattccaacccatcccatcccaactcagcccataccaatccatcccatcccattccaccccattcatcccataccatcccatccaatcccatccctcccatcccatcttatcccattccatcgcaacccatcccaacccatcccatcccatcttaacccatctcaatacaactcatcccatcccatcccaacctgttccatcctgtcccaacccatcctatcccaacccatcccatcccatcccatcccagtctatccaatcccatcccattccaccccatctcaacccatcccaatacaactcatctcatcccatcccatcccatcccatcccatcccatcccatcccatcccatcccatctcccatcccattccatcctaacccatcccatcctatcccatcctatccctatggtcctgagttcctggtctgggcattgggattcaaaaatgaattgggaaatttatttggctgcaagtgacaaaatccagctcaaaccagcacaagcaaaaagacagatttttactggcttatgtgaagaaaaaggtagcggggcttcagtctcagctggatccaggtgctcatataacatcaactggtttcagtatctctctcaacttcccattgtccttctgtctgtctcctctttttttccctttctatttctcagaggtctgcatcctttgttggtttcactctctggcagtcctcttcatgtagtggccccagcagctccaggtttatatccacccagtttggcaccagtaaaagtccccagagggctctcatttgttgggcttgggtccatccctaagcttgccactgaggtgtgaggaatgtggtgctctgataggctaggcttgggtcagccgctcacctctggagttggggttggagttagcctcaacagagactcacggactgagctgctggttccccgaaggagaatcaaagttctgctactagacaaggggaggagggatgctggcaggcagaaccacagaacatcctctctatctttcttcaaaaagcttcttcatgcctctgtgccttttacaagcagttcccttctgaagaggcccttctctggccctcctggaaaattcattcttcctcttccttcagggttgttggagctccctccatctgtgatgtttcatcccacgagctggcatgcctgtcatgtctgtacacactgcccacatgtgcgtgcgtgaacacacacggcccacatgtgcgtgcatgcacacacacacacacgctatccttgtagtttgagagtgttgtgtagttgatatccagtaccagagtaaaatcctgactcagcaagagttgcatcctaagctgcatttggatttcattgctcatccatcatccatccatctttaattcatccattatacatccatcacccatgaatccatcattcttccatctgtccatgaccactcatccattcattcatctacagtccatccatctatctacccatgatccacccacccatccattcatccacctgtgcatccatccatccacccatgcatccatccatccacccatgcatccatccatccatccatccatccatccatccatccatccatccatcccttcatgcacccatatatctacacattcagccatccatttttccatcattcataatccatccatctaacaaatattgctgatgcctttgctatgccagatggactagaagatccctgccctggagagcaaaacatagtgagacagacagacacaaaaacaaagataattcagaatgatacaaacgatcccatctcagtctggtgtcagcagtttacttgatgctgctgattccacttataaataacgcacttctactcacataatgaaaatggcaacagttcacattcattcagttctttacacagcactttctcatttgtttcttaggacccttctttgggggtaggtattcttatctctgtttctcagatgaggaaactgaggcccagagaaggcagggaacagctcaaggacccttaccttgaccacagtggagaaggtactcagaaacaggcctcagatacagctcctgatcccgtgttaggcaaggtgctttccgtaggttgaggatctgttcatcagctgatgtgggtcgcctggtgccctgccatgcatcaccctccaaaacaaacctgggctgggagagcctagctggctattggtcactgctgcagcgtctgagagctccctgaagcccaggcctcctcatctctagccactgcctttctggctgccggggaccacagcactgtgaagagaggcagttcctgcctaagcctggaggcttaaggaaggggcatattatgtctcctctagatagtatgatctgccccgagcctgaggctggctctctctttgttcaaaagagagattagcaagtgctatagaggcattaacaacatatcagcaccaagctgagactttctccttggtattaatggaaggacaggaggaacattaaataaggaataatttcctttctctgagagttaaaagctgggactctgaagcagaactgcccaggatttaaactgttggccatgcaatgagtgctaagtcttattaatattattcttattgttatattgttactgtggacagagtttaaaagccacaagcagaatgaggcagtggtaaacagtttacactcgggaatcgtaggcctaggttccaatcccggctttgtcaagtcttacttttgtcaatttgcaagtgacttgacctcctcaaggcttggtttattcatcttcaagatcgggatgaaaataataaaaatagtcaacatgagggattattttctacctgcctggcacgggtctaggcacttctcatgtaataactcccttggccttcatggcccatcaactacactggctagataaggaaattgaggcatcttgaagttcagtagcttgcccaaagtcccacagccaattgtaggtgaaggtgggatttgggcccagggcagtctgactcttgggcttgtgataggcttaggaaagactcacgaaatgacacatgtacgtgaccagccaaatgcctggcacatagtttggttaaataaatagaggtgatgctgctgctgaggccttaggtgtcagctctgttgctgaggctggagtgcagtggcgcaatcacagctcactgcagccttgacctccagactcaagaaatccttccaccttagccccccaagtagctgggactatgcctggcaatttttgttatttttgtagagacagggtctcattatgttgctcaggctggtcttgaactcctgggctcaagtgatgctcccaccttgtcctcccaaagtgctgggattcagacttgagccacggtgcctggccaagactcttacttctaatgatggaaaccctactagtttaagcaagtctaagaaaattatctactcctgtgaactacaaagtctaggtggtgtcagtttcacctgaacacaggtgcccaaaaatatcaccaaatgctctttgattccttagactctattccatttaaaatttaaaattcagttcctcatttgtaccagtcacatttaacatgtgactagtggccactgcattggatggtgcagaacatttctatcttcactaccagattgtatggtgctgctcgctatggaaattaacgtggcccctcataagccctgcactgaaaccccacctgccttgcaaccctagagggaagagagctgctttcccataactctggagaaaaggctcagggaaggctctcattggcctgatttatatcacatgtctattcctgaaccaatcaccatggcctgcagcgtgtgaatggagtactctgattggctggcttagatcatgtgcctgcttcattggtgggatggttaggcctgcccagagcacatggcatatgtttccagaataggggagagaagaggatggagagtgaaaaatgacatactgtgatagatggtattctttgtttataattattaattcccccctccaccactgctgtgtgtccctgaaggggcgtgtactgtcccacttctgagtgcagtggtgctatttcgactcactgcaacctccatctcccgggttcaagcaattcttctgcctcagcctcccgaatagctggaattacatgtgtgcaccaccatgcccggctaatttttgtatttttagtagagatggagtttcaccatgttcgccaggctggtctcgaactcctggcctcaagtgatccatccacctcagcctcccaaagtgttgggattacaggcatgagccacaatgcctggccccactcttgatgactttgaatttggtcctgtgccttgctttgattattgactgtgagcagatgggacacacgcagtatctgagcacagcgaggctctgccctgtcacgaggatgggatgcctcagacagtggctgttccttctgcctggtcccagaatgcgaagggacggggcccagtgtaaccaagaccggccaagcccagcagagcccagctgagctgcgtccagcctgcttccctcatgcgacaagaatgagaagtaaatgcctggtatggagggccactgagaggttaggactctgttctggcagcgaaagccgactcgtgcacaccctgatcctcttcccgagtcccatcctgcttcctgctctagtccaccttgggcttcagctgaggtccctcgctgatgtgtggcagatccgcagcagaatcagactccagtgaagagcaaactcaggctggagtagaagaacttgtgacatttctcaaggggctcctctcctggttcctcttaagcttgctgctgttcattcagtcacacacagtgactgagctcccgtgatataccgggtgctggacctgcaagatcttgcgagacccagctcctgccctcaaggtgcccccagtctgtggggagagacatgggtgagcaggtaatgaagtcacggcaggcccagggctctggcaaacccgggccgaggactagctgggcgtttggcttcctgaatatcggccagccttggacccagagccacgtgttgatcagacgaatttctttaaaaatgaccctgggctagaagtgcaatcctagccatgcaggttgtctggcaaggccaaaggattctggagattctcctggtagcaaggagctgtcttccccaagcccattatcctctagcctgtgcctgctgtggcatttctctgcctgggctctgggtcacatttcacttctgttgcagtccctggggccatcaggatgacaggagcatcacgcccaactgtcagccctcttctgtcccaacacactgttctgacttcagaccttgccagtcccaattataaaagaacaggcaggggatggggtccccgctctttcacagggtcccaggcaaaggcccggctctctcttgctcatttattcgtgaatttatctgacatacattgaaagccaattatgtcttgctgctggggcaggcaggggtgacagagatgattaagatacagtcagcccttctagcctgggcccagcagcgttgggggcctgcggagccagggagggttgagccgggcttgggaggatggtgaaattgatccagcagtgagcattttaggcagaaagaacagcacaaggaaaggcacgaaaactggatgtagggttcgagcacaaccttttggaggtggggtgcatgtcccccttatgtctgctcttccttagatgaggtggcatggcccctgcccagagttgccatctggggagatttaaggctccccgagcctcctggccctagctgctggccaggcccagtggctccctcatctccctttcctgcacccactctcctggtgacatggctcgcagtgcacatctcctgggcaggtgcaggacatggcaacccttggttcatctgctcttcccagagccccagcctttctcatgcaggctactgctgagccatgatgcatccctcccagtcctgcaaggttggctttcagaaccttggagtggggctttctcttggttctgcacaggagctcctatcacagcagcagtcagcatggcctgagcccccgggtgggaaataaatcagacagctgtgatggtaacactcccatttattgagcacctattatgtgctgggcactttgagggctgctgcagcacacagggaactttggtaaatgtaagaaagccttcccctctgggcatggaggatgggctcgatgcagccctgctcagcctcagctaagtgccctccttcacgcacaacctgaacagctgtcattggcagccctgggcctttctagtcaatatctcatttaatcctcacaatagcactatgaggtgtgttctgtttggactcctattttacagtcaagaaaacagaatctctgagagcttcagaaacttgtttaaggtcacctggctggcaagtgtgggaggagcacttcatactggacatctctgagggcgacttctgcccttgctgctgtatttcaccctctcttgccctcaacagcgaaggccaccctttgctccttagctaatttcccagcaattctctcccgctgttccggggcctgttatctttcattattgtattttgtagcttcctagattgttttatttttcactcccagtggctcgttgcttgggagcagctgagaacccggcagtggccctgctctaaacgcatcatgtcagatgcaagtttatctaatttacaatcggagttggcggcagcaccttgtcgattccatttcgagctaatttcctccctgatgatttccatggaggtggtgggctacttgcctcccggaatctctgccagccccagagctgggctccatgtgtctcacctggttgtgaaccctgggggcatcgagttgccctcagccccattgaaggggttatttatggcccatctcaggagcacgtggtggttaaggagcaaaacctcgtatcttggcaagatcttgggtttggaggcagaagttcagaattcaagtcctcttgctgccactgtttttctttttttcttttctttattttttgagacagggtctcattctgtcatccaggctagagtgcagtggtgtgatcacggctcactgcaccctccaactccttggctcaagcgatcctcctacctcagcctcctgagtagctgggactacaggcaagcacccccacacctggctaatttttttgttttttgttttgtagaggtggggtcttgccatgttgcccaagctggtcttgaactccttggctcaagcgatcctcccaccttggtctcccaaagtgctgggattacagatgtgaatcaccatgccactttcttgctatgtgatcttaggcaaattgcttaagctcactgagcctcagtttcttcacctgtgaaatggacaataatgatgcattgttttccttccccaagatggcaaagaaagaggaacactttgacaatagacaagttggtaaggatgtagggatgtgggaatcttcacacaatgctggtgggacaggaactggcccgaccacaatggacaacaatttgtcactgtgtatcagaaccataaatgttcataccccttgccccagcaatttcaactgggtttgtatgtgcacaagatgaacgcatgtgcacaagaatgttcattgcagtctcattcaaaatagagaaaaatgagaacaaacaaaatgttcattaatagggggacggctaaatgaattgtggaatattcattctatagaatgtgctgcagccactaaaaaggatgaaatgataaaatctataggagacaaatggattagacttattggcaagtgaaaaaagcagtgcttagaaagatagaagagagaaagatagaatgataagtataaaacaaaaacagaacaatattttgtattttcttaaacaaaaaccttttaaaattatgaattatgtatactggccagctgtggtggcttatacatacaatccccgcgttttgggaggctgaagtgggaggatcgcttgatgccaggagtttgagatcagcctaggcaacatagtgagacctcatctctatatatatattaaaaaacaaacaaaaaaattaactggttgttggctgggtgcagtggctcacatctgtaatcccagcactttgggaggctgaggcaggcggatcatgaggtcaggagttcaagaccagcctggccaatatagtgaaaccccgtctctactaaaaaaacatacaaaaattagccaggcacagtggcgcatgcctgtagtcccagctacttgggaggctgaggcaggagaatcgcttgaacctgggagttggaggttgcagtgagctgagattgcaccactgcactccagcttgggcaacagagtgacacttcgtttcaaacaaaacaaaacaaaacaaaaaacaaaaaaagaaaaatacaaaaattagctgggcgtggtggtgcacgcctgtattcccagcttgggaggctgagtcacgagaattgcttgaacccagaaggcggagcctgcagtgagccgagatcacagcattgcactccagcctgggcaacagagtgagactgtctcaaaaaaaaaaaaaaaattagctggttgtggtggcttgtacctgtagtcctggctacttgggaggaccacttgagcctaggaggttgaggcttcagtgagctgtgatcacgccactgtactccagcctgggtgacagagtgagaccttgtctcctaaaaaacaaaaacatgtatgcagaaaagtgcattaaaaaaagatgatttacgatttaatgatttatccctgattgaacctcatgtaatcacctctgaggtcaaaaataaaatattgccaccacccagcaactcccctcatggtcctaccagtacctcctacccccatctttaccctgagtcgtatccactatcctggtgttattacgacggtcaattccttgactcactttataattttgccacctaagcctacaaccctaaacatattatatagtataattttgcctatttggttttgtattcacattaacggaatcacagtgtattctgttgctgtgacttcccaggctaggtcacaaaaggcattgcaacttctggctgagtcttttggattgctggctctagggaagtcaggcaccatgctgtgaggatgctcaagtagccccgtgtcgaggcccatggggagaggtgccaaccccaactgggctatatcctggcatcttgctcaacattattttgtgagaccaatgccagtcattgctctgctatgtagtatttttggggacatgaatatgaatgtaaatgattaggaaaaaaaagggttagaaaggtacccaccaaagtgatgaggtcagtttgggagaggagcccagaggtagggacagaagagttctaaagagatttaggggtcttatctactatctgaatttttctaaaggagaaatgtattgatgcattatttaactgattaaattttaagagaaagaataaaatggaaaaaataagacctatttgctggagttcctgggaagacggaatgcattaacgtaggtaaaacctggagcccagagtaggcactcagttagagggagatgaatacaggtgaacacgaaccaaatgtcttttggaagtagccataggagcactatagtggagtggtcagctgctctggattggacagtctgtgttcaaatcctggctccactgcttagcagtggtgtgaccttgggcaaatgatttaacttctgtctccccaaccctgagttttaccatctggattagttatcacttgccacctgataagtctgtgtacttgcaccccttctgccttccaccatgattgtaagttttctgaggcctccccagaagccaagcagatgccccctcatgcttcctgcatagcccgcagaaccatgaactgattaaacctctttcctttataaattacccagtctccggtatctctttatagccatgtgagaaaggactaatacaccacctaacaaatcatccccaaatgtagtggcttaaaacagcaataattgctgattatttttcactgtttctgtagatcaggaatttgggagtagtttggtgggcagttctgggttgggggtctctcaggaggctgcagtaggtgtgagttgaagctgcagtcatctgagacttttgactggcactggagaatcctcccaaggggcctcacgtacatggctgcctggttggggctggctagttagctcctttccccatgaaccttgccacggggctgcttgagcgtcctcacaacatggcagctggcttcccccagattcagcaatccaaaagccctagcaagaagttgcaatgccttttgtgacctagccttggaatcacacactgccacttctgcagttgttggtcacacaagtcatccctgattcaatgtgacagaggacggcaaaagggcaggcagaccaggagatgaagctcaccaggggtcacagtggctggctgcaacaccccctctgacataaggacaagagtacccactttatagagtttttgtgaggattaagtgaatcaatccatggaaaggtacttagaacaatggttggcatattgtaaacttcagacgagcactagttatcgttattgtttcagaaatgctgccagacacatccccttcatgcattcttctgggtattactttactgcttaattttgcaaatgtagattggttctcagattccctggaatgacaccccttataacaatgatcatgaatagcagcgctttggagtagccgccagaactgtttgagccaccgcacaaagacggcaccctgcatagccattttgcatgtctgcttcactgggtggactgagtcgccaatgcccagcaagacagtagggccgattttgatctctttgggaacaggcattgagtctttgacttcaatcactcgccacatcaatgtctctgcgcgaacgaaggcattgatgagagagtggacttgctactttcaaacacagaacaggaaacttgaccatcttcagtgctttagtccaaggatctgaaactctagtgcctacaaggcgagacaggtgacccaagtttgggaagtggccaagggtatgaagaaccaggtgagcatgatgatagagcagcagctgacccctgaccttggtgatggagaaataatagggagtggtaggggctgtggcaaacaggagtgcacatgctctgtctctggggccactgttagaagtgccagcaagtcattgtctgcaagactgtggtctagcgtggcctaaatttctgctcccttctctgagtgctttgctgctgtggtccacaattacagtgaccctttggacgattgatgcttgagctgtcctgtaatttgcatccaggtgctaccagaaaggtgtcctgatccagaccccaagagagggttcttggatcttgtgcaagacagaatttgaggtgaagccatagaaagtgaaagtaagtttattaagaaggtaaaggaataaaagaatggtgactccataggtgtcaaagaatgagtactccaatggctactcgtgaaaacttattcaagagttttctgggaaaagtgtgggcaattcctgaaactgagggttcctcctccttttagaccatatagggtcacttccgggcattgccatggcatctttgaaccgtcatggcgctggtgggagtgtctcttagcatgctaatgcattataattagcatataatgagcagtgaggatgaccagaggtcactttcgtggccatcttggttttggtgggatttggctgacttcttcacttcatgctgttttatcagcagggtctttgtgacctgtatcttgtgctgatatcttgtgctcccatctcatcctgtgacttagaatgcctaacttcctgggaatgcagcccagtaggtctcagccttattttacccaggccttattcaagatgaagttgctgtggttcaaacgcctctgacacagggtgtacagtggctcatggacacctcgaccagcttctccctttagcatgaagggcccatttcacaccagagttccacccgagcagatcatggcagtggggagcatttgctgacttccttcatctgagaattgtccactgattggcatcatgaagtgtttcactctgtgcaggtcgcagctgggcttggggatcaaaggcaattcagagcatccctcaagcctctatggagaaaacagacatgtctcagcacttcatgtgggggcggcatgttatgggctccggtttccaggtgaggtggggtctgggttatttgactgatctcaggacatcaacagtgggactgatgcatctaacttgcctgggggtggggggaaggtggcattgtggtttcctgcacaatggccgttccctcttctttcttgttattcttccttgtctacctgacaaggagactgaaaagggaagctactttcctagcctcccttgaagctaagcagtggtttagtgacccagttctggccaatgcaatgtaagcaggactctgctgggggcttttggggatgtatttttcctcctgatggaaggatgtgggggcatatgagtgaagtctttctcaccatcctgaatgccccttatttcctgcatttggaagtggttgggtaaggatgtgatgtctggagctaccgcagccatcttgtgcctctaggagaagtctcagagaattgcagacttagattcctaatgttgttgagcaactggatcaatctttagctacctacttccagtcttcttgttatgagacagaactgaatgcctttattatttaagccactgttaggtttttattacagccaaaagttgcattactaatgttacaggcagtgtttgaacaacatgttctctgatggtatggagtggaaaattgggtgctccttaaataccgataaaggcttgaattttgttgtgctggctctatcatatttctggggctattttctattttttaaatctctaaattaaaaaagtgaaatatatcacttataaaaaagaatgtttaaaacatatctgtatagtctaagaagaataataaaatacccatgtactcaccacctaaggattagaacattaccaagtcttagacattccttgtgtgcccctccccatcacatcccgtccctccccaaagttaaccagtatccttaattttgcatgagtcactttctgccattcctgatagttttaacacccacataatcctaaacaatatgatgtttaattttgcctgtccttgaatttcatctaaatacatgcagactctacgcattgttttgtaagttgcttcttttgccctctgtgttgtacggtatgtttttgagtttgtgcatgttgatgtgtgcaggactgcatctgttatttccacggctgcgtagtttttgttataaggctctcttgcaggttgtgtatttcttctgcggttgacagacagttgagatgtctctcattcttttgccatcaccaacccgtctgctctaaacattcttgtccatggctcagggtgccacagggaagagttgctctggcacggattcctttgaatggagttgctggatcacagggaaagacgtattactttcattagataacgccaagaagttttcccaagtggttgcacctacttatcctcacacagtagtgactgaatgtccgtgttgcccacgtcctcgctgacatttggtcctgggtatgttctgttccgaatgtccctctgtccctgccaagttgacctctgacctttgaagatgcctttccctgtgtgtcattacatatcagcatccatacttcttcaaacagtcaccccagaatgatgctggggtcctgaaataaggccattatctcagtcctggtctttatctttgggttcaactgattttggagtttccaataaggagaaaaaaaccaatttgatattctcagacatcagaactgcacctgatttgattcacaagacagtgggaacttttcctgaaggtcagcatccaatctctctcccttggttctctctgcctctgcgttttgtataatcaaccctaaaggcggaggcaagatctaggattctcagagttgcacattgcagggagatgagcatgctgtggacattgtgggggaggcaagcggatttggaaggaggtgagaggactctcagggctctgatgatggaccttggacagatcatttaacctctctgagcgtcaatctccccttctattaaaatggggatgacaccagtagataattgtgcagagagggggtgaataagtcatttagcacaatgccgacatgcagtaagttctcaataaatgtcagcagctacttttagtagcagttctcatctgcatagtgttttggtggggttgagaaaggttccagacattattgctaacattccatacatgcattcctataaaacctcatgatctgtaaagtcgtgggctaataagaaagaggcttatgagaaaaatagagttggggtagatgaccccgaacctagggaagattgcactaagctccaaactagctaacaaaatcaataacaatcttaataaaatctgagcacgggtaaatccttgagggcatttgtacccagccacacaatcaaacgtttcagccttcaaccctcagcatctgcttcctcctcagagatgtaggtccaggaggacatttgcttctaatcacgatcatttttatccacattaaaactatgattggttccaggtgcagtgtggctcatgcttgtaattccagcactttaggaggctgaggtgggcagatcacctgaggtcaggagttcaagaccagcctggtcaacatggcgaaacccatctctactaaaaatacaaaaattagccgggcatggtggcatgcacctataatcccagctactggggaggctgagacgtaaaaatcacttgagcctggaggtggaggctgcagtgagccgaggctgtgccactacactccagcctgggtgacagagcaagactccatctcaaaaaaacaaaaacaaaaaactgtgattgaaagtgtagcctttgccactggcctattgtttcagcagaggtgggaaggactttgtagcttcttcatctcaatttgccatatccccagattatacagcccagtggcagcagagaggttcttgaaaccacaaatccggccaccactggaaccaagctggtaccagaggcacttctgtagactccagcttttttcttcagtttttcaagtcctgataaggatatttctttaattgtacttgttcctgactacttaaaaatattaatgtgctggagaaaatcttgtatggacacactttcctcattatttcaacatccttcccttacatactaatcatgaatgaggtaacctgggtcaaaggagcctgccttatagcaggatagactgtgtcctctaagagtctttcagcactgatgttctacaatggggtttggcaagctacagcccagggaccaaatccatggtcctttattttttgagacagggtcttgctctgtcatccaggccagagttcagtggtgtgatctctgctggctgcagccttgaattcctgggctgaagtgatccttccacctcagccttttgagtagctgggactacagccatgcaccgacacagctggctaattaaaaaaatttttttgtagacaggggtcttgctatgttgcccaggctggtcccaaactcctggcgtcaagcgatccttctgcctcagcctcccaaagtgctgggatcacaggcgtgagccgctgtgcccagccccatcccacattagatatggtgttgcccagaccctcattgtttagccatgttttggcccaaggaggtcaaatttcctggttccttgcccaggcaaagaaggcactctctgcctttaagacttttgtctctgggaaaccactgagctcagatgtaaccaactggaaattgatttcaaaagcttcaacagtggactctgtcccagccacatgggactgcaaggactagtagttacaccagtgcctcctctcaaagctcacaacctggctggggcagggcaggggccaggttagtactgagagcagctcctttcccgagaggacaagacaagcatatttctcacttgctttagaaatgcaagaaaggtttattataccaaataggtattcattgccaaaagatataacagcccagtgggacaaatgaggctggcacggtggttcatgcctgtaatcccagcactttggaaggctgaggtgggaggattgcctgagcctaggagttcaagaccagcctagacaacatagtgagaccccgtccctaccaaaaaaaaaaaaaaaaaaaaaaatagcgtgcctgtagtcccagctacttgggaggctgagatgagaggattgttggatcccaggagttggaggttacagagagctttgattgccctactgcactccagcgtgggtgacagagcgagaccctgtctcttaaaaaaatgaaaattaagaaaatgactcccctttccgtgtgcttatccccactcttcagtttagtctgtatttttccagttgttttctctattatcaaccgcatacctatgtaaagagatggaagcagagaggtacagttctactctctgctttctccccatgacaacataactgaggcatgttcccgtgtctgcacgtgtggatctgcctcgtgctcttcaataactgtttattagtatgtcctcccatggatacacctttatttattcagaatacatacttcctttcagcttagtgcaaatgtcatcttcctccaggaagtcttccttgattcttgcagcacaaaatggccacttcctcctccaaactcctaggtccctgtccctttctcaggctctagatgagtcagggtaaggctatgctgctgtaacaaagagatcctgcaatatggaggcttgaagaacagggcagctgtttctctcttaggtcgtagtcctggttggtggggcagctctgcccctgccagtcattccaggagccaggctccttccaagtcattgctctgtatgccctagggcaccctggtcgttgtcagtgtggctgaagtgagccacataggaagccaggagatgcctgatgtcttcaccctgacacggactgtccattcacaagccattggcaagagctttgcatggccatgcctcctgtctgggaggcctgggtgtctgcaatgccatggaagaagagaaaccagctttggtgtacaatcgctagtgtttgctattatacaaaccttgatgccttaacgtggcgcttggggtccccatgctgtgggagatgaaatgctgagagagcaggatccagggctggtccatcttcgcatcttccttcatgtcctgtgtggcacctggcacgtggtcagtgcttggaaaatgccaagcccatgtgtggacgtacagtcaccaaatcagagagtggtgggcaacagggtctagtaacatttccctgccaagcactgttctgggccctgaagacccaaagcatagttgctccacccccaaacattatagtcatgatctctttgggtttctggaaaaggagattctcttcctgtggcagggcctttgcacatgccatctcttcctcctgacacccacctccctctgctcgccagctctcctcacttgcctagctggctcctactgtataactctccataaatgttacctctcccagactaggttggctctctccattatccacatgtgtattatatttctcccttgtaagtttttttttttttttgagtcagagttttgctcttgtggcccaggctggagtgcaatggtgaaagctcactgcaacctccacctcctgggttcaagcgattctcttgcctcggcctcccaagtaactgggattacaggcatatgccaccatgcacggctaattttttgtatttagtagagagagggtttcaccatattggtcaggctggtctcgaactcctgacctcaggtgatccacccgcctcggcctcccaaagtgatgggattacaggtgtgagccactgcacctgggcacttgtaagttttataaattgcattgaagtaactttttttttttttttttttgagagttcttgctctgttgcccaggctggagtacagtggcatgatcataactcactgcagccttgaactcttgggctcaagtgatcctcccacctcagcttcccgagtagctgggactacagatgcatgctgccaccctcgataattttaatttattttaaaaattttttcatagagacacggtcttgctgtgtagctgaggctggcctggaactcttggccttgagtgatccttctatcttggcttcccaaagcactgggattacaggcatgagccaccatgcccagccagaagtatctttttttttttgtataaaatttcatttcaggtcaatctgcactctaagtttgtaagctctatgatgacaggtacagttttgtgtgttcagtgcctagcagactgcctggcccaatagacattctgtctacacatgttaaatatttaatcaatattatcaccggttcaccacggatgagaaaatggaggctcagagaggttgagtgactggcctaagatcacacagcaagtgagtttcagcattgggattttgggctgcctccagagctgctgctttcacaggctaatgcaattagaataccacatgatgtgtgccataacagggtattaataggctgtgtttaaggggtggtgggagggcagaggggggcgtgactgactcagcctaggggaggggtggctgcctggaggaagcagtgaccttgggggctcagaaaccgtggggcatttggagcagctgtagcgactgcgtgggagtatgaaatctgagaccagagcagagctggttgtgaagctcctgcttgggggtgtcagggagtttggacttagttgagctgaggggaactctcagagttcgtaagcaggggagtgacatgatctggtgggttctgtttagaatgtcaccctaggtcagggttgcaagctgacggctgctggctggcagagttggctgtgctcactgggaatctgaaaatggaatccgtggcaaactgcattagttaggagttaagtccaactgctgagccaaatacccaaaattatagcggcttaagcgaaatagaagctttctgtcctctgtcacatgaaagtctgaacgaatcaggcatctcagctctacttcaggggcccagaatccctctagacagttgctctaccatcccaaggcactgccctggtccacatggtcctcgatggccgtgaaggcacagaaggaggaggcagatggacattggggccaaagagcagtctctctcacttcaaacttgaaacatcaggtgattccacccaaaaaccagggttctgacttctcttggacgacaggaaggatctagcaggactgggccacacatggccacgactgactcgatctggaccatgtctgcctctttcggatgggcccatgtgctccagttcatcacggtcctcacactcccttttgtccctgaccgccgaggcagtgtgtccattgctcaatcctcttacaccagcccctttgctcagtttcatgaccctgtagtccccaaagcatgtgagctcacagcccccaacccagggcggaggatgccctgcaggcggctgggctgggaggctctctcgggcagtggcggctgtcatgaggcaggactggcaaggaccaggccaggcccaggctctttgctgagaacatcccttcctttcttccttcatcctggtgaacacagttccaacaactgcctctgcctctaaaactcgtagactctccaggggaaaccttgttggaaatcagggcgaggttcttttctaaacagccatctgggcgtgtgtacagggctgcctttcattctcctgggagctcttaggggcatccaaggagtgcagcctgcccggcagagccccgacgacccatcagagcccctcctcagctctaccctcaggctcccaggcctgcttgaccaccctagaaaaggctgaggctggcacaggggagacatcatgtaactcaggatgctgatcaaacttcctgtcagaggcagttgcgggcggctgcatttgaattttgcaatcaccgtcctgtgggagttctagatgacacgctccccactcctgctgggcaccagttgccaaggaatgatttccggtggagggatgtttggtgccatctttatccattattcctgacccctggcttccatcacggagactccatcaggcaggaggagggatggatggcttctcctgtcagaggcagatgtgaatgagtttactggagctggggagcaaagaagtttgcttccagtgggtgcaggtctcatggagattgaaggtccctgcaggctggaaatggccttggcacggtggcacctccagattgaacagcacttttttggtctgcaaatagctctcccgtattagtccaatccaatattttctttctgacctgcagcaatcagagggggcctctgtgtcccccttggggactaggtaccttttagcaaaatccccccacagtgcatgctgtctctagggtccaagccttccgctaaccctaacctgcctctgcatttggggtctgggtttctggtggttgactccctcctgaatggggtagtgtcaagataagatgctgccccttcttgggtttccatagagacaaatccctctcaaagagcgtctgaggattttgctgactttactgaagatccgtgggaggttccattgcacagtgcaggtgacacggtgcatctggcatcctcctggcccctcttccttctacctgatttcccaaggagttcccggtgtctcttcctcacgcgtgcaaagccgcttccctctcccctgaagcctttcctgttggcgccgatatacaaccttgcaagcgtgtgtgtgtgttttgcgggtgtgtgtgtgtgcatgaggacattggggcacttgccttctgcactgaagctcttgtcaaaacatttttctccacaaagtcatttctgtcctcaagaggaattctggtgccagcagctaagataagacagtttcttcacttgttatgtggctaacagctgtgaagtgggctgaagcagttaagtcataatccccattttacagatgaggaaactgagactcagagagaggcagtgactccctcagggtcacccactgtgggactccgttctaggcttgccgacccaaggccagtgccgtttccactgcatccctgcctcatggaagcctgtttgctggagtttggtcctgagtttgcttccatggtgagccttgcctggtagggccagagacgggggtaatgacacagcacgcatttactcattcaccaaataggtaatgagcccgcgccctgtgctaggcaccagatactcggtaatcagtggtgagtgatacagggactctgccctcgtggaactgatggtccagtgaggaatcaggtgagcacgcacacaaatgcatgtgttcccacaggcaggctgagtgtcactgagacaaatccatcagggtctggggtaagggcatgcagggggggcaggggtgctattttataatggggggtcaggaaggccactttgagggcacaagctccaaaggtatctggggtgacagagcaagcaggtgcaatgtctgagcctggacagtgtttggtgtgtgcagggagctgcgaggaagccacagggtctggagcacaatgattgagggagaaggtcggggaaagagcagggaggagaacaggcatctcatatggggcacctgcgctcagaactgggcagttaaaacagtactgatgtggccaagcaccgtggcttactcctgtaatcccagtacttcgggaggccaaggcgggcggatcacttgaggtcaggatttcaagaccagactggccaacatgacgaaaccctgtctctactaaaaatacaaaaattagccaggcgtggtggcgggtaactgtaatcccagctactctggaggctgaggcaggagaattgctttaacctgggaggcagaggttgcagtggtccgaaatcccgccactgtactccagcctgggtgacaaatcgagactctgtctcaaaacaaacaaacaaaaaagttctgacaactgcaccccactttctggacattgcttctttctaaaagcccctcaggtaactcaaatgtgcagtgagggccaagagccactgggctagggccctgccggccaccgtgaggacttcggtttcattctaagtgtgatgagaagtccttggtgggcaggaagggaggtgatgcaatctgacgtacttttctagaagacctccctggtgcctgggttggaacagatggaagggagtgagaggggaggcagggaggccatgaggaggctgctgcaatggtctggacaaggggcagcagtggctgatgatggaggcagccttggccaggtgtcatgctggacccctcttaacttcaggagggatggcacaaggttcaagaggccaaggaagagacctggagccagcaaactaaacatagagttttgccaggcgtggtggcttatgcctgtaatcccaacactttgggaggccgaggcgggtggatcacctgaggtcaggaattcgagaccagcctggccaacatggtgaaaccctgtctctaccaaaaatacaaaaattagccgtgtgtggtggtgcacacctgtagtcccagctactcgggaggctgaggcaggagaatcacttgaacccagaaggcggaggttgcagtgagcggagatcatgccactgcactccagcctgggtgacaagagactcaatctctaaaaaaacaaaaacaaacaaaaaccatacagtttatttgggggaacttacctacagggtgctccagtggcgatgggctggacagaagaacaacggctcgtaaaatgcgtgcagtttctatagtactttcacttaacacccttggtctggcaatcctcatttcttaagtcaggtgtgtctgccatacagggtatgcttaagttgttattgctgtcaattgcatctgccatacaccagggtcctcagattaccacaaactcagtggcttaaaacaacacaaatttaggctgggcatggtggctcaagcctgtcatcccagcactttgggaggctgaagtgggtggatcacttgagcccaggagtttgagaccagcctgggcaacataggaggacccccatctctacagataatttaaaaaaattagctgggtgtggtggtgcacacctgtggtcccagatactcaggaggttgaggtggcaggatcacctgagcctgggggattgaggtggcagtgacctgtgatggcaccgctgcactccagcctgggtgacagagcaagatcctgtctcaaaaccaaccaaccaccaaccaaccaaccaaccaaccaaccaaccaaccaaccacacacacatgcacatttattctcccacagttctggaggacaggagtctaaaatgaaggcatccacagggctgcactcctgggggcttcagggaggaggtttccttgccttttccagtctctagatgccggttatactccttgtctggtatctcctgcatcttcaaagcccgtcactctaacctttggttttgtaccatcatatcatctttttttgattctctggcttctctcttatatggaccctggtgattacttcggacccacctggataatcctggctaatctccccagctctcgatccttatcttcatcacccagcagagtcccttttgccaggtaaagtaagatatcacagattccgaggattaggacgtggacttcgtggtgggggcattactcagtctctgacagtcagggtcccctctggagtggtggaggggcctatgggtggagcctggggctcccttatctccctgggggctctcagtgtctccctgaccaggcgcagataacccctggctttttttgtctgcttttagatgctgtgccagctgcaaaggccagtgtgtgggtcccactcctgttcccgaggggtcctccaggtgggccggcctctccatggttgctagggtggctcactacccctagggtgcactggtgtccacctggtctcccaccggagggcttggttgaccagatcacccactcccatttgcctggcattttcagaatgtattagttttctgtgggtgctgtaataaatgaccccacaaacttagtggcttaaaacagcatacatgtattatcttacagttctgcaggccggaatccaggacagtctcacccacctaaaatcaaggtgacatggggcaggcgcggtggctcatgcctgtaatcccagcactttgggaggccgaggtgggcagatcacttgaggcaaggagttcaagaccagcctggccaacatggtgaaaccccatctctactaaaaatacaaaaattagccaggcatggtggtgtgtgcctgtagtcacagtcactcgggaggctgaggcacaagaatcccttgaacccgggaggcagaggttgcagtgagccgagatcacacctctgcactctagcctgggtgacagagcgagactctgtcttaaataaataaataaataaataaataaataaataaataaaatacaatcaaggtgttggcaggctgtgccttgttccggaggctctaggggtgaatgcattttttgcttattctgattgttggcagaattcagttcctacagatggtaggacagaggtccctgctttcttgctggctgcaaacgaagggctgttcttggcttctagaggtcaccctgttccttggctggggaccccccaccccgtcttctccatcttcagagccagcaacagcgggctgaatttttctcacctggcttctccctctcttcctgcagctggggaaggttctctgctattatgggctcatgatgacattgggtcaacttggataacggatcatctccccatttcaggggctacaaccttaattacacctgcaaagtcccttctgttttgtaaagtaacatatttacagcttccaaagattaaagcgtggacgttttagggggctgttattctgccgaaatgcacccaataataacaaaacaatgacaatgtaattaatacttattaagcctttattctgccggtctctatgcctggctcctcagaatcacctctgaggaaggtactattattatgcctattttaggaataggaaactgaggcacagaggaaactgaggcacagagaggttaagggatgtgacaggttgaattatgcccctccccccccaccattcatacgttgaactcctaacccccagtacctcagaatgtgaccttatttggagcgaacgtttttatagacataaatcaagttaaaatgaagccctttgggtgagccctaatccaatatggagtatgtcctcctaaaatggggaaatgcagaaatacaaacccttacagggagaatgccatgtggatgggaaggtggcatctacaagtcagggagacaggctgggctgtaatcccaccactttgggaggcggaggagggcagatcacttgaggtcaggaattcgagaccaagctgaccaacatggtgaaacccctgtctctactaaaaatacaaaattagccgggcatggtggtgcatgcctgtaatcccagctacttgggaggctgaggcaggagaatcgcttgaacccaggaggtggaggttgcggtgagctgagatcgcaccattgcactccagcctgggcaacaagagcaaaactccatctcaaaaaaaaggagagaggccggaaacagatccttcccccacagccctcagaaggaatcagccctaccaacctcttaattttggccctccagccttcagagctgtgagataggaactgtctggtgttcaggccacctatttgtggtgctttttatggcagtcctagcagactaataagtgtaacttgtcattagttgtggcagctgggttcgagcccaggcagtcgtcagtctttggctctctggctgtttttgttgtcacgtctgtctccaactctctccattttggtctctttgtctctgatttactctgttctgatttttttttctctatcttttatttgtttatttattttgagacagggtcttgctctgttgcccaggttggagagcaggggcgcaatcatagctcactgcggcttccacctcctgggtttaagcaaacttcctgccccagcctactgagtagttgggattacaggcacgcaccactttgcttggtaaatttttgttttttgtagagatggggtctcattctattctgttgccctggctggtctcaaactcatgacctcaagcaaccctcctgccttggcctcccaaagccctaggattataagtgtaagctaccctgcccggcctcctttttttttttttttcctcactcactctccccttctctctcccactgcttctggctctctggatttccgtccttctctccttctggccctcagctcctattgagacaggaagtccctcacctccttcctctcagctccctcatccccctccagccactgttcctcccaggacacccctttgcaattaaactgtggatagaccaaggcccagatgccagcatccctggatgcccacaccggctgttcttggggccttggcggcaagggagcagccagcactgaggagagtgggcagagagctaccctctctgagagcggaggcctctgagctgcaggaggagccaaactcagcccccactcaccaccctgtgggctctctcctgccccctccaccctgctgtgcacacaggcgcctcgggctgagtggccgtcagcccagcagccccagcaggcctggctggtgcgtgacactcacagtgggcaccagcagctgtgccgcccgtgtcatcctgccacactgactcttctttttctgctcctggttcctggcttcaagcttttcagagcagtcttcctgccctccaaatcccagcctccatctttctgggtttgactttttccctttgttgcccctgcttctggggtccatgttgccctgagtgggaaactcccaactccctaaggtccgaggaaccctgtggtctggccagccctggcccctggttgggttgggggtggggattgagatggagacaggatggaggaaatcagggaaggctgccagggggaattctgggaaacactggggaacggacactttggagagacctggccggcccagttcttctcctctgggagcttccccaacatcagtcacggccatgctggcaaccacgttttcctgcaaggccatgatttacccggccatgctgattggccactagagctggacatgtgacctgagctgggccaattggctcctctgtcctgggagtttggaggactctgggaggtgggttggcttctgtagggctggtcacagggacaaggggtggaatgtttgagggaggcaggcatgtgttcagaggagcagagaggggctgagacagccagagagaggttgcccagctcccatggctcccgtcccctgcagtccctgctgctgggttcagcgagatgcccgtgtatccttctgtgttaacaagcatccattctcaagctcctgtgagtgggttctgtcttttgcagccgctcagcctccagatagcgcttttaagaatgcaaatcagatcacagtgctcgtctgcttggtgccctcagtggcttcccagagctgcagcatttctccttaaggctgccccagcacgaggctgagcaatctggccctggcctctcccattgtcccaggactcgctcacaacagcctctttgctgtttctccagcactccaagttcattcctgccccagggcttttggacttgctgtgccttttgcctgggatgctctccccctggatctttttttgtttttctttctttctttcttttttttctgagacggagtctcgctctgtcacccaggctggagtgcagtggtgcatctgggctcactgcaagctccgcctcccaggttcatgccattctcctgcctcagcctcccgagtagctgggactacaggcgcccgccaccactcctggctaatttttttttttttgtatttttagtagagacggggtttcaccgtgttagccaggatggtcttgatctcctgaccttctggtcctcccgcctcggcctcccaaaatgctgggattacaggcgtgagccaccgcgcctggcctctttttttctttttaatttgttttgagacatgatcttgctctgtcacaggctagagtgcagtggtacactgcaaatacagctcactccagcccccacctcctgggctcaagccatccccctgccttagcctcctgagtagctgggactacaggcatatgtcatcatgcttggctaatttttaacatttttgtagagatgggatcttgccacgttgcccaggctagtcttgaactcctgggctcaagtggtcctctcgtgttggtctcccatagtgctgagattataggcgtgagccacagtgtgtggccaccccctggatctttacatggccagcttgtcgtcatcaggtttgagctggaagtgttctctcttgtagaaaaggccctggtcagcccatcagagaagcctcgctcaccctgttattccatcacagcatcctgttttattttattcagggcacatatcaccatctgttgtttatttatttgttgacttgtttacatctgtttctcctgctggaatgaaaacatcacatcttgcgcaccactgaatcctcagtgcttccaacacagcctggcgcgtagtaggtgcttaatgagtatttgttgattgaatgcaaaaatgaggcaagatggcccagagttagactgccaggagtttggccaggtttgctggaagagagttaaaagcccatctcgttcttcccacacaggaaccccattcttgcctatacataggctgctctgcccttgtagatgataatttgaaggttgccaagcagcgggtggagaccaggctgccaggctgcacggagtggtgatcgtagcagaggtgactcagttctgcctgggccaaccttgggcccccttctgggctgatacatactctatccactgggccagtgtctgttctttctctagagggccacaaaatgatctttccaggaggaaccccatttgtcctacagcccttcagtaagggactatgattcacatcccccaagatcagaggctttgacctgggagagggcctctggtctaaaaacaagccctgttttgggtaagctggtggaggagacgatttcacgtgtgggtgaattgcctttcgtctgcctctctctgatttgtttttgaaaattcattgtatttattagatgtgccatcacacaatggtcccttgacatatttcatgctgtaaagagacagcccctgccatcaagctgtacgctgtagctgacaacactgtgtgtcttgtgcatactcacgcatacacttccacgtgggcacacgctgttgtcaagcacacagacgtcacaggctggtgggagcagccctggggttgaaagacccaggctggcgttggctgtacctctcctccctttcctggaaaaatgatggcaattctgcactatctatgtgaattggggaagaaagcagcatggacagataaagtccaggatcccagtcgcctccctggccaaacagaaatggctaaccagccagtggttttgagggatgggagttcagcaaacttttcttttccttttttgtctgctggtggagctgctaatgagtagaacgaagcccacagagggagggggaagcagaaagcctgagcaatccactccctgaataatcagccctgaataattgagaattgacttgtaattgcaattgtctcagtgtggagatgctgacgctagaagatgaggaacaggcaaggagaatggtggggtttggaaagagggcgttgactctggattggttcctggcaaagcaatggcgggtcaaggggaaattttttattacaattttaaactacaaggtcaaagggctaacactgttgggggaaggttgtaggaggaggagaggagagatgtatccaggaaggagcagtatttcttcccagacagtaaacaactaccaaataaaccccagaaatgacactctgagagtgtctgtgggaagcttagagagctgcttgtccggcaagaggtattggttttgttcaagcttcatctggtgctcatttaaaaaaatagatttcatttcccctcttgcaccagtctggaggggaaaatcagcacgtaacatctgcctcatgtcatcatttagatgcttataaataaatggattctggcaggactaagcaaatagatagtaaaatgcaagacccagccaactcctgattagctcttcgtggattatctgctgggggatcgtccagaggaaatgtcccatcccagggtggagtccttctcgccatgcagcaaggtcctaggcttcactctctgaggtggcctaactttttatttttacttttattatctttagcattatttggtagagacgaggtctcactatgttgcccaggctgatctcagaaccctgggctcaagcgatcctcccaccttggcctcccaaagtgctgggattataggcgtgagccactgtgccccgctgtggcctaacttttgagcgcacagaatgtcacatgtgagcaagtaatggttaagggctggttctatgctgcagacagatctgaggttgaactcgtctcttacacacagtagctaaaaggacttgagccgtgtctccattcctctgaacctctgtttcttccactgtatgatgaggaagatgatgattgcagctgtgactctatgcttatcagtagccttgagtttctctgcatttcccagcgtcctttgcacttggaatggccatgtgactagtctggccaatgggatatgagtggaagtggtgggctgaggtggacaaatatactgtgtgtcctccctctactttctctccctcatctgtggtgcagctacaccataaaaggagcctggatccctgattcactgcatggatatgagtcattcaggagaagcagctaagaaagaacctttaagattttgaggtgtttgtaacagcagctagtattaactacccaaacaaatacagtagtactcccttgagaggtattgtgaagaattaagttagggaggcagagcttataagagcttagctaagtgccggcatatagaaaatgttcaataaatattaggtatgagtattaatttatttatgcagcaaatatttatagagttcccatgatgggccagggatgtggaataacaacagatgcataaaatcgtattttggattatgtattaaatagtgcactccatggtaaaatagaaagaatttggtcattctttccatcagtgattattattattgttgttgcagctcactgcaacccttgaagcctcccaggttcaagtgattctggtgcctcagcctcctgagtagctggcattacaggcatgcaccaccacacacaactaatttttgtatttttagtaaagatggggtttcaccatgttggccaggctggttttgaactcctgccctcaagtgatctgcccgccttggcctcccaaagttctgggattacacgtgtgagccactgcgcctgacccaatcattgattattaaatattaaaccctattatgctccaggcattgtgatgaatggtggggacgtgtggttgaatatgtccgttttcactcttaaattgcttgcaggctactgagagatgtacaagtaaacatataattcaaatgccaagtgacacgtgtcatatagagggacttttttaaagtgctggctgtgtcattaactctgtttgggggaaatcagagagggcttcatggaggaaggggcttttgagttcagccttgaatgtctgagtagcatttgggcagatgagaaagcatttcaggtggagggactggttcagagtcatgaagccttgggttgtttttttttttaattatttattgatttattttttaaaaacaaggtttcactctgttgctcaggctggagggcagtggcgcgatcacagctcactgcaaccttgaactgggctcaaatgatcctcctgcttcagcctcccgggtagctgggactagaggttcatgccaccatgcccagctaatttttaaatttttgtagagaaggggtcttactgtgttgcccaggctgcccttgagctcctggcctcaagcaatcctcctgcctcgacctcccaaaatgctggcattacaggcgggagctcccgcgcctggtgaggtcttgtgtttgatgagatgtgacaaatgctttggtagctggggatatagggtatctgtgctaggtagaataatgtcacccactccaaagatgtccacatcagtgcttgctctggcagcacacacactaaacttggaatgatacagagaagattagcacggcctctgtgcaaggataacacacacattcatgaagcatcccatatttttccattattctaagtgaagtaactctggaatagaaaaccagactctgtatgttcttacttataaatgggagctaaattatgggtatgcaaaggcacatagagtggtacggtggacatggaagactcagaagtggggaggggccaggcgtggtggctcacacctgtaatcccagcattttgggtggccgaggtgggtggattacctgaagtcaggagttcaagaccagccaggccaacatggtgaagccccatctctactaaaaatacaaaaagctgggagtggtggcgcatgcctgtaatctcagctatttgggaggccgagtcaggagaattgcttgaagctgggaggtggaggttacagtgagccaagatcgtgccgctgcactccagcctgggtagcagagtgagactctatctcaaaaaaaaaaaaaaaaaaaaagtggagagggtgggagggagtgagggatgaaaaactacatattgggtatgatggacactgcttgggtaatgggggcactaaaatctgaggcttcactgctacacaattcatccatgtaaccaaaaaccacttgtacccctaaagcactgaaataaaaaaatataaataataacaataaaaattaataaaatcaacaatagaaaacaagcaaagatgtccacatcacaaactttgtaacccaacccgtgactgtgttagcttacgtggtgcaaatggactttctcagatgtgattacattaaggattttgatatgggaggttatcctggagtatccaaatgggcctgacctcattccatgagtccttaaaagtggagaaccatgatggtgggcacatgtaatcccagctacttgggaggctgaggcaggagaattgcttgaatccagggagcagaggttgcagtgagccgaggttgcaccactgcactccagcctgggtgacagagcaagactctgtctcaaaaaaaaaaaaaaaaaaaaaaaaaaaagtggagaacacttcccagctgtaggcagagggagaggtgtgtctgtgaaagaagggagatttgacatggctggtttcgaatattgggaaccacgagtcaaggcatgtgggcatccaggagaaggtagaagaggcaaggacatgatatcttccctggagcctcctctaggggatgtggctgggcctacaccttgattttagcctagtgagaaccatggtggactcctgacctatagaattgtaagataaggccaggcgcggtggctcatgcctggaatcccagcactttgggaggccgaggtgggtggatcacctgaagtcagaagttcgagaccagcctggccaacatggcgaaaccctgtctgtactaaaaaatacaaaaattggcctggcgtggtggcacatgcctgtaattccagctactcaggaggctgaggcaggagaattgattgagcctgggaggcagaggctgcagtgagtcgagattgagccactgcacagagtaagacactgtctaaaaataaaaaagaaaaaggaaaaagatttataaggtaaagattttgtattgttttagccattatgttttgtttgtgttaatttgttacagcagcaatggaaaatgaatagagcgtctgatggagaatgtcaagagaccacactagacaaaagggccaggcagagttctgtagacttattctggatgagcagtgggtctcaaacttcagtgaggtccccacttttccatgtactactaatattctgtgtgaatattaattaataattatattctgagagagagtagccttgttcattttaatgggcatgatccttccataagttgaatgtatgtttcttatttaattaatggaaatgtaggttatttccagtcctttgccattaaaataaggttgcaatgaatgatcttgaccttgtgtaattttgcacacgtgtaagatgagttccaagaaatggaattgttgggttacagagaatatgcatctttaggagtccacattttccagaagtgtttgagggcaccattctggtgagagctaaaggcaattggaggttcctgagcagaattcagatatgggttctacaagtattcctgtggctgatggtgtggaagcaaggagtccagaggagaggctgaggcaatggacctagagagaaatgagtgtgagtgacagagagagagagagggcgctgtttaggactgggttggtatgggtgagagtaagttgattttcttgtgtgtgtttttatttatttttagatatggggtctcactatgttgccgaggctggtctcaaactcctgggctcaagcaatcctcccatcttggcctcccacagtgctaggattacaggtgtgagccactgtgcctggctgtgtgtgtgtgtgtgtgtgtgtgtgtgtgtgtgttttaatcagtacaggaacttcctaagacctgagaggtccttcttcaatggccctgggttgagagcctactggagccaggtgcggtggtacacgcctgtaatcccagctacttgggaggctgaggtgggagaattgcttgaggccaggagttcaagagccactgggactcgtgtccctcatgacaagtgaggcccactttgtgttcacgtgtcaggcctgaattccactctccattctcttctgcctggcccttttaaccttgggggagacaattatctttgtggttttgcagggaaaggggatagaagtgtgtccctgtggtctttaaacaagatctttctgatattaggtttcttctaagaaatacgtggtgaccacagttcttcctgcccctgacttcctgatttttggtgcttatatgatttttacagcatcgaggtgttccaactacaatatctccagttgtttcattttggttatgcgtttacatagattctttacccaccgtggggttttattatgatttctccattcttgggcttattttattcttccttggtgagctgtatttcaatgtcagctagctttttcaagaatggctcatggatactatattctccaagggcgttcgtgtctgagaatgtctgcctgctgcctttacacttgaacgtgcagttcatctttttgcagccttgctgggattatgttcgtgagtctcccctgaggagagccctgggactgtttctcccattcttctcgaggttgggttgagacccagtgctgcttgggatgcgtggtggtcccctgaacttggggatgctgtaggaagatcatgaacagaaaataacacaatttggagggggaaactttggctgccaatttcagggcagccagccagaagattatctctcttccctcgtatgtttgggatatttgtaactctaaaaatatccatggcagctgtgtacagctgcacaggctgtgcactgcacgattcagggaatgttgttcctgtaaaccacaatgtgaatggtgctccgttatgtgcaatgtcgtggccctgtgacctctcagcctggagtgggcctagaagcagagaattattttatctcagtgtttccagactttggctattttcatatcacctttattaatttatttctagccacatattcatcttctactatgattttttttattgactcacagtcttcttacaaaaatgaatgtaaaaggggaactttagatcaaaattgggagcggaaagccagtaaaactcaccaaaatagaagaaatatgtatgtgcacgtgtgtgtgtgcatgtgtgcacatgtgagcataaaagaaaaataatgccatcaaactctagctggatattgtggtctttctttctttttgaaacaggaagtattaggaagtattatcagcaagagttagagcaatgttaaagacaggcttgcagaaaactgacgttttcttttggaagtcatctgaagggttggaaaggaattagagggagaattgttccctatgacacaattcagtgtagtttaatgccacatccccccaccattctgaacccccccaagggacctgagaaaacactggcccagccccatcctccatgagctgcttgaatatcttggcaacatctccccttggtggttcaagcctttctcctatccttatgttacagtctcgccaatgcaccagaatgtagccgttgtagcagcctctcctgtggtatcacctggagttttttgtctcacgactaagaaaattaaggagcatggacacaaaggatgaggttgcagcaaaagtttaacaagcaaaagaagaaagctctcctgtgcagtgggggcctggaagagggttgctgtttttacggttgaatgcaaagccttttataagaaatggatgaggcctgggtgtctcatttgcataaggcatgaatttctggtagctccgccctgtcctcttagtgcacatgtgagcccttagcttgagttactgcatattgctttgttcccctttctgcacatgtgtcaggggacagaattttccattgcggacatgtatgggcaagtcatctgtgtagcctttcttatctgtgcggctgtgggcatgtcttaggcaagcccccatgtgcaagtttccttatctgtgcctgcaagctgttcttttgcttgaaagaattcaactaaggacccaccctaactgcctgcctgaccagcttcttcctttctcctctctcacttacactactggaaagtttaatgccatggcacaggggcttttttcgaggctgggccattctttgattatattgggcagagtccctctccttgggcctgttgagcctggttttactgtctggagtgcaatagaacagataaaatccttcctacaagttacattcctccaaatatgattgaaagtggggactctaggccaggtgcggtggctcttgcctgtaatcccagcactttggcagattacctgagctcaggagttcgaggccagcctgggcaacatggtgaaactctgtctctactaaaaatacaaaaaattagctgggcatggtggtgcatgcctgtagtcctgtctacttgggaggctgaggcatgagaattgcttgagcccgggaggtggaggttgcagtgagccaagattgcaccactgcactccagcctgggtgacagagcaagactctgtctcaacaacaacaacaaaaagcaagtggaaactctggagttagagtgcttgggccggaatcctgactcaggtactaaacctcactgtacttctgtttctccattcaaaaatgggcataataacagtacctctttcatatagttattatgagaattagacatatggacatttcagtagcacctggcacatagtaggttctcaataaacattagctgttattattttctgtaggcagggactgtagggacctcattccctcataccttcttctagttataaggtggaggatgtgggtcctaacttcagcttaatatctgactcatgatgagatctcaagtcacccaaggccctccctgggccatggtttctgtatctggaaactgagggtggtggactctgtgatccctaaattcctgcttccatctctagcagagctggataattgtatgtcaagggaggacagaagaggaagcgtgttctgcaatgagcagatctatgcaaacctatccccaaaggctgagggagccgagaggcccaagaatgaggctcacaaatctggcttctttgaaaaagaaatttaataggaacttagtaacagaagtggtatgtctggtggctgagagacagtagcttcccacacccaccctccagaaaatattcctttttttttttttgagatggagtttcactcttgttgcccaggctggggtgcagtgacacaatctcagctcactgtaaccttggcctcccaggttcaagtgattctcctgcctcagcctccctagtaactgggattacagacacacgccaccacacctggctagttttttgtatttttagtagagacgaggtttcaccatgctggccagggtggtctcaaactgtcctcaggtgatccacccgcttcggcctcccaaagtgcttggattacaggcgtgagccactgggcccaactgaaaatatcctttatctagcaagcctttagggtaaaacatgcatagctggtcacacctcaggctttcttgcaaaactcatcatcactagggaggttagataagcatcttgacgagggtcatctatgccacaggcattgcttaaagaccttgctgcaggagtcaaacatcagttatcatggaggtttcacttccagatggcgtcgctcttgccatgcaacaggctgttttcttacgctccacccctggaaacctgccctgacaatctcactcacccacctctcctgaggtagtccctgggtctggagagaagacgcttggtatggtatagatttatcagcagtgcattggcaatgggaaatagattgggcccagtaggattccaaaggagggagattcacagcctttgttgaataatctctagtctttggaataccatgattttggttttctcagaataagtaaaacaatgagagatacatagcattaataatttgaatagtagaaatatgggccaggcacggtggctcatgcctgtaatcccagcactttgggaggctgaggcgggtggatcatctgaggtcgggagtttgagaccaacctgaccaacatggcgaaacctcgtgtctactaaaaatacaaaagttagccaggcgtggtggtgcatgcctgtaatcccagctactcgggaggctgaggcaggagaatcacttgaactggggggcagcggttgcagtgagccgagattgcaccactgcactccagcccgggcaatagagtgagactccatctcaaaaaaaaaacaaacaaaaaaagaaatataatgcacacaaatactacaatcaaaaagagaatttgtatgccagaatgaaaaaaaacaaaaacaaaaaacagagaacctattctatcagggagcaaactaaaaacatcacgaagaaaattaaaacccagttctcctttagagacttgttgtagccaggaaataattcagcattcagtccaaattgtaggcaaataataaaagctcagaaacaactgtcaaggctggaatctaataacaggtgtgttatagttttcttctgaaagatagtttttctgtctccaattccccttttctaccaaagaaaaatcacagtaagacccagtttatttgcaaaataaattttagccttactgtacttggcccgattatttgcataaggtggagcaagactagcgattgaccacatagactctttttaagttggctttgctggaacttacataaggaattttgaattagacttttttttttaaattatactttaagttttagggtacatgtgcacaacgtgcaggtttgttacataccatttgacccagccatcccattactgggtatatacccaaaggattacaaaacatgctgctataaagacacatgcacacatatgtttattgcagcactattcacaatagcaaagacttgaattagacttttaaaggtctggatttaggaagccaagtcacagattcgtcatcaaaatgtgcctaaactacctgtatgaattgggtgaattcttttcttcttgaggtcccaaaatatcttgaggttcctggacctgctagaaagtgtcattctttatttatcacaggtcaggaatcttgcaagggaaccataagacaaggaactaggccagtctttccagaggaccttttattggctctattaagtcaacctcaattcctcaaagcagaatggtcatatctaaaaatacaccattctagtcaaaaccttggcataataagtatttccaatgtgtccagtggcaaaagaaaacgtattcttagtgaatgtatgttaataactatattataataaaataagaatattcatgaatagtttccaaattatggagaaattagagggaaatgtaaatgtctccattttgctcacaagtgtatactttgcccaattgctgtagatataaatagctcaaaagaaagaaaaaaatttctttgactctgaaaaacaaaacataaaaagaaacaacaatggttcaaacaaaaagtcataaaaatgatttcagtcctttattatttcagacccatgtgagtaattcttgttctgcttgatgttgggttagcaatcctcataaacacatcagctaattaagagccctggacgtttctactagcctaatggtatcatctccaaagttatcagaaacctgttattcaagatgacttgtcagggtcctttccatgaatttcctcgaagacaccacactttagggtttgcaaaaagcttttaggaaaaagaatcagaataaagcaattaactgcatataccaagacatatcagacatttaggaatttcctccaattttgggacacatattaataacacatttatacaaatacaactcaaagaaagttaaacaccatttcttatttgacaacgtttcccatataattgtttgtttttttttttttttagactgagtctcactctgttgcccaggctggagtacagtggtgtgatctcagcacactgcaacctctgcatcctgggttcaagtgattctcgtgcctcagcctcccaagtagctgggactacaagcatttgccaccatgcctggctaatttttgtatttttagcagaggcagggtttcaccatgttgggcaggctggtctcgaactcctgacctcaggtgatccacctgccttggcctcccaaagtgctgggattacaggtgtgaaccaccgctcctggtccgtataattttaacataacaaataagcctagtatatctctcttggcctttcaggggcctatttgttatgtctaagttagtttgggtcaagaagacttaagtttagaatttgaaatttgcttttgggaagtatgtcaaatatcaaaggttaaaacacttgatatcaaagtaagaaagctttaaaacactttatcaaaataggatcctggatgactgcaaaataatagtcatttagccaaagtgataactcaaagatggcaaaaagcaaaaacctttactctttgatagagaggagactgagttttccaaaaaatccaaagccctaataaagacagcgtgaaactgtctctccttctctcctttttttctttctttttctttttttcttttctttttttttttttttgagacagagtcttgctctgtcacctaggctggagtgcagcagcacaatctcggctcactgcaacatccgcctcccgggttcaagcaattctcctgcctcagcctcccgaggagcagggattacaggcatgcaccaccatggctggctaacttttgtatttttagtagagacggggtttcaccatgttagccaggatggtcttgatctcctgacctcgtgatccgcccacctcggcctcccaaagtgctgggattacagacgtgagccaccaggcccagccctctccttttttttttttttcttaattgcagttgactgaaaaggtaaacaaaataattttctctcttattaatatgtcataaattcttgtttaaaggagaaaatgaaaatttacttttatattagtgtattatcaatacaaaagctaattttaataaaaccctataaacaaatccatccaatttcagtcagctttggaccacacagataagattcccacaaatcctttataactgcttataagacttttttctacttttttcttacctcaacttttagattcatttatttttatctataccatttctccttcattttgaatcaacctttaaataacctctaaactagaaaaaattacttttccttcagcaaaaaccacaacctcatgtctttttaataacatttcttaacctaaaatacattttgctttctttatacactctgtatatagaattgtttctcttatatgtagtagtttaaattaccataatttcaactcctagtaagcttaatttccagtgaaaaacccaggaagtaagtaattttgtactgtcttatatcagtatttgtggatgaaaattatttcataatttttcagaaagatgtttccttaattttttgtttattaacagatatacttaaagtatataaacttaaacttgtgtttaaaagttaatattccagtatcttacctagaaatgactcagacattttatgatgatctgttactttatttaacatgacatgactttaagatttgaaattactgaaaggaatttgaaactatgacacgattatcttttccggttttttttttttttttttttttgagacggagtcttgctctgttgccaggctggagtgcagtggcacgatttcggctcactgcaacctctgcctcctgggttcaagtgattcccctgcctcagcctcccgagtagctgggactacaggcatgcgccaccacgctcggctagttttttgtattttagtagagacggggtttcaccatgttggccaagatggtctcgatttcctgacctcgtgatccgcccgcctcggcctcccaaagtgctgggattacaggcgtgagccaccacgaccagcccacaagtatcctttctaacgtcttccccagtcactctgggtcccaagtacccacgtggcacccagggatggctatgaaaggcagggcttgtctgggtcccgagttaacacaccaactataaagctcaaggcagaggacagagctgtgaagataatgtctgacccttcccagcacagccagggggcacagcaggggcagggagacctccacacatgtccctcagcctcaccatggccatttgcttagagtctagaatcgaatggctccaagacttaaattcacagacagaagcaacagttttatgaccttaaaacatccaacagagatagcctaaacccatctgaccatagacccaggcgaaaatatctgcattatatttaatactgataattctgaagacatttctattttattttatgaacaatttaaaaactttttttttttttttttgagacggagttcactcttgtcgcccaggctggagtgcagtggtgcgatcttgggtcactgcaacctctgcctcccgggttcaagcaattcttctgcctcagcctgctgagtagctgggattacaggcacctgccaccttgcccagctaatttttgtatttttagtagagacggggtttcaccatgttggccaggtgggtctcgaactcctgacctcaggtgatctgcccgccttggcctcccaaagtgctgggattacaggcgtgagccactgtgcctgaactgagaccaatttcattttagatggttagcttctaatttagtctccatctaccaactggaccactgagttcagggcggagcccattaacaaataggaccaacgaaggaattgcaatttccagggcctaatacttacagatgtgaaaagcaggtccagctggaaggcagaacacttaggtctccccaaatcaaggtcccacttttacactggatcctgggtcccccaaaagaaagaagcaccacggacagtgcaaaggacagtgtacctcactgcaaggacattctccccaatgctggtgggtaaccccgcaccagtaagtcactttgtgatcagcccatcccctgcaggagtcttatccctttgtcgcaagtgtttccatagcctctaggtatccaaatcacacttttctatctttttttttttttttttgaggcggagtctcgctcggtcgctcaggctggagtgcaatggtgtgatctcagctcactgcagcctccacctcccgagtttaagtgattctcattctcctgcctcagcctcccaagtagctgggattacaggtgcacaccaccacgtccagctaatttttgtattttcagtagagatggggtttccccatattgtccaggctggtctcaaactcctggcctcaagagatctgcctgccttggcctcccaaaatgctgaaattataggcatgagccattgcgcctggccagatcacacttttcttatctaaacatgcaaagaaaggagtagcctccctgcggcaataactctcgttgtaaacactgtcagccaccctcaaaatggcagccctcatcagtgacttgtcagccatggcacacgcaaaggtcatattctgtcatagtactaagtaatccctggtactcccaaaagcctcaaagatgggagaaagcaatgcaaaagagagcagagttttagaccacagagaaaccttctcatgactcttggaaccccacaaggaaggcagaagaccccaaaaagggggtgagtggcaccttttcctgtgttcctcaaggagtcgtgttagtctgtgttgttataatgaaataactgagactgggtaatgttttttttgagacagagtttcactcttgttgcccaggctggagtgcaatggtgcgatcttggctcaccgcaaattctgcctcctgagttcaagcgattctcctgcctcagcctcccaggtagctgggattctgcctggctaactttgtatttttttttttagtagagatggagtttctccatgttggtcaggctggtcttgaactcccgacctcaggtgatctgcccacctcggcctcccaaagtgctgagattacaggcatgagccaccgtgcccggccgagactgggtaatttatagagaagaaaggtttatttggctcatgattctgcaggctgagcggaaagcatcgtgttagcttctgcttctgctgagactgcaggaagtttccaatcatggcggatggtgaaggggaaggcagtgtgtcccatggtgagagagagagctagagaaagagaggaggaggtgcaggctctttttaaacaaccagctctcgagtgaactaacagaccaagaactccctcattaccatgaggacggcagcaaaccattcatgaggaatctgcccccatgacccaaacacctgccatcaatccccaccttcaacagtggaggtcacatttcaacatgagatttagaggggacaaacatccagactctatcagggtctcaggggcacaggaagtctcctctagattgattcatttggcttcaaagatagcaaaaggcaggaggagcagaagtggaaggaaatggaagagcaagagcaaaaatcatgccaacaagaccaggcatgagggctcatccctgtaattccagcactttgggaggctggggcgggaagactgcttgaggccaggagctcgagaccagcctgagcaacatggcaaaaccccatctctacaaaaaatacaaaaattagctgggcgtggtggctcgcgcctgtaatcccagctactccagaggctgaagcagtaggatactttgatcctgggaggtcgaggctgcagtaagccatgattgtgccactgcactcaagcctgagtgacagagcaagatgctgtctccaaaaaaagaaaaaaaagaaaggaaaaaaataaaaattataccaacagaaaagacaccaaacagagggatcaaatgtaatttttaaaaaggtgtttcagtcgactgaaaaaaaatgccagaaacaggataaaggccttcccctatctagaaaaaaaattataacctgaatattagcttctaattaagctgacttctgactgtagagctctaaaaaaaacttctttctaattataattcctcctcaagccattttacttttgcttctgttgctagctgggcttccgtcacccaatgggcagcccacagaagcagtgatcctgacatttctggggcatccttgtactcatgccatgggccaaaagtgtccaaaagatgagccacaccactccacatagaagtggctggctaccctgcgatgtcccccatggatgcttcattccctctgcccatttcttggtctctcggctcctggctggattgctacatgttctgcagtgagcaggcctatgcaaacccacctccaaggtccaagggagctgagatgccaaagaaagaggctgacaaatcccgtttctcagagagaaacattaataagggcttacaaacagaagtggtgtcttgcggccatgcaacagtggattcccgcaccgacctccaaaaaatatcctttctctagcaaacttttaggataaaaaccatgcgtagctggtcacacctcagactttcttgcaaaactcatgaccactgaggatgttggataagcatcttgacaaggggttatctatgctatgggcattgtttctctatcaggggttatttatgccacaggtgtcgtttaaagaccttgctgcgggagtcaaacattgttcatcatggcaatttcacttcaagatggtgtcactcttgccatgcaacaggctgttttcctgcaagctgagatgcagataatcatgggccacaatctcacagtgtcagccatagaatgcctccaaaaaaactccccagtatccctgccccccattttgatttctctttcaaagcatgctcttggagaatgagatagggtaactgaggagggaggattgcttgagcctaggagtttgagaccagcctgggcaacatagtgagaccccatctctatatttagaaaaagggcagaaataagactgagataaggggaaaatatttgccttgctttaaaccaaaccaaacatatgggatgacattacaaaaatcacaattctttaatttatcaagcttccctgaaactgagtccttgtcctgcaccacgtgcctcacatgtattacctcatttatctccagctaccctatgtgtagggcagcactagctgctgtaacaaataagccctgaaatgtcaatggagtaacagtagaagtttattttcttttattaatttttatttttattattatttttttgagacagagtcttgctctgtcacccaggctggagtgcagtgacatgatccgggctcactgcagcctcaaactcctgggctcaagtgatcctccttccttagtctcctgagtagctgggactacaggcatgcaccgccatgcccagctaatttttgtattttcagtagaaacagggtttcaacatgttgtcccagctggtctgaaactcctggactcaagtgatcctcctgccttgtcctcccaaagtgctgggattacaggtgtgagccactgtgcccagctagcaatagaagtttgtttcctgctcatgtaacatgtcagcacaggtggtcctggtggatggcagttctactctacatagtgttttgggatgatatggtttggtaatttgtcccctacaaatctcatgttgaaatgtgatcccccatgttggaggtggggactggtaggaggtgtttgggtcatgggcgtggatcccttatgaatgacttggtgccctgcccacgacaatgagttcatgcaagatctggttgttaaagaaactggaaggtcctctcctctctcttgctcctgctctcaccatgtgatacgcctactcccccttcaccttccaacatgagtaaaagcttcctgaggcctgaccagaagcagagcagatgctgataccatgcttatatggcctgcagagccacgagccaaataaacctcatactctataaattacccagtctgaggtattcctttatagcaacgcaaaatagactaacccaggggactatgcaacttccaaattgttccatttcatggagccttagagccctttgcatctaggtggaagaggaaagagagagtacacccatttcataaaagccctccccaggaattgcctcacttcacgcacacacacatcatattggcaggaactagtcacgtgacccactgctcacatgaccccactgggatgcgggggatgctgggaaatattgtacctggctgggctgagtgcaatggcacaatcatagctcactgcagccttgaactcctgggctcaagtaatcctcccaccacagctttttgagttgctagggctacaggtgcgtgtcaccacattggctcattttttgttttttatagagacaagctcttgctgtgttgcccagacttgtctcaaattcctggcctcaagtgatcctccctcctcagcctcccaacgtgctgggattacaggcatgagccatggtgcctggccagggcagctacttcttagcaataactccatactacagaagatcacttcttttggtagatagctagctgtttctgccatacctgatgtggtagaggtgacaattataaccattttacagatgtggaaactaagacccagagagtctgacccctgggtcacagagcttgtatgtggcagagctgagacttgaattcaggactctgtaagtttaaatctcttacatttaatcactataattctaattttagataagcatttagcttcttcagctttaacattcttgagaacaaaattcttcccttgatttatacaaaatgccccaaatgcccaagcaacgtatgtctggaggccacggtgtagcagtcatgatgccaagcggggttttagtcttcagtatttcatccatttgtagaaacgattatccccagaaagttgacctgcattttggactcctgccagaaatcaaggcatggtaccatctgtaagagataaataaatcaaaatatcatcagcagagaagtgtgtgccatctgctgccccgtcagttgaactggcagaggcctccggagaatccaaggaagtgcttgccaaggctctgccgccagcccagatagtgagaggagaagcttcacacaagatctgttggcatttttttcccccagctgaattccttgaatctggccagcaaaggtgtatgaactcttgcccttgccaaccagttaaaatcattccccattggcctcatttgctggggaccaggactgattcttctctgcccgcccagcaagttgaaagcactcaactatgaagaaaatttaccatgcacctgccaaaaagctttgctgcttgtggaatctgggtctcggaaccagggtcaaactttgaaccagccagatttgagtccacttcgctgggcacgtctggaaggctgctaggttctcctgccacgtgtggggtctctggagggtgtgtgggactttccttaggaggaatgaattttactaggacctgcctgctctgctaagatgtagtacagaggaatgaccaaatcaaaggctctgtgccaagctgtcttgattggaatcctggctccaccactagctgtgtaaagttagacaagtgattcactcaatctccctctgcctcagtttctttttttctttctttcttttttttttttttttgttttttggtttttggtttttgagacgacatctcactctattgcccaggctagagtgcagtgcgtgatctcagctcactgcaacctctgcctcccaggttcaagcggttcttctgcctcagcctccagagtagctggaattacaggcatgtgccatcgtgcctggctaattttgtatttttagtagagtcagggtttcaccatgttggccaggctggtctcgaactgctgggctcaaatgatctgctcacctcagcctcccagagtgctgagattacaggcctgagccaccgtgcccagccagcctcagtttcttcatctgtaaaatgggtgtggtcataggagctgcctcataggctgtcgtgcagattagcaattgatgcatgtaaagcacttagaacacacgttggtaggcgcataaagcatgtcagcacgtgttattggctggttgactttgtgaaactgttgctactgcctctctctgttgaccctgccttccccgcctctccccacctcctgactccatggaagcctcagcaacaccatctggtggggtatggaattaagtcacgatcttcagacccaggatctggggattcagccaaggatgctgggctccttagtgaccccttccccctgtctcgttgcccacatctctgctgccaaccaggacctgggcgcccaatgtccatgccaagggtaacttggcagaccctcaatgctctgcacaccttctgccagcattgggcatctgcctctggccaccccccttgattttgcctgtggccctgccaggttccccccacctgctcaggctgaagttgcagaattacagcctcctgcttctggcttgggaagacgcccgggctctccttgggaggagtgacatgtgtctctaacttaggatccagggaaagaatttttaaaaagctcttatttatggagccaagcacagggcagccattttcacacactttctcccatttcaattctctctctcttttccttccttccttcgtttctttctttcctttctttctttctcttttccttccttcctttctctctctctctctctttctttcttttctttctttctttctttcctttctttctttttctttctttctttccttctttctttctttctttcctttctttctttctttttctttctttccttccttccttccttccttccttccttccttctttctttctctctctctctctctctttctttctttctttctttcccctccctcctgcccatctccctttcttccttcctttctttcttccttccttccttctttctttttttttttttttgatggattctcactctgtcgcccaggctggagtgcaagggcatgatcttggtggctcagtgcaacctccacctcccaggttcaagcgattctcctgcctcagcctcccgagtagctgggactacaggcgcttgccaccacgccaggctaatttttgtatttttagtagagatggggtttcattatgttggccaggctggtctcaaactcctgacctcaggtgatccacccgtctcggccttccaaagtgctgggattacaggcgtgagctatcatgtccgacctttttttcttttttaaaaatggattcttgctatgttgtctagtctgggctcaagtgagtctcctgtctcagcctctgtagtagctgggactacaagcatgagccaccatgcctggcttgtttgaatcctttttgcaagcctggatggaaggcgctctgatttccgtctggcaagcaaggaaagggcttagagaggtgaagccactccctgagatcacttggctatgaggaggcagaggatggatttgaactcacgtcctgtggcttctgagcctagacacctccctgtgctggcgcctccagacctgtgatgaatgacattgagggtgtgggtgtcaaaacatggagctgattcctttgcagatgttgtctgaattaaatcctaactgaagatgtcttgttttatgccaatgaccttatttagccttcccagcaaccccagaagattggaatggtcaaccttaatagcaaacaactacaaaaaagaacccaaccaaacaaatatatatatttaaaaaaaaaaaccattatttactcccagtcccacagctagcaggtggcacagtggggatttgatttttttttttttttttttttgagatggagtcttgctctgtcacccaggctggagtgcagtggcgagatctctgctcactgcaacctccgcctcccgggttcaagcaattcttctgcctcagcttcctgagtagctgggattacaggtgtgtgccaccacgcctggctaatttttgtatttttagtggagatggggttttgctatgttggccaggctggtctcgaactcctgacctcgtgatccgcccaccttggcttcccaaagtgctgggattacaggcgtgagccactgcgcccagctggcacagtggggatttgaattcaggtctgcgggaagccagagcccagcttttaaccagggagcacaccctgtccggcttcctggtgaccctggtgcaccccatggctctccttgctgccttcacacaggagcttctttctcaattaaaccagacctacaggaggagatctgggggtggaattcctggaatcaggcctgagtggtgagccagagtgaggcagctgtgacccggccagttctatctgtggtggattcctggaagactcatttctgctgagggcccgtgccaggctctccgtttcatggcagtctcgatgtgcctgctgacaagctcaagctgctgcactgagggcaatttctgagtgatgcccccatccatcctcgctcagccagagcccctggagacagtaactcagaggggctagcggtgaggggaggtcagggcctcctgaattttctgtttgattctcatgctgcaaaatccagctgccccataaggtgatgccacaaggtctaggaagaaatgaccttccatttgtcttttctgaacggtggacacacccctgaaaaacatatctaggtccaattctggaatttgtttcaaaataatctcatggtggtggggacagtggggtgtagaggtgacaagactggccttgagttgacaggtattgaagctggtgatggggacatggggctttttgtactagtctctctacttttgcaaaagatggaaatttcccataataaataaaatgtttaaaaaaagattttagagatacctggtctggccatagaatgccttctggaatgtgtccttgccctttttttttttttttttttttttttttgaggcagggtgtcactccgtagcccaggctggagtgcagtggcacgatcttggctcactgcaacctccgcctcccaggtttcagcgattcttgtgcctcagcctcgactacaggtgcacactgccacgcccagctattttttgtatttttagtagagacagggtttgaccatgttggtctcaaactcctgacctcaagtgatccacctgccttggcctcccaaagtgctgggattacacgaatgagctaccgcgcctgtcctgtcttgttccgtttctgaccaagtcagtcccctgcatgataacagagccttggacagataaggacttaagtccagatcctgattctgccacatagtggctgtgtcaccttgggtaggtcactctgcctctgtgagccttagttttctcatctgtaaaatgggaatggattcagacttcgtgccattgctgtgatgaacgccaagtcctttgcgtggggcttgttctggactctcttccgggttgtgggatcctggctctaaggcaacatgacaaactcgagcctggggtgggatctgccttccaaaggggcttagcagaggggccaagccacgctcagggtagcacgtgacaatacgatgagtgatattgcaataaaacccttgggaaatttagagtggagaaatgttgcttctggatggagcgagtggttggtgaacaagacaggcttcatgacgggagagtggggtggacatttgagctggatcttgaaggctggggatggttcagacttagagaaacagagagagagatgttgagattaaggcagtagcaagaacagagacccagccatgggaaaaggctgagaatgcagacgtgatggctaaggtgacctcccgatcttaagtctgctgcctcgtggcaggtgtaaggctcaatgtggctgcccaatgtctgctgttggagccctcagctctttcttggctagtgtagatatccctttctgtttgtctcttctgtcttagattgctcccaagattcaatttctgtctcactgtggccatacattctggattctgcagagtaggtccccgctcttgtgagattcttgagaaagacgatttatgaagtactattaattgcttcattccacaatcatgtctgcagcactgatcactgctccaggctttgaggacacaacagcgaacaagacatacatggtcacgaagtttctatttgttgctgaaaacatgtggcctccgtgttgcagagacattgtctgggcattattattattattattgagatggagttttgctcttattgcccaggctggagtgcaatggctcaatcttggctcactgcaacctccacctcctgggttcaagcgattctcctgcctcagcctcctgagtagccgggattacaggcgtgcaccactgggcctggctaatttttgtattttatgtagagacagggtttcaccacattggccaggctggtctcgaactcctgacctcaggtgatctgcccacctcagcctccaaaagtgctgagattacaggcgtgagccaccacgcctggcctgtctgggtgttatttagaagagccaggaaacatcattttttggagagaggattccaaagaattactgatatgtacactttaacatgagaatggaagttccgtgagggcagggattttgtctgtgtggttcgctgctgtgtctccagcacctaaaaccaggactggcacatagtaggtgctcaataaatgttgatgggatacaactgtgtgaatataaaacgttgacattgggaacttaagagaagagaagtgtacttttggggattgagattaattcagacaccttcagatatcactacttgatgttgtgattttgatgcctaagatagagagatagaatatgaattctcaggatttcagggtacgcagcctccagcctagtctagaaagtggttaagcccacagtgcacacaggactacacgtaaatagatccgaaagcagaggaaaagtcccctgcacgtcctgtagaggacacgtgtactaaacaagttgacaaatccatacacaggacaatttcagagcgtgatggtggtctcactatggaagaaaagcaacgcaggtgcaggaataagcatgatgcggtgaggaggggtggggaccaccttaagtagggcggtgtgccagctgttctccatccacccctccatgtccattccctgcccttctcggtgccctgggaactgcctggactctgtgcccattggttttggccaacaggaggcacctacagggaatcaagagggcagaaggagagaaagatcagggcattcctttctggctcatcttgttctctccctgttgcggttttgacagtgactacatttctctaaggagtggctctcaaagtgtggttcccaggccggcagcatcagcatcctctgggaacatgttggaaagaccgattctcaagtcccggcccagagatgcttaagttctgattctgaggcttgttaagtgtgaattcagctcctgatggcagctcctcctctatggcttcacctcttccaggctcctttccctcccctgccccttcagacctgggtttcccttggttaccagcccctcaaccctgtccacacccctatacataatttcttcactcgtcggtcttcagtgagcccctcggaggtaccatctgtttcctgcagagaccctgactgtccagatgaccagcatgtcagttcatccccatctagacagggcacaccctctcacggtcacccagtccccacaggctcgcctcagtcattgctggtcattgagaaggcttgagttggtgaccttgagttgaggctgagatttaagtcctgtctgtgtgcccctggcctgcaagcaagatgcaatggtgtgtgatggtgagggcagtcacacatggcatttctctttaaggctatggtgggtatgaacaggcactctcacttcttctagccaaggaatgccctagtcatttattcctgtagacccagtaggatagaactctgagcttccactccccagaatagcaagaaattcaatctccagtttttgagatttcctttcagcccctgggtcgtatgaagttttcaggccatttgagagaacgctctggtcttcccctacccttcctctccccacagctggtggttttctggcctcatgggcaccatgggaccctcactgggtgcaagattttggctgagctaataacctatgaccccaaagtccagctttcccgtgacgtttttctttgaaggccctgacatcttttagggtgctgtggatccccaaacatcttctcctcttggaatctgatggcccccctttctttctgcatgaattccctctgctgtcccctccctgaagcaggaagacatcaccctccagtgggcctctgggaatacaaggggcctttaaggagtctccttcctagggcaggagatgccagctccattcacctttgctatcttagcagctcaaagggaatcagatggggagggggtaatgggagaaagggcatcttcaaggggcaaaaatgaggccgttcccaggcaacattgatgggcatggaggagacaatggaaggcgcagggccaggacccaggctggggcccacgaaggagcccagagcatgtctgcagcagcctcaggcaacctggactgccgcccactgagttgtcccagctgtaccccctggtggttgacaacaagccctgccgacctaccctataatatgcactgtagaaacaccagcgttggtgatcttcatgtttttataggtagggaaactgaggcaccaaaaggttcatattgatgttacacgtgcagtgagtgatggagccaggctgcacccaggcaggcctggctctagaatccctgcactgaaccagtgcgtgaccccctggccatgtgctagtctgtgatggtacctgcatgtcactcttgtttcccccaattaggctgcagaagaccgtgtctcatgtttcctctgacccgcatgtaggtgacagtgatgacaacgaaagccatctcctaagcacacactctttttttttttttttttttttttttttttgtgatggggtctttattgcccaggctggagtgcagtgtcaaaatctcagctcactgcaacctccacctccggggttcaagtgattctcctgcctcctgagtagctgggattacaggtgtgcacaaccacgcccgggtaatttttgtattttcagtagagacggggtttcaccatgctggacaggctggtcttgaaatcctgacctcaggtgatctgcctgcctcagcttcccaaagtgctgggattacaggcatgagccaccgcacctggccctaagcacttacttttttccaggcattgcatctaagctctttgcccatgttgagtcttcacaagacccctacaggtgctgtgcccatttcgccaacaaggaaataaaggcacagaaagatgggaggactcacatggcaggaagtgacagagccagcatttgcactcagctctgctgattccagaagtcagacccctgaccactgaactattctgccccataaatgcccttccctgaaggatcggccggtgccatcacatgagccatcactaaaatgactctctgttgtttttctaatgttggaaggatatttttaataggctgtgattctcaccctgagtgtacattggaatcacctgggagcttttaaaacgctaagatatatgggctccaccctgaccaatgaaatcagaatcgttgtgggtggggcctgggattcacatttccggggttaagaatcacgtaaattgattgacctaataggattcttctcagctttcaagttccatggttcaccaaaggtatgctgccatcaggtggcagtaacatgccacagctctgtgatctaattgtcaagccccagtctgaagtgtgattgagagacaagtgcacctgtcttaaggtttaatgcccaaaataaatcccttaactaaacatataaacttaattgccattgattttgatattttatgggtcacttctaaaagcggcaagccaatatggtgccatttaatacctagctcattaatccttagataatctttatcacagagactaaggatttggaggaaaaacatctcttctgtgtttgaatttcagctgttagacttctggccattgaagtatcctgtgttcctcatgtcatctctatgacttttccttaaacctcagcgttgacctgcctgggcagtgtgggctaagtttgatcacctctgcttaaacatcttctgtttagccttgtccatgtagcagaaatggaagtgtgagagccatttattttggcccctcttggattttccctgtctctatggaggtatattcctaggagatttctttcaggacacccccagctgtccatggtgggaacatctggttctggtaggaaattctgacatagcaatgggagcagagagctgggaagattttaggatgtggtgtggagtctgcagacctgggttgagtcttgctccatttcttactggctgtgtggtcttaggcaagtcaccgaaagttcagaccctcactttgcttgtcttgaaagtggagattctcattgaagtttgttgtgggactaaagagacggcaaatatcctttcatgataaaactgctcaacaaagtaggaatagaagggaacttccccaacctgacagagggcatatattaaaaaaaccccacagctaacaacaaattttatggtacaaaaatgaatgcatcccctccaagatcaggaacaagatgaggatgtccactcttaccacttctatttaatattatattggacattttagccaaagcaattaggcaagaaaaagaaataaaagagatcaagattggaaatgaagaagtaaaactatctctatttgcagatgatatgagtctgtatatagcaagttctaagaatccactaaaactgttagaactaataaatgagttcagcaagattgcagtttacaagatcaatatacaaaatttaattatatttctatacactggcaatgaacaatccaaaatgaaatttagaaaacaattccattcataatagcatcaaaaattataaaatacttaggaataaatttaacaaaataagcatgaaacctatattctgaaaactacaaaacattgttaaaagaaatttgaatagatctaagtaaatggaaaaacatcccatgttcatggatttgaagttttaatattttaagacggcaatacttcccaaattggtcccattacagattcagtgcaatccctttcaaaattccaacttgcttttttaaagaaattcacacattgatcctaaaattcatatgaaaatgcaagagacccagaatagacaaaatgatctttaaaatgaaggccaaagttgaagaacccacattttccaatttcaaaacttcaaagctacagtaatcaagatagtgtagtataaggagagacatataaattaatggaatagaactgagagtataaaataaacgcttttacttatagtcaattaatttttggcaagtgtgccaagacaattcagtggagaaagaatagtttttcaacaaatgcttctgagacaaccggatatccacatgcaaaagaataaagctggaccccttttatacaccatacacataaatcatctctaaatggataagagacataaatagaagagttaaaattacaaaagtcttaggggaaagaataggagtaactcttcatgatcttgggctaggcacacccttcttaggtataacactagtctaggtgtagtggcttatgcctgtaatcccagcactttgggaggctgaggcaggaggatcacttgagcccaagagttcaagactagcctgggcaacatagtgagaccccatctctatttttctttttttagatggagtctcactctgttgcccaggctggagtgcaatggcgtggtcttggctcactgcaacctctgcctcctgggttcaagcgattctcctgcctcagcctcccaagtagctgggattacaggggtgcaccaccatgcctggctactttttgtatttttagtagagatgggatttcaccatgttggccaggcttgtcttgaactcctgaccttaagtgatccacctgcctcggcctcccaaagtgttgggattacaggcgtgagccaccatacccagcctctatttttaaattaataacaaagaagatatgacaacaaaagcacaagcaacaaaagaaaaatagacaaattgggcatcattaaaattaaaaacttttctgcttcaaaggatgtcatcaagaaagtggaaagacaagccacacaatgagagaaaatatttacaaatcagataactgataagggacttgtatgcagaatatataaagaactaatcacccataataaaaggacaaatgacacaattaaaaagtgggcaaagggtctgagaagatatttctccaaagaagatatagaaatgggcaataagcccatgaaaagatgctcaacatcattagtcattaagaaaatgcaaattaaaaccacagtgagataccgcatggcactggcaaggatgcttataataaaaaaagacgaacaatagcaagtgttgctgaagacatggagaaattggaatcctcatatgttgctgatgggaacatagaatgatgcatctgctttggaaaaaagtgtcgcaatttctcaaaatgttaaatatagagttacatatgactcagcaattctattcctgggtatatacccaagagaaacaaaaacttgtccacacaaaaacttgtacatgaacgttcataaataaccaaaatgtggaaacaaattcaagtatctattatctgatgaatggataaataaaaggtggtatatccacatcatgtaatattattctgtgatataaataacataggctacaaagatggttggtccttaaacacattattctaagtgaaagaaggtagtcacaaaacattattatatgattgtattgtatgattatataattccatttatatgaaatggcatttcatgtcttgtctgatcatattgagtgtattctataattccatctatatgaatcatacaatattgtaagattccatttacatgaaatgaccagactaggtgaatctatagagacagaaaatagatgagctctttcctagggctggaagggttgcaggaaatgagtgactgctaataggtacagctttcttttcagtgtgatgaaaacgttttaaaattgattgtggtgatggtcacacagcctggtgaatatgctaacagtatactaaaaaccattgaattgtacactttattttatttatttatttatattatttatttattttgagactgagtctcactctgtcgcccaggctgaagtgcagtggggcgatctcagctcattgcaacctccgcctcctgggttcaagtggtcctcctgcctcagcctcctgagtagctgggattacaggcaggtgccactatgcccagctaatttttgtatttttagtagagaagggatttcaccatgttggccaggcttgtctcgaactcctgatctcaagtgatccgcctgccttggcctcccaaaatgttgggattacaggtgtgagcagccatgcccagccaaattgcatactttaaatgtatgaattgtatagcatgggaattatatctcaataaaattgttaaagaaaagggaaaatgcctagcacatagatcttaaatattattgaggtgcccagttggtggtgagagctgggagcctgctgcaggagggcgggcatctttcttaggctcaggaggcacagagcggagggcccagaatacttctataaaggtcttgggcctgtgaaaatgttttagggccatgaaaattctacgggcccatgaaaatgttttagggccgggcgtggtagatcacgcttctaatcccagcactttgggaggttgatgcaggagaattgcgtgagctcaggagtttgagaccagcctgggtgacagagtgagatcccatctctacaaaaaataaaaaaaactagccagatgtggtggtatgtgcctgtggtctcagctactcaggaggctgaggcaggaggatcacttgaacccaggagttcaaggctgcagtgagctatgattgagccattgcactccagcctgggcaacagggcaagaccttatctctaaaaataaaaacaaataaacaaaaaaagaaaaaaattaatttattttaaaatcagaagaagatataaacttttaggtgaaaaaatgcttaatacttaatatattcatctttttgccaatgtggttgtaaaatagaattcttattattatgttttgaagtttaagaagggcccctaataggcaaaaatgtgcaaggcccaccaacattttaatgtggcctcgggtgttggtctgaatttggccattacatctcctccattccagcaatataacagtacagaaagtttaaaacaattcactcaaaatccatccactccagcacaacactttatattatattatattatatttttttgagatggagtctcaccctgtcacctaggttggactgcagtggtgcgatctctgctcactgcaacctccacctaccatattcaagcgattctcctgcctcagcctcccaagtagctgggattacaggcatatgccaacacacccagcgaatttttgtatttttatcagagatggggtttctccgtgttggccaggctggtctcgaactcctgggctcaagtgatcctccgaaagtgctgagattataggcatgagccaccgtgcctgaccaacactttttaattttaatccttccttctagttcttggctgtcagcaaacatctctttcagtgggctaaaatatcagcacctctaatgtgctgtgtggcccaggatggtccctcagctgccctgggccttatcgtctttgtctgtaatggaaggtgtgagtcctgcatctcagtacggagcacaaggcgggggcaggggaagccagaatgctggaaccacagagcagggttcacccatctgtggccttgtgattctttggaaggagtgacataaataagagaggaagcacctccttggcttgacatttaagaccctttgtgatctgaccccttccttccttctcagactcatctcccaccgctgcctccatctctgcctttgcattgatatggggctggcaggaggttcaggaggccaaaggggcttcaagagaccttatcagagaacttaggaagctctaagcagacaaattagttgagaatgctgaaagcttctagatcgttttgactcttctacccacattggtccattttgacccaatctgtctctttgttgggaccagcagtaacatcctgaagccaggggttgcaaactcaccctagagtttatccagtctagtgtcgcaggggccatctcagtggtttaggtgaagctgggggcagagcagtagtgggcggtggggactgtggcaaaccagagagctttcaggtgccttatctaaaggaggcacagctgcctggccccatgtgattgttgctgtgtgggattgtgggctcagcacagctggatcttctgattctttaagagaaaattacaaatctgaatttgtaggtagcaatttacctatttttatgatcccgtgtgggtcaaacaaaatgtgtttgtgagcataggtccagcgtgcgccccctctctttgttagaaaggtctagaagttgggccatgatttgctcagtgctgcatccttggtggccaggtctgtgtccctggcatcagggaggcctgggaggaaagactgaagaggggaagcttcttgtagacataaggtttcagtggcattcattcatttattcattcatttgctcgtgtattcattctcttgctcatttgttcatatattccttcaatattgtttgtttgtttcctttttcctagatggggtcttgctctgttgcccaggctggagtacagcttactgcagcctcaacatcctgggctgaagtgatactcctgcctcagcctccccagtagctgggactacagccccgtgccaccacagctggctaatttttaaatttttttgtagaaatggggtctcgctttcttgctcaggctggtgggaaaatatttattaagcagtcactgtacacaccaggttctgttgtagctgttaggaatccatccagaaggaagatggagagtgtcaggggagggacatttggaattttagatagattaaatggaaaggcctccttgggaagataacatttgagaaaaatgacaagggagaggaggagtaaactactcaggtatgcgagtgaacagtgctgcaggcagcagaggcagccagtgcgaaggccctgaggcaggagaatgcccggcacgtttaaagattggcaaggagaccaaaatgacaggagtggagtgagcaagggggaagacaggagggaaagaggtcagggaggtgatggagagacagatcacagagggtcttgcaggccacagcgaggacttaggctctgacttggggtgagttgggaatgctgggagggttctgagcagagaagggacataatctgttttaggttataccaggatacttctggtcactgtgaggatggggcagaaagagagagaccagtgcagaggctactacagtgatcctggtgggaactgatggtggctggaccagcggaggtggcgagaagtggctggatgctagacgcattgggaagctagagccacgaatgagataaagatggcagcagggttttggcctgagcatctggggatggaggtgccatttactagctggggatgcagtgaagacttggtccctgtcctcacagagcttgcagcttgctgggggaaatagacattaatgtgtgtgtaagcagagtccggagtgagcttcttctatttgtaagaaagggtctggaagaagtagaaagttcagaagaagaaaaagaaacttttaggtgaagaaaatgtttaatacttaatagtaatattgtatattagtctctataccaatgtgactgtaaaacataattttaaaattacttaaaaatttaattaaattaaattttatttaaattaaaaatttttggctgggtgcagtggctcatgcctgtaatcccagcattttgggaggctgaggcagatcacttgaggtcaggagttcgagaccagcctggacaacatggagaaatcccatctttactaaaaatacaaaaattggctgggcgtgatggtgggtgcctgtaattccagctactcgggaggctgaggcaggagaattgcttcaacccaggaggtggaggttgcagtgagccgagattgcaccactgtactccagcctgggcgacagagtgagactttgtctcaaataaaataaaacaaattaaaatatttaatttttgtgggtacatagtaggtgtatatatttatggggtacatgagatgttttgacacaggcaaacaattcaattatactctttttgtcatttaaaaatatacagttaagttattattgactacagtcaccctgttgtgctagcaaatagtaggtcttattcattctttctaactattttttgtacctgttaagcatccccactgctccccgcccaatcccctactacccttcccagcctctggtaaccatccttctactctctatgtccatgaattcaatttatttgttttttagatcccacaaataagtaagaacatgcaaagtttgtctttctgtgcctggcttatttcacttaacataatgacttccgattccatccatgtggttgcaaatgacagcatctcattcttttttatggctgaagagtacttcattgtgtatatgtagcacattttctttatccattcatctgttgatggttaggatgcttccaaatcttggatagtgctgctatccacaattgataaatacaattgtgctatccacgattgataaatacaacaattaattatttaattaatttttatttaggaaggggctcatcaaggcaaaatggccgaaggcccaccaatgcctcaatgtggctgtggatgctgatatgcacattttttttttttttttgagacagagtccctctctgtcgcccaggctggagtgcagtggtgtgatcttggctcacctctgcctcccaggttcaagcaattctcctgcctcagcctcccgagtagctgggactacaggtgcatgccactacgcccagctagtttttgtatttttagtagagatggggtttcaccatgtttgccaggatggtctccatctcttgacctcatgatccgcccgcctcggcctcccaaagtatgatctgtatgttgaatttccctccctctagcctttgaggaaacaatgtaacattaaaaaaagtataaagcaattcattcaaaatccatccactgtagcacaccacttttgttttctttcttttaaatcctcccttccagttcttggcggtcagtacactctctttcagtgacttatcatctcagtgccactaacttgcacctgagactcacacatgcaaaggcagactcaggatggtggccatgccccatagaaatccaaggtgctgtgagagttacaacagcgggagcatgttccaggcggggaacagcatgtgcaaagccatggtgggaggctgcacaggggtgtaccaggaacgggggcagagggagagggcagtgggtggacaggccagtcaaggcctgttctgggtccacaaatgggaatttgaactttctcctttgggaagtcatcaaagagtttcaaacaggagcaagctgtgtgtgtgcgtgtgttggatgtgatcagagctgtgttttgaaatgatccctccagctgcagcgtggagaatgaattggagaggggccagagtggaggcctggggaggccagtgaggaggagcgtggattctggggggaggctgtggaaagggacaaggttgctatcgtggaggtggaagcgatgggccaggatggatggggtcaggaggtgggagaattggcagtttcgccatccacactcctgggatgttgggcttctaggaaccagggttggagaaagatgtcactgggcttgggtcagagacactggcttgctccagggctcatgggatgggagcaggcaaacctcggaagcccacgtgtcctctcacattctgaaaacgcttctcttcttttcaaaggtgaaaaatgtcgcagcttcattgacctggccccggcatcggagaaaggtgagtgtgaccccagctgagctgtggcagctctgctctctctggggacatctttcctgccttggtggctccccaaagccctgtgatagcatcttcttcagcatccctgggcaacagggccctgggagccagacaccctgttgcaaagccctgagtttcttgagctctcagtggagtgggagaggctggtggatggggactgtctgccctccctgtctgacagagtagtcctgagggtcatcacccttccattctgtccagtgcatgctgggactgtgggagggatgatgggggtgtggacgtttggttcaggcaagactggtgttggggtttgcctccagctgtaggatttgaccttgggggagggaagccaggtgcctggcctttgtcatctcacaggtgtggggagggccagtctgattggatgccaccatccagagagggctcactggtgttcagagcccgacagcagaggctctgagcccacagagatgtccagaggtgtgcaaggcagtgactggattatcaggagcagggcacagcttgagtcaggggatagcagtcaggattaggtttagttgcaagtaatagtgaccctaaggaactaatttcaatggagaaatttatctcctttataaaagtttgaaagtagacaatctaaggtggctctgctccacaaagtcctcaggatcctggcccctgccactctctctgttgtcccactgtgtttttcttcatggtctaagatggctgccagagcaccagctattacatctgcattccaggcagcaggatgcaggaagggcaaactctaaggttcccagaagttatcccacaacacctgcatatatctccttgaccagaactagtcacatggtcacacccagctagaagggaggctgggaaatgtggtctttatcctgggcaatgctgtgcctagctgaaagtcaggagttttgttattatggaagaacaagagaatggacacaggaggagagcctgccacagggacacgggggagtgtggctgcctccccacctgcctaccctctgccacccaggagataggctgccaagagtgaaacaggtatgcatgtctcttcagatagcctggagattaagagagggctctgggcttgggagtcaggggaggggaaactgaggcagaagggcaccatgtgtcctggaagctggtgacattctgttttgcagacactgtctttttggagcgctccagtcaagtggcagctggtgaagttgaggggcaagagacagggaacccaccgggccctcagttcccagaaagcgacaaggactccctaccccccagcagcctcttggcagtcaggaccgcctcctccatttctttgatgtccccatggctgtgttctgtttaattgctacatgtgaccatctccaaaacatttggctgggcggctcaagccacagcttccaaattgagatcactgggaaacacaataatatgaccactgcatggctgatatttgttgaacagttactatgtgccggatacagtgccaagcacgtcgcaagcatcaactgagaaacctccccacaaccccttgaggaaggggctgtcattctcactcccacctgacagatgaagaaaccaaggcttagagagatgaagtcacttaggtctcacacctcatgagaggcagagctgggtgaaatccaggcctgcgcttcacacctctccactgtctgcagccttctgggatgtgcagccctctgggatgtgcagtcctctgggatgtgcatcccataattcccaaggccttggagctcctgggtcaactttgctccaaatctggcttccagaaagcagggcctgtgtatgtgcacatgcatgtgtgcgtgtgtcccgggtaagggtgagtgtgcatgtgcatgagtggctgctgctatgtgtgtgcacgcatgcatgcctgtggatgagctgggtgagcatgtgtgaacgtgggcatggaggcgtgtacacatgcgtgcacatgtaagtgcaggtgccatgtgtgcataagcacaggtgtgttctagggtgagcacatacgggttgtgtgcccatgtgagtgcgtgtgtgaatttgagtacgtgtgtgtgtgtgtgtctgtgtacagtggcaggtgggtggcctgtgcccctccagaaggtatcaggcctttattttgcttcttttacaagaaccccaaagaggttgtatctttgtgttttactggccttgtgattttacttttagggcttggcagccacaccgagaaccttctggctgtgtatataaaaatgtttacaaggaggctgagtgggctggctttgccactgaggtgctgaatgattttcacgtactcgctgtctctcaaacactgtagctctcgcttgaggttggcagggtttggtccaaggcagcccgtgtggcctccccccatgtatacgggcccagcccttccagtagacacccgcagtaacgtggcaccctcagacccatccattttctccccaccacactcagcttctccatttcacagaggaatctgagggcagagagacgagggacttgttcccagccgcactgggaacaagtgtgcggggttggatgtccacactcagctgtgttctcccaaggaatactctttccctatgttatggctcccgcactggctccctctgggacatccctcctggcatctttctggtctgccacatacgataatcgcgacactggcactaactggctttcatacggtagttactgtgtgccaggtgctatgctgagaacttggcacacgttggctcctgtaatccccattttacaggtgaggaaactgaggtacagagcaaccacacggctggaaaatgggggaactgggatttgaacctgaacagtctggctcttaaatgtctggttctcctgctgaaaagcttagggcttctgagcctgggggatatctgtactccctttatcagctgaggtccggtgagtgctttccttcctgcctccagctcctcccacctggcaaaccgcaggcatgatttcaagatttccaggcccttctcaaatgccacttccccattcccattttctccaataccctcttgtcccctgctcacctaccctctccctcctggcaaaatatttgtccatcatcagtttcttaccatagcatcacacatttttcttcgtttgcctgactattctagttttgtgttttacatgggaaatgtcttttttgttttatgctagcctaagccacaaccattttttatccggattcctgccacaatcttgtaagtggttacctcctttcattcttgctccctgatttgcttggtacctgaatgatctgtattttatattttgagatggggtcttgctctgttgcccaatctgtagtgcagtggtgcgatcgtagctcactgccgccttgaactcttgggctcaagcaatccttctgccttaggctccgagtagctgggactacaggtgcgcactaccatgccccacgcttggtgcccaaatggtcattttttctttctttcttcctttctcccgtcctcccttttgcccttctgccctttctctctttccccttcccttccctccccttccctcccctccccttccctccccctcccttcccgtcttgtctcgtctcctctcttctcttcttttcttgacacagtttcactctgttgcccaggctggagtgcagtggtgtgatcttggctcactgcaacctctgcctcccaggttcaagcgattctcctgcctcagcctcccgagtagctgggattacaggcgcacgccaccatgcccggctaatttttttttttttttgtattattagtagagatggggtttcgtcatgttgcccaggctggtctcaaactcctggactcaaacgatcctcccacgttggcctcccaaagtgttgggattacaggcatgagccactgcacctggtcaagtgaacccctatcctgaagctacctaggaaaccccaatcaacagccagttcattagcacacgtaagacactctcatcactccagaggtttcaagggttttagcagctgtttgccaggaaccatgagaccaaatatatgttttttgttatatcacagtatcacgattatacacacttgttatagaaattttaacaaccgtggccgggtgcagtggctcatgcctgtaatcccagcactttgggagtacaaggcgggcagatcacctgaggtcaggaatttgagaccagcctggccaacatggtgaaatcctgtctctactaaatatacaaaaattaactgggcatggtggcatgcacctgtaatcccagctacttgggaggctgaggcaggagaatggcttgaaccgggaggtggaggttacagtgatccgagatcattccactgcactccagcctgggcaacagagcaagactctgtctcaaaaaaaagaaaaagaagttttgatagccccaagtgcgtaaattacagatgaaagtctcttataaacccacccttgggtatttaatatgaatggtttggtttatcagttcttgaaaaaaatgtatacatacacacacgtatgtacatacatatatttgatatataaaatcatggtttgctattcatgtcagtacatagaacttgtccttatcttgaaacaggtgtaggatattctatcgcatgatgactgatatagttttcttttcttttttttttttttttagatggagtctcactcttgtctcttgttgcccaggctggagtgcagtggcatgatctcggctcactgcaacctccacctcccaggttcaagcaattctcctacctcagccttccgactagctgggattacaggcacctaccaccatagctggctaatttttgtatttttagtagagacagggtttcaccaatttggtcaggctggtctcgaactcctgacctcaggtgggcctgcccacctcagcctcccaaagtgctgggattacaggagtgagccaccgtgcctggcctgtgactgatatagtttgaatgtgtgtcccctctacatctcattttgaaatgtgaccttcaatgctggaggtggggcccagtgggaagtgtttgagtcatggaggtggatccctcgtgaatgacttggtgccgtccccttggtaatgcgtgaattctcaccgtattagttcacactggagcttgttatttaaaagagcctagcacctcctctcctctctttctcactctctctcttgccatgtgacatgcctgcttcctctacatcttccaccatgagtaaaagcttcctgaagcctcaccagaagccaagcagatgctggcgccatgcttatacagcctgcagaattgtgagccaaataaacctcttctttgtaaattacgcagcctcaggtatttatagcagtgcaacatggactatcacgtatattgacatgtgtttaaaccaggctgtctagctgaactgcacttgagtgttctgtattgtattgtagctgaataacagtgacttgtgcacatctctctgtcccttacaagcccaagaccttcgatgggtagcataatttctcatttacctctgggtctccaagtcctagcccagcactggagtaccactggcaagacagtataagcagtataacaaaggtctgcacagtagattgtgccaggcagagaagaagaaagtgatcaaagatgcctgagcaacttaagatgaaatgtacaaacgcagatcaacagcaatgcctccatgttatgaacttttttattttttattttttggtggagtcttgctctgtcacccaggctggagtgcagtagtgtgatcttggcttactgcaaactccacctcctgggttcaagtgattctcgtgactcagcctcccgagtagctgggactgcaggcgtgtgccaccacatccagctattttgtatttttagtagagactgggttttgtcatgttagccaggctgatctcgacctcctgacctcaggtgatccaaccgccttggcctaccaatgtgctgggattacaggcatgagccaccgcacccagttgatgttgtgaacttgatactgaacatgcagagaaaagtttctcctacttccctgtcttcctcctcaagggttcctttgtctctcaaaacctcagtcatttattcactagggcaagagtctcctaccaaataactgtgacccacaggataatcttaaaacctggtgcattggccagtaagaccaacaataatgttatgtaacgagctatcacacaacccagtggcattcacacaactcagtggcattcacacagtttttttttttttcctcacatgtctgtgggttttcttgagtttagctcatgtcggaaggcttggttccaggatataggctgggctcaatctgccccacttgtgtctgttcaggtagaggggatagtaggtgcttggtggaggttttttcatggtaatgacagaaatgcaagatggggagccaactgcacaagcacattttaaaccttgtttggatcatatccaccaacatcccattggccacagccagtcccatggccaagtccaacatcaatggggcaagaagtatactgctcacatggaggaatgggtggggtgtttggagtgaatgtttgctgatcaataatttaagtgaccacacccggacctgaccataggtctcaaggatgggtggcagctggagccagcctggctggatttctggtcatgagtgtgagactcattaatttgcttgtcaaggtctcctctggtcattgtcaggatctttatttctcccaaagtgacctaaatatttgaatatttatctataacctggttggcatcaggctgctaaatggtctattattgcttcctcttctgagattgaagaactgttttatgtgcacagactttggccaactttctggttaaaaatatataactattaacagtcatgaaaccttccagattaaccaactatcattaaattttctagattaaccaactatcattaaactttctagcttcaaaagaaaactgttcatcctttttgcaaattattggcaaatgtgtaaatgttctctcaatgtcttcaaagacaactggctaattataataacacttcctcctttccttcttctctccctccctccctcctgtccttccttcctcccttccttccttccttctttccttccttccttccttccttccttccttccttccttccttccttccttcctcttctcttatggagtcttttgacctgcagccccattttgactcaatgattatctagggctgttattctggaagccctttttaccattattttgaaatttcctcccctctctcatgttggctccactgcttcctggatcccaggtagtcttctttctggattacttcctcattttggggaaaaatatcctccagtaacttcctgagaaagacagcatggttgagaccctttatgtctcatgttgtttttatttgtctgtcacacttgactagatgttttgctgggtataaaattttaggttggaaataattttcccacaaaatttgggaaggattggctgctcccttgtcttccagactccagtgttgttgaaaatttcaatgttattctgattcttttgtgtgatctgattttttcccctctctggaagcttttaatatcttattttctgttctcacttttttttaatcttccattttcatttttatttgcctttttatttattcctcagatatttattcaatttttatatttcaatcagccagtctacttttaacatttctacagtcatacttttaattttaagagctttttcttgttataggaatgttcttttttttaatagtctcctgcttttgttttatggacacaatatcttctcatatttctccaatgatattaatttttttaagtttgcttctctaccctttaatgtctctgtttcttccaagttcttttgcctatcttattttaatttcaactgtcttttatattgttttccttaaacatctgatgttcatgtttaacagtgaggtgcgaacttactattttgaagctcaagatacagtggagatggggagaatattggccaatggacttcccaatcatctgagctataaactcctcatccaaaaagttcatttgggccaggcatgatggctcacatctgtgatcccagcactttgggaggctgaggcaggaggattgcttgaggccaggagttccagaccagcccaggtaacatagtgagacccctgtttctatgaaaaatttaaaaataaaattaactggacatggtggtgtgtacctgcagtcctagctactcagaaggctgaaatgggaggattgcttgagctggggagttcaaggctgcagtgagctaggatcgtaccaccacactccagcctgggtgacagggcaaaaccctgtctcaaaaacaaaatgaaacaaaacaaaaagttcatctgatgaacccatacgcactgtcacgaggctttttctcttgcactgatcagtttcccgcaagaggaactctcccatctccagtgtattaataaactcagccatcagcattctgggaatcaaatggggggcctgggaggtatctcagtggcacacatgtagactttcacttaattcttggttttcagtatggagctcagctgggcctggttcctctatttgaaggattttctgaagtttcctctgtggcttcctccatgcgggtagtcaacttccagccttctcctatctgctaagtcattaaccaactattcatgaaatttctagcttttaaaatgttgctgccatcttttttttctattgttatctcttgtcacatcctctttgttctgaggatttatgactttcttattccttaactgtaatgattggcggtattgaaagagagcagtggcctttggttcagccccatgttcaatcccaggtttgactttgtaaacccaggtctctctcctgagctctagattccacctccaactgcctcctggacacttcctcctgagtgcccccagggactgcaaactcagctggtccacaatagaaaacacttgacccttctttgtccattgtcctgtcttcaccattatctgctctgataccaaagccaggaaccagaaggtcatcctcaactctttccaaattcaattatttgacaagttcagtttcttttgtttcataaatatctttgtttctttgtttttttgagatggagtcttgctctgtcacctaggctggagtgcggtggtgcaatctctgttcactgcagcctctgcctcctgggtaccagcaattctcctgcctcagccttccgagcagctggcattacaggcatgcaccaccatgcctggctaatttttgtatttttagtagagatgaggtttcaccatgttggccaggcttgttttgaactcctgacctcaagtgatctgcccaccttggcctcccaaagtgctgggattacaagtatgagccattgcacccagcctatctcctaaatatcttttgcattggtgcgtcttctctatctccactgccacagcccctttctgcttctcatcacatctctcctgccatgacaataatctctcagttggcctcccagactccagtctgcgctgcttaaaatccattcctcaatgctcatcaacacacctaatggaaaactatagagcaacgaaaatgaacaatgtacagccaggcatggtggctcatacctgtaatcctagtgctttgggaggccaaggtgggaagatcgcttgaagccagaaatttgagaccaggctgggcaaaacagcaagaccccatctctatgaaaaatttataaattagcccagtgtggtggcacgcacctgtactcccagctacttgtgaggttgaggcaggaggatcacttgagcccaggaggtagaggttgcagtgagctgtaatcatgctgcaatccaggctggatgacatagtgagactctgtttctaaaagaaaaagaaaagaaaaaaacaaatatgactgctcacaacatggatgttaggtaaaagaagctgcattcaaaagaatacattccatatgattgcattcctgcaaaaccggaaaatgcagaagccctatctgtattgttagaagttgggtcagcggttgcccttgcagagaaggtgtaactgaaagggaacttgcggagggcttggcagctggcagcattatgtttcttgatctgagtgctaattatgtgtatatgttcagtttaaaggaagttcaccaagctgcatgcttaggatatatgcagttttctgtgtgcgtgttgtatactttgctaaaaaggaaagaaaagtgtttcctatgctgaatttcaaattatctttctaaaatgaaaatccagttacatcaggcccctgctgaaaacctttgcatggctctcaaacatacacagggcattttaacctggcatttatggcccagcacggtctagttcttgtctgccttttcaatccctgcctcctacagtcccttatgtgaatcctgtgctccagtcctgatgctctgcacacatccatttcccccaaactatccatcacctctcatgcctctgtgcctttgcatgtgctgttccctctgcctgacttgcctttaccacctcgtttgctttgcaaacttatattcatccttcaaaacccagcttagaaatgaccttttgtgaaaagctatccctaaacccccagaggaacctacttacagagactggtcctctgagcactgatcccgctgtgttgtggtgacctcctccagcaggctggatactccctcaacacaagcactgcatcttgtctttgtggcgcctgtgtgcccgacggggctgtacagagcaagaatttagtaaaggtttgttgaataaatgaatgggtgaatgagtgaatgaataggggccaggttatagatagtgggtggcccatttgggcttagaaacctggatctgactcctgaagctgtgatctcctctgacccacctgggttgaactgtattttaagtcatccctgctccctgctcctgtttcttggtgccctgggatttctggcagccaccagccagcaatttttgtgaagcaatctccaaagcttgtaggtttcatttgtttaatatttcagggatgtgtaacaatgtggttggctccatggtcacactcttgagtcttgcgtgagtcatttctcacttcagttcctataatagtctcttgttcgttccctcaacctctctgttctccgcctgaaatcgatttacaattctgctgctcacttaatttatttagtgcattttattgatttatgtcatagaactgaaacgtgcatagatcagagcatgctgagcagagaggggagcccctctccacagctgcttccacagctgcccaaactgacatctgagctaaaaacaggtcaacctactggctgcagccggaatacgccaggtggctagagcatctttttgcctgagagttaatcaatgctctttacacccctggctgtctggggaaccctccatcaaccttcatgagccaacccaaaggtcctgcctccacaaagccctccttcatccccagactgcatcaattactctcactcgatgctcccgagggactgggtacctcctggtggtccagggcccagaaacatggaagctgtgattctttccatttcaaagagacagacatttcaagacacagaaaggcaggatactggtcacactccattactccttctcacctaccattcccagatagtatggagataatactcccagccctgcgacccaggttgggaactgtccaccatctgaatggccctgctccatcgtggagctctagaatcttcctatgatgcctggccattgtcagtcaactcacagcagaggctggctcacctgatgccagttaattctcggaggcagggcagactgcaacctcgctttcaggagtgggctgcagtaaccttcgtccatcttgccttgggccagtcgtcagtatcccttgatgccagggtgtgtgtcaggaaataaggcagggaggagaaccatccctaacctcgctctgttcttgaagagctcatcttctagtgggaaggcagatgaggggatccagactcacaatccgtgaggggagacagagggctgcggtgtgatggcagtctaggaagattgagtggaggagcgccatgttggaagcatctcgaagacagaatgcaattccttctcgtgcatgaggggtgtcagaggaagtcccagtagaatgaacagcctgtgcaaaaggcgacactgagtatctcagtgctgggaacctggcaggtgctcagtggacatagctaagtgactgaagggtggaaggaagggagagcccagagaggtcaactgccttgctcaaggtcacacagcaggtttaggtcagagtcaggctcagcctctaggcttccgaggttttcaagcctaccctgctacccacccttccttctcagccatccctcgagacgcatttgcttgagaaacacacctggccctcccacctccttaattctgaagtgctggttctgccactttcttttctgaatttctggattcctctaattatgtgctcttattaaaggtgattaaatccctaagcctggtggaagattgctcctggagatcacaacatctaataattgctttagttgctctaattccaattattcaagattatctttccaggtaattaggtatttgggcagtcttgcctgctcactcttccacagagcatcatattaaccccaaacggtgaccagccttcatgttttgtaattggaaacagtttctccatggcaaatagactctgttaagggtaaacagcagtaatttaaatttctaaatggctctgtggtcttagcatgctttgctatgagaaatgataatataactcgaaggctcacaatttgtactgatctatgatggcgtagggttgggcagtgaacatcctgtatgaggggcccagggattcacagatagggttaaaaaagacaacatcatcatacatgtctatacttgcacctcattgctaaaccacactgcctgtgttatgctggaaatctgggacactattttgtcatgtttcctttttgtttgtttgtttgtttgtttgttttgagacggagtctcactctgtcgcccaggctggaatgcagtggcgcaatctcggctcaccgcaagctctgcctcccgggttcatgccatttgcctgtctcagcctcccgagtagctgggactacaggcgcccaccaccgcaaccagctaattttttgtatttttagtagagacggggtttcatcgtgttagccaggatggtctcgatctcctgacctcgtgatccgcccgcctcggcctcccaaattgctgggattacaggcgtgagccactgcgccggcctgtcatgtttcctttttattttttagagatggggtctcactctatcgtccaggctggagtgcggtggtgcaatcgtagctcactgtaacctcgaacttctgggcccaagcaatcctcccgcctcagcctcccaagtagctgggactataggcttgcgccaccacacttggttactgtcttgagaaattcttaataatctttcaacgaagggctgttcattttcatttcacgctgccttcccaatttcggccgtgtgccatacccgcctcccataccactgctcatttactatttctgttcacattcattcactgaaaaagtctaattattttagtctcatcctgagcagtaatatctgtcaactcatagttttagtatgccagtttattttttcaagatgctttcaaattaataataataatgatgatagagtagtggcggtggctcatgcctgtaatccagcactttgggaggccaaggtgggaggattgcttgagccccggagttagagaccagccttggcagcataacaagacccctgtctctaaaaaaataaaaaattagctgcgcatggtggcacgtgcctgtagtcccagctactcggaaggctgaggtgggaggatcacttgagcctgggaggtagaggctgtagtgagccatgattgagccaccacattccagtctgggtaacagaatgagatcttttctcaaaataataataataataataataatagatcaggtgcggtggttcacacctgtaatcccagcactttgggaggccgaggcaggcggatcacgaggtcaggagattgagaccatcctggctaacacgatgaaaccccgtctctactaaaaatacaaaaaattagccgggtgcggtggcgggcgcctgtagtcccagctactcgggaggctgagacaggcgaatggcgtgaacctgggaggtgaagcttgcaatgagccaagattgagccattgcactccagcctgggcaacagagcgagactccatctcaaaaaaaaaaaaaaaaaagaagaagaagaagttcaagaccagcctggccaacatggtggaatcacgtctctactaaaaatacaaaaattagctgggcgtggtggtgggtgcctgtaatcccagccacttgggaggccaaggcaggagaatcatttgaacttgggaagtggaggttgaagtgagccagtatcacgccactgcactccagcctggacaacagagcgagaccctgcctcaaagtaataagaataagaataagaataagaataccaaaaccttatttctgttttagcaacatgccaggcccacttgattccccaacaacttgaagaggttgtactgctgttacactaggttatggatggggaaactgaggcccaggtagtttacatcatctttcccaaccaagatcatgtgcgttttaagtggcagaggtggctctgaacctgggtaggggctgcagagtcctagcctttgccattttacttcctgtccccaggtgaactaataaaatagaaaagactgccccagcaaggggggtaaggagtgaaatccagtgaaaggaaagggcgaggtaagtgtcggccaggtagggctggggaggaatctttattcctcccctttggccgtcacaccatgggggtgacacttgtgattctctgaggccctccagcctcaggcacctccttctgctttcttcttcttgtgcttctagttccaggaaaatagtctgacccttgtgcatggaatgtcagagtgcaaagggctccgagagccggtcccacttgctccatttaacagatgaggaaattgaggcccagagatagaactctttgtggctgccatggactgagcatatgaagtatgcctcctgcataccggtccttaagaaatagggtcctgtctctggggcaacttcccttagcccgaccctgacatatacagtaagcactcactgagtatactcatccctttcatgcatgttatcacacaacccacagagaacttttctttttctttctttctttttctttctttctttctttctttctttctttctttctttctttctttctttctgtggtctgtggccgacttgtcttgctggctgtttggtcttgcgtgctctggctgtggcttggtcgtctgtgtcttgtcttggtctggcctgtgtcttggtcgtctgtcgcctcgccctctttcttccgttgcttgctgttgcctgtgccgggccttgctctgttctttctttctttctttctttctttctttctttgctgtcttgtgttctttctttctttctctcctgcctcctgccttcttcttctttcttctccttttttcagatcaggaagctgtgctcagagaggttaagaaacattagccaggcgtagtggtacatacctgtagtcctagctacctcgggaggctgaggcaggaggatggcttgagccagggaggtcgagactgcagtgagctgtgattgcaccactgcactccagcctgagtgacagagcaagactctgtctcaaaacaaaacaaaacaaaaacaaaacttgctccaggtcagtagcagggcttggatttagatgcagggctttgagagccgggctctgggttcagattccagctctggctctctagtggtggggcctcaggcgtgctgttgatccttttagtgacttcatgtcttcatctgtaaaatagggataacagcgtccactttgtgggattcttctgagaatcaagtgggatgatccatgtgaggagttagcacaacgtctggctcaaactccagcttgaatatcctgtcggatttcccccatctcttcagtgtggcccagccagctggaaggctaacttggaataactcagtttgcgtttatttctactcagctaaaacattcaactaagctttatagaataacgcacagaattccattcacagcctgatactctcataccccttgcttcatttaattctttctttctttctttctttctttctttctttcttttctttctttctttctttctttctttctctctctctctctctctctctctctctctctctctctctctctctctctctttctttctttctttctttctttctttcttttttttgagacagagtcttgctctgtggcccaggctggagtgcaatggcacagtttcggctcactgcaacctctgtctcctgggctcaagcgattcttttgcctcagcctcctgagtagctgggattacaggtgcccgccaccacacccggctaatttttgtatttttagtagaggcagggtttcgccatgttgcccaggctggtctcgaattcctgacctcaagtgatctgcccaccttggcctcccaaagtgctgggattacaggcatgagccaccgcgactgacctcatttagttctttcgacagctctttgggttaggtactgtgatctctgctttacaccagagtggccgggcagctgactcagagaagttgagccacttgcctgaggtcacacagcaaagtgacgtatcccgtcagtcctgtgctatttcagccacacctcatgggccttttcaccctgcctggtgcctcctggttcctcttccactgctcaggcccaggaatttctttggtctgctttgctgtgtgttctgacctggcggggaggccccttggctcacagctgtcagggcctgcgtggagcaggagggaggcagcagctgaggggacccgagttaccctctgctcatcaggcatcccatctgctggctcctgtggcctcatcatttgcagccatctgtcaggctccctggagatgctgcaaagcctgagatgtaacacagaacctccaaatgtgccaccttcagcctgcacggggagcagagaggcccatgcccctgagacccctacctacgccttgaagccaccaggaactggaaactcaggagagaggtcctttcagaggaactgttcccagagggctggagccccctctcccattggctgcccggcaattggctccgcagaaccggctggggtttactttgctcaggcgtctgcttgaaatttcattttggatttaaaaagtcctctgtctcttggcggggatgccctggcccctgcttgtctgcagaatctctggcctcctgggcttccgatcttccgctcgcgtttgccaaaggcagagaaagggtcccatgtgggactgggggcttctggagcagggggaggggctagtgatttctccaaagccggtttctgtctggttgatcttgtcacacatgcctctccctggcccatctctggcggtgagggcagaggttgtcagttttattcattagttttacattaaagaaatttctgatagcagcttttttgagatgtaattcacttccattcaatttgcctgtttaaagtgtataattcagtggtttttagtgtattcagagttgtgcaatcatcactatcaattttagagcactttcatcaacctgaaaaggaaccccatttacttgagcacttacccctcaatcctcccacctccaagagacggaggcaaacactgatctattttttttttttttttttttgagacagggtctccctctgtcacccaggctggactgcagtggcacaatcatagctcactccagcctccacctcctgggctcaagtgctcctcccagctcagcctcccgagtatctgagactacaggtacacgccaccatgcccgtctaattttgttttattttttgtagagatgaggtctcactgtgttgcccaggtcggtcttgaatttctggactcaagtgatcctcttgcctgggactcctagagtgctaggattacaggtgtgagccaccatacctggccctgatctactttctatctctatagatttgctaattataggcacataaaaacgaaggcatagaatatgtggacttttgtgactggcttctttctctttagcataatgtttgcaaggttcattcataatgtggtgggtgtcagtacttcacgtcttcctttttttttttttttgaggcagagtctcactctgtcacccaggctggagtgcagtggcgtgatctcggctcactgcaacctccacctcctgggttcaagcaattctcctgcctcagcctcccgagtagctgggattatgggtacatgccaccacacccagctaatttttttgtttttagtagagacagggttttgccgtgttggccaggctggtctcaaactcctgacctcaggtgatcttcccgcctcggcctcccaaagtgctgggattacaggagtaagccaccacacccggcccattccttcctttttattgcaaaataatattgcattgtatgggtagactacattttcttgatctattcatgatttatttatttatttttaaaacctttttaaaattgggaaattagtacaatgcagcaaggtgcataacatatacatatatagcctgacaaattattgtaaggcaaaaactttattacagctaaggttaagaaatgggtcattgtcagactcccagaagcccctgtaacccttcctggccactaccaaatccctttccccaggggagggtcatcactgccttgcttcactttctaacaagggttgccaaactatggcctgttgtgtttttttgtaaataaagttttatcagaacacagcaactcccactcctttacgtatggtctatggctgagaccatctgtcttgcacaacataaaatatttactgtctgtccctttatagaaaatattagctggctgggcatggtggcttacacctgtaatcctagcactttgggaggcaaagacggatggaggattgaggccaggagtttgagaccatcctggccaacatgacaaaaccctgtctctactaaaaatgcaaaaaattagctgggtgtggtggtgcacacctgtagttccagctacttgagaggctgaggcataagaatagcttgaaccctggaggcagaggttgcagtgagtcgagattgcaccattccacttcagtctgggtgacacagcaagactctgcctcaaaaaaaaaaaaaaaaaaaaaaaaaagaaacaaagaaaaagaaaatgttagctgatctcaccttgtggttttaccaagtatatagatttatttgttttcgaattttttgcctaaatgtgatcagtgtacttttttgtgtctggtttcttctgcttgacattatgttgatcatgtaactgtagtttatttcttttcattgttatgtaatattctgctgtattgctacaccaccttctatttgttcattctattcttaatggatatttgggtcattttcagtttttattaggaacaatgccactggttcttcaagtgtgattctcaaactggtggaatcagcatcacctgggagcttgttagaaatgcaaattttggctgggtgcagtgactcatgcctgtaatcccagcactttgggaggccaagacaggaggatcacttgaggccaggagttcgaggctgtagtgagctatgatcatgccagtgcactctagcctgggtgacagagtgagaccctgtctcaaaaacaaacaaacaaacaaacaaacaaaaccactctgcaaattctcaagtcccactacggacctcctgaactagaagcagtggaccctgcaattcgtgttccataagccctgtgggtgattttcatgcatactccagtctgagaaccactggtttcgcatctacccagatgtggaattcctgggttgacttagtgtatcttcaacattattaagttttctatcccattttgcaaagtgtgtgtaccagtttacacccccactagtgggctatgaaaattcccatctctctatccttgacaatacttggcattcatcagatttataaattttgccaatctggtgggtgagaaatggtatcacattgtgatttccaatttacgtttccctgattactaatgaggttgaacatctttttgtgtttatggctatttggaacttctcttgcatgaagtgcctgtttgcatcttttgccacggtttctattagattgtctttttcttaccgatttataggagtcttttttacacacgataatctttgttgcttgtatatgttgcaaataccttttcccactctgtggcttgccttttctcagatgtcttttaagaagttctcatttttggccaggtgcggtggctcacgtctataatcctagcactttgggaggccaaggcaagtggatcacctgaggtcaggagtttgagaccaacctggccaacatggtgaaactccatctctaccaaaaatataaaaattagctggatgtggtggccagcacctgtagtcccagctacttgggaggctgaggtgggagtatcacttgaacccgggaggcagaggttgccgtgagccgagattgtgccactgcactctagcctggggaatagagcaagactcagtctcaaaaaaaaaaaaaaaaaaaagaagaagttttaattttttttattatggtaaaatatataacataaaatttaccattttaaccatttttaagtgtacagttcagtggcattaaatacatccacattctctgcaaccatcatcaccatttacctccagaactttttcatcttcccaaactgaaactctgtagtcattaagcactcacttcccatctgcctctccttccagcctctggcaatcaccattctacttcctatctctatgaatttgactactttgggtacctcatctaagtggaatcaccagtatttgcgtgtctggtttatttcatgaaacataatgtcttcaaggttcatttctggtgcagcacgtgtgagaattccatttcttcctaaggctaatatgccatcgcatggatgtaacacacctggtttatccatttgtctgttgagggacaggtgggtcccttggctgttggctgttgtgtgttgtgaagatacactaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaacaaagacacaatgggcttttgtccctcacccccttcccaccctttctccttgattccccaaagcccattgtggtttttttttttttttttttttttttttttggagtttcgctcttgttgcccaggctggagtgcaatggcatgatctcggctcactgcaacctctgcctcccggggttcaagtgattctcctgcctcagcctcctgagtagctgggattataggcacctgccaccatgccgagctaattttttgtatttttagtagagacggggtttagccatgttggccaggctgttcttgaactcctgaactcaggtgatccacccgccttgatctcctaaagtgttgggattacaggcatgaaccactgcgcccagcccattgtgtcattcttatgcctttgcaacctcatagcttagtcttttgcccatttttgaatcacagtgtttgtttttttgttggtggtaagttacaggaggagtctttatatattctggatattaacaccttatcagatatctctgattcgcagatattttttctccttgcatgggttgccttttcactgtcttgatattatcctttgatgcagaagttttaattttgatgttgttcagtttatctattttttcctttgatgcctgtgcttttggttttatacccaaggaactgttgccaaatccaatgtcatgaagttttcctcctgttttctactaagagttttattgttttagctcttctgtttaggtctctgatccatattgagttaatttttatagatggtttaaggtaaatatccaaagaaatacttaattttaaagcagctaaatttatccatccttctctttaggattaatgctttctttggcctatttattttttatttttattttattttattttattttattattattatactttaagttttagggtacatgcgcacaatgtgcaggttagttacatctgcatacatgtgccatgctggtgtgctgcacccatcaactcgtcatttagcattaggtatatctcctaatgctatccctccgcactccccccaccccacaacagtccccagagtgtgatgttccccttcctgtgtccatgtgttctcattgttcaattcccacctatgagtgagaatatgcggtgtttggttttttgttcttgcgatagtttactgagaatgatggtttccaatttcatccatgtccctaaaaaggacatgaactcatcattttttatggctgcatagtattccatggtgtatatgtgtcacattttcttaatccagtctatcattgttggacatttgagttggttccaagtctttgctattgtgaatagtgccgcaataaacatacgtgtgcatgtgtctttatagccccatgatttatagtcctttgggtatatacccagtaatgggatggctgggtcaaatggtatttctggttctagatccctgaggaatcgccacactgacttccacaatggttgaactggtttacagtcccaccaacagtgtaaaagtgttcctatttctccacatcctctccagaacctgttgtttcctgactttttaatgattgccattctaactggtgtgagatggtatctcactgtggttttgatttgcatttctctgatggccagtgatgatgagcattttttcatgtgttttttggctgcattaatgtcttcttttgagaagtgtctgttcgtatccttgcccgctttttgatggggttgtttgtttttttctctggcctatttaaaaagtctttcccagccaggcacgatggcttatgcctgtaatcccggcactttgggaggccaaggcaggaggatcatttgagcccaggagctcgagaccagcccaggcaacatagccaggtcttgtctctactaaaagttaaaacaacaacaacaataaaaaaaattagcctggcatggtggcatgcatgagggaaagaaaacaaattttggtgatgcatgaagtctctgtcatattctctgacatcccttcctcggtcccccaggccaggggaactttcgtatggcatatggggagagtggggagaggtggcagcctggactttcatctcttcttctaaatatattacatacagtgaaaaccgtggcttttgaacttaaaagcccagactcttgtaactcagaagtcctgttctggtggcctgagctgcctctctgctgaccagtgtgtcattctgtcatacagcaacagttacatgtggggaaagacacattcatggaagggcatgggaaaagctcagttcaggtctcaaggttcatcccactgtagttaacttgagaatttgggggctggcctggtgcctcatgcctggaatcccagtgctttgggaagccgaggcaggaggatcacttgagtccaggagtttgagaccagcctgggcaacatagtgaaactccacctctacacaaaataatgtattttaaaaaagctgggtgtggtggtgcgtgcctgtggtcctagctactctggaggctaaggcaaaaggatggcttgagctcaggaggtcgtggctgtagtgaactatgatcacaccactgcactccagcctgggtgacggagcgaaaccctgtctcaaaaagaaaaaaaaaaattcagctggaatgtttgctacccttgagctcacaaactctagtttctttctttttttgcagttggaatgtcattatgtgctttcaagtgctgggttccccgttagttccccagagtccccactgcacagcaatgaagcatccatccatcctcacggagggtcccaatgccacagtccatgtttgttcatgttgggaggctggaacacattcagaaggctcagaaccttggctccatttggactttggctctgccttgccagtacttgggctgctctttgtggtttaagtgatcctctttcttgccagaggagtctgaaacaaagcagaatcagggacgttctgctcacttcctaccaccatgctttcagaatcttacctttggctccaagcagcccatccatcctcaccttcttactcttgtcctgaacataacagaagagctcttttctgctcttcctagaggtttttgccagctcagtccctcgcggtgggcacttgcccgtcctgacaataacctgatgaccttcgctgctctgatgttcactctgacctgctgcctggacagcttttggaaatctccttctccagcagggcatctgctcctgtggctctcaaggctccagccagtgtttccagggacatttgtctcaatgggaacctttgggcagcctagaattttgaacagttgagaagccagcggtctttctctctgctcctctgccttttttttttttttaatggagtctcgctctgtcatccaggctggagtgcagtggtgtgatctcggctcactgcaacccaacctccatctccaggttcaagtgattctcccgcctctgcctcccaagtagctgggactacaggtgccccaacctaataataaaccaaacaatggtgcactccccatcccccacccatattagtggtgccaatcattgcctccccagctacactcccttattaatgaaactgaccacagccccaaggggcgcctctctgcatggtgcaaccctacccctcgcctcagctcactggacctgagctggacccggctccaactggaccaatcagaatctctctctttggattttttttgaaaaggagacctagagatttcattgactgtggggtgaccaggtgcactgctgagctaggaggtggggcagacaaccatggggccatggtcatcatgtgggtgtcgccacaacaaaagaatgaaacggatgtgtagaggcgtcaagggaagacccctggtaatcagagacagagagggagtccccatctcatgttctaagtctgctcttcgaacacctcctgggcccaggacagtcccctgtggcctctcagaacttcctttggagttaagctagtttgagtgggatgtggtccttgaagccaatttttcttcttttctaaaacccccaccagccgccaactcaacgatggtgccaaggacttaggaagtgctccccagtcatcgccctggtctgtcttacttggagagtgacctagaggtgaaagattgctgattggcagatgccctgtcagcaagggagatggtccttcgagagggcagaaggggccaggcgtggtggctcatgcctatagtcccagcaccttgggaggccaaggcagacagatcacccgaggtcaggagttcaagacctgcctggccaacatggtgaaaccctgtctgtactaaaaaatacaaaattagctgggcatggtggtgggcacctgtaatcccagctacttgggaggctgaggcgggagaatcacttgaacctggagatggaggttgggttgcagtgagccgagatcacaccactgcactccagcctggatgacagagcgagactccattaaaaaaaaaaaggcagaagagcagagagaaagaccgctggcttctcaacagttcaaaattctaggctgcccaaaggttcccattgagacaaatgtccctggaaacactggctggagccttgagagccacaggagcagacgccctgctggagaaggagatttccaaaagctgtccaggcagcaggtcagagtgaacatcagagcagcgaaggtcatcaggttattgtcaggacgggcaagtgcccaccgcgagggactgagctggcaaaaacctctaggaagagcagaaaagagctcttctgttatgttcaggacaagagtaagtaggtgaggatgcatgggctgcctcaatgactttcctgccctggacgtttattttgaattaaatgagctggagggtagtgttggcggggagtggcccttgcaaatggaactaatgacctgcatgcattgagtaattgcagttttgtcattgctttcagtggcaaacactgcaattacttttgtaccaatgtagtagaaagaggatgactttgagccagaggaaccaaagatctggttcaaatccaggctctgatttgcaagttgggcatctacgtctgtttgtgttgctgtaaaggaatacctgtgtctgggtaatttgcaatgaatagaggcttatttggctcatggttctgcaggctgtacgagaagcctgcatctgcttctggtgagggcctcaggctgcttccactcatggaggaaagcaaaggagagctgctgtgtgcagaggtcacatgcaagagaggaggcaagagacggagggaggtgccgggctcttttcaacaaccagctcctgcagaaacgaatagagtgagaactcacttccaccctcgtcccacacaagggagggcattgatctattcatgaggagtcctcccccatgacccaaacaccttccattaggctccatctctaacagcagagatcaaatttcaacctgagatctggagggggtcacataaaccaaactatagcacccagtgaccttataaagtgaaagcctcagtccccttccttgtaaagtgggcaggatggtctgccgataaggatgctgtgagtctgaccacttccttgttctttccttgtgcgactgtgattgacctgggcatggaaaggcttagtgccctgaaaggcaggctgggtgaaggtctggcagggtcctgaagggtgggggtgattccctgggtcctgggatgaaggggtcttagattttggtgtagttgtcctgtagatcccagagctggacctgacctcacttgagatacggatcgggttgctaggcaagggttcaccaggcagcatcatctgtgatgcatcctgcaggctgagcagtgaaggtaggaaaaggcattctagatgggaggaacagcacatgcaatttcaaggaggaggatggatgcttgtgtccggttctgtctacagcagctaatggctgttgctggcacactgaggaccagggagcaggaggggccaggcgggagggcttagcagggctgggttgcaacacacctgaaatgtcaccttgaggaacttgggctacctcttggaagccacttgcaagacaatggaatcacaggtggcacgatctgatttgaactccaaaaactgattcacagctgccttgaggcagaggggtggcatggctgtgaagcagccctgcccagatcttggggagagcctcagcatggcctgagaggcaggacttcttcacagtctgtctctagcgtatagccgagagcctaacgctaagtggtcatttaagattttgacttaatatccccaaaatgcaaggtgtcaagagccccaagtcagaccctgcatcatagacaccacttggcatcagaaataaaaacgcaagcagagccctcattgttgactctgaagccccccattcccccatcaggatgggactagctcaggaaggctggccgggctgtggcagctctcagaggcctggggacccacagggacctctctcagcagccattccagggcaggtgggagctgtttgctgatgggattaggggctcccctgctcactgtttttgacgctgctccccataatgggctccatccgagtctcacctcaatgtcctcgccttggagaaacctccctggaccgtgctgtctaaaataaacaccttctcaagtcaccttgctttgtccctcctgcaaatccccgaaatgatctcgttttatgcgttcacatgttttctgtcttgttctcttcacaagaccttgaactccacaagggcactgccttgcctgtcttgttcaatgccaaatccccacatggtgcttggcatccagtaggtgcccagaaaatatgtgagctacattccagagcctgctctgagccaggtgttatgcatagatcagctcatggtctcattggatcctcccaacagccccaggaaataggtgccactttggtcctcatttttcagatgggtaaactgaggttcagagaggctaagcatgtgacaccctcgcacaaccgcgaaatgacagagccagaatttgaacccagggccgctgcacgctggagccacagctctcccatggtgccatgctcctctgggtctcttcaacttctccactctctcttccgtattctcctttccttggaaatgaaattcatagctcacttttgtttttattttattttatttatttattttttgagacagagtctcactctgtcacccaggctggagtgcaatggcgcaatctagactcactgcaacctccgcctcccaggttcaagcgattctcctaccttaacctcccaaatagctgagattacaggcacctgccatcatgcctggctaatttttgtagagatggggttttgccatgttggccaggctggtctcgaactcctgacctcaggtgatcctcccaccttggcctcctgaagtgctgggattacaggcgtgagtcaccacgcctggcccatagctcgcttttaaagccttccctcctttcttgcacctcaatgactttcctgccctgtacatttattttgaattaaatgagctggagggtagtagtgttggcggggagtggcccttgcaaatggaactaatgacctgcgtgctggggaaggttgttctgccccgccctgccttctctgctgcaaagcacctctgctgtctcatgatttcctgtggagttctcatcaatgcctctttaagactcaaatggacaaataaactggctgagagagtgaggaagatttaattgagttcaactccaagcccttcatcctccccgtggagggtggcagggttcaaaatagggactttggctaccagcagatcgagggttgaatgcagggcccagccctgagcagctaccggacctcaggcctgtttctgaacctctcttggacttcaaggaaaaggtgacattggaagacccctctggaatttgagttttgcattttgacaagatagtggcaaattttcttccagaagggaggttctggggttctgagggtcaaagaagtcttcagactttttatcttagtcattggctcaacacactttttttttttttttttttttgtgacaaagtcttgctctgtcacccaggctggagtgcagtagtatgatcatagctcactgtaacctagaactcctggactcaagcaatcctcctgccttagcctcctgagtagtggagaatacagacatgagccactgctcctggctaacttttaaattttttatagagatgggggttttgccatgttgccctggctggtctcaaaactcctggccccaagcaaaccccctacctcagcttctcaaagtgctgggattccaggtgtgagcaaccacacttggccttcacaaatatttattgaacaccaactctgtacctccccagtatgatttctagggccctgccctcatggacttgtttctggtgagacagaaactcgggagaagagagtgagctgagagtgctgctcaggtcaaggctatggtcctgaatggtccataccagtctccagttgattgaataatgggttattcttttctccattcccctcccttccatactggcaaccatccaattctgtctgaagtatttctgcttgtatgtgtttttacaaaggtgcccccttttgcatgtattttaaattcatatgaatagtatgtgtattagtcagctattcctgcagtaaggctgtgtaacaaatcaccccaccactcagcaagtggcttccataaccaagcattatttttcttgcttgtgagtctgcaggttgggcgggttaccttgggtccaggctgagggttgtgttcaggtcttcttgctggacacatctcctgtcacactggggccagcaccaggggacattcttatggcagtggtggaaatgcaacaggggtgagccatgatctgggatactgtgtaagccctggctgggtgatggcacatggtcacctctgcccctatgtcactggacaaagcaagtcacatgttcaggcccaaagttagtcggatgggtgatatggtttggatttgtgtccccacccaaatctataatccccaatgctgaaggtggggcctgctgcagatgactggatcatgggggtggatttctcatgaatggtttaacaccatccccacttggtgctgtcatggcgatagtgagttctagtgagatccggttgtgtggcatctcctacctttctctcttcctcctgctgccaccatgtgaattgctgatttcccctttgccttttgctatgattgtaagtttcctgaggcctccccagaagccaagcagatgtcagcatcatgctttctgtacagcctgcagaacagtgagccaatgaaacctctgttctggccaggctaagtggctcacacctataatcccaacacttagggaggctgaggcaggtgaatcacttgaggtcaggagttcaagaccagcctggccaacatggtgaaaccccgtctctactaaaaatacaaaaattagccaggtgtggtggtgcatgcctgtaatcccagctacttgggaggccgaggtatgagaattacttgaatccaggagacagaggctgcagtgagccgagatcatgccactgcactccagcctgggtgacagaacaagactctttcttcataaattacccagtctcaggtatttctttatagcagtacgagaatggactgaaacagtggggaagactgttccccaagaaggacggctgtgaatgtctgctgaacagtaatgcagttgatctcagtttgtgctatagatctcattctgtttcttcagttttcatgcactctgtttgagattatccatgtggctgtgtctatacctaacccaacacccgcctgattctccacactgcgctcctcctgtgcctgtctgttctcttagtgatagacaacgagcttgtttccaaatccttgtcaccacaaaggaagctgcagagaacatcctcaggcctgtcctcctaaggacctgtgtgcatcctaaggacctgtgtcctcctaaggaccaaggatccacttggagtgtgcatccaggtgcaggctgatggagtcacagcgtagattacgttgaatttgcactgcttaaagttcccatatcctgaccaacactgggcattctccagctttctactgtttgcctatctaatcagtataaagcataaaacgacatctcattgcctcaacatgcatttccctgatgaggagtgcctctgagtatctcttcaagggctcttctggtttgagtttttgctcctagaaacaacttctgcccattctatactctgtgcttgccatgaggagaaaggccagtggggctgggatggaggcagcggcatgaagccagctgtttgagcacggtgggcttgagatcagagcgggatgtccacaggcatgggcaggagattgcagccgggaagctgtccagcctcctctactttgttccaggcattaattatttaaccttcattagcagctctgagatgggaaatttgttgtccctttgattggccccacgaagagcccgagtgaagaagcagatgtcaaatgatttgctttattataaatgacctggagagatacctggcaaagtcatcaccaagttctttctcaagttgctctgcagctcaagaaaagagctggccaggcacggtggctcacacctataatcccagcagtttgggaggccgaggcggaagaatcacttgagcccaggagttcaagaccaggctcttgctgtgagcctgggcaacataacaaggccccatctctataaaaaacaatagcaacaacaacaaaaaattagccaggcatgtggtgcatgtctgtagtctccgctactagggaggctgaggtgggaggattgcttgagcccaggagtttgagactgcagtgagctatgattgtgccactgcactccagcctggatgacagaataagaccctgtctctttaaaaaaagaaagaaaagagcatttgtgaatgacatcctttaaggacctactatatgctcaggacctcctaaatgctgtattctcagggacaatgtctaccttgagatgctaattggacttacctgactgcttacttctgagcattgaatccattccttccatcagtgcacatttcttgagcacctactatgtgccaggcactgtacaaggcccccaaaatacagcagtgaagaaaagaaaagcaatcctgtcttcctggagcttacatcccagtgggaggaatcagaccacaaataaatgtgtgacctgtggagcgtgttagatggtgttaagtggtgacaaggaaaataaagcagggagggttgcaattgtgaagagaacagtctaggggggcctcgctgggatggtgtcacttcagtgaagacccccaggaggtgagggggctggccatgtggggccagtgaggcatcacaggaaaaacgatgagaacagcacctagtaggcactctgtaaaattattgtggtttctcaatgaggaagtgaaggcgttgaggttatggaatctgccctaagtcaatcggctgctaggagcaagctgggactaagatgagggatctagaatgcaaaatttgaggaggcccttcaaccccagaggcatgtaagtgccagccctggccaaaaggtggagatggggctgcaatccaagcctctgactctcatacacacacccaggaagcactgcatacatgggggaggcctggctgtgcagtggcttggctattgcacatggcctgttctagggtataatctgggctgcaggagacccatgctggcaggagaggaaggtaatggtaaggaaggaggttccatggaggagggcagagagctgttcttccctcccattcctggtttgctcacgccatgctggttgccctggggtatgtggagtggaatctagcccacagcttcacctcatcaatctcaccatggggcagatgtatcagtaacagcagcatcagttaatacttttccaaaccacaaataaaagaaacacaatttagacagggtaataggaaaaagggaatttatgggctcaagtaactgaaatcatccttcaggcatggctggatccaggactcaaactacttcactggaatctgtctcttttcaccttttgatgttgcagttcctctgttatggctttattcgcaggcagattctctccagaagggaggatgtccgtacttagcagtcccagagggaagagagcttttcttccttagcggcacccacagaggccctacggctgattcccaccgggctcacttgggttacacgcccttcttgaatcaaccactgtctttagggagattcagaactctgattggccaagcctgggttgtgtgaccatccccgggtctaggagcaagaccaatcccaaaccatcaggaccgagggttggggaggcatagttccctaagtcagctgttaacagaagaagggagaatgggctgggtgagtccacaccacacactatgatgtcaccgtctgtcccttcccaggagccatttatttaccttctagtgcagtgattctcacatctggctgtcccttggaactacctggggaggttttgagaaatacaggtacctgggctgcacctttgcacattcagatgcaataggtctcaggtaggacctgggcattgttagtttttaaaagctcctctggaagagatacttacatgtgaccagggctgagaaccactgctttcccaggtccctgcaccttaataacctctgtgaatcatcactccgtgatttggagagttttcagtctgctagtttgtaaggagggaagcaaagagggacagaaatccttagccagactctaagccccttagccttcctctggctggcattaagtggagcgccggctggtgtctggtctcttgggatagagatcaggacagctctcaagggagtgtggcttctgaccagcatcaaagccacacaggttaaactccctctcccgaggcctgggcctgcttggcgactttctaacctagtccctcacctgccgaatgtcaccacccaccaaatgtcagcaggaagcagcctgactgaatccaattagaagcctctccctggtgtccagacagactgatgaaccagacagactgagcctgggcttttttgttttgttttgttttcttttcttttcttttctttccactcacaagaactttgttttccttagaactgggctgggggccgtcttggagggacccagagactgggaagggccaagtcacccacacaggagtgtcgctcagaggcggcgacattgcagatgctgtttactgcagggtcctgaggagctgggcagagttgggtagggagaaagttctgcaaggcaggtcctggagtcagatggacaagggctggaatctacactctgggactcactacctttcaacctcctgagcctcagtttccccatctgtcaaactgggctaataggaattcctacctgatagggtttttgtgagaatgaaagaagacaatgcttgtgaagtccacagacagggcatatgctagataaatgctggctgctacagttatctgcatttgctgaataagtatttattgagtgctcactttctcagggactgggggacatggaacgtatcgtctagtggatgagacaaacttgaacaaaataaccctaagaatgacttaagcaatgaggaaatgatgataaagcacgaatcctccactgtgtccacacattggaaccacctggggagattttaggaaatgctgatgtccaggccactccccaccccacacgcctcccaagagattctgattcaccagatctaggcagaggtgtgggcatcgatgctccttaaactctccctaggtgactccagtgggtggccagggttaagaagcatggtctgaagaaaggatgagtgatacctgtgtgtggcgaatgaactttgcctaggctaggcatcagggaggacttcctggaggaggtggctgggtggagcactgaggatgggtgggagccaactaaggtaggaacttagggcagaggtggggaaagtgttctaatcagggattggcatgtacaaaggccctgtggtgcagaggagaatggcatgaggggtccgagggagggcttgtgtggctggagcacagtgggtgagtgtggagacttgggaggggccgggcctgagccccacagagcaggtgaggccggtccaggtgaggcatctttcctccctctgaacaacaacgggagtcactgaaggattccggcgagaggtggcaaggtcagattctcatcgccaaaatatccttctgccaagaccagcctgggcaacaccgtgagaccccatctctacaaaaaaattgaaaaattaggcacgtacccgtggtcccagctacttgggaggctgaggtgggaggattgcttgagcctgggaagtcgaggctgcagtgagctgtgttcacaccactgcactccagcctgggtgaaaaagtgagaccttgcctcaaaaaaatgaaaaagaaaagaaaagaaaaacaaaagatcctgctggctgctgcgttgggagtagattggaggggcttcgagaggacatgggagacctgtcaggaggctaccacagtctgggtgagcaagggtggagggagggttgtcgagggaggccactcagtgcagaggtcaagggcttggcttctggcgtcaaactctgaacatatttctaaaccctccgagcctcagtttccttacctgaaaattgggggtagtactaatatctacctcacagggttgttgagataattaattgggccgttattaaatgcttctatcccggtggacacttaattgtcatcagccctctatgctatcttgacttacgtgactccttcatactgctaagcgctcaccccatatgtcactttcttcaatgagttgcttctccagtgggattccttatctaaggttttttttcgtttgttttttcctttgtgacggagtctcgctctgtcgcccaggctggagtggagtgatgtgatctcagctcactgcaacctttgcctcctggattcaagcaattttcctgcctcagcccccagagtagtgggatcacaggcatgtgccaccatgcccagctagttttgtttttttgtttttttgttttttttttttcagcacagataggatttcaccatgttggccagggtggtctcaaattcctgacctcaggtgatccaccagcaccggcctcccaggcccagtggcttcaggcatgagccactgtgcctgcaatcaaccatctttcagttgtctgccgcctccacccactagactgtccatgagttttgcaacggcagggaccaggactactttgaacatggctgccttcctagcctggtgcctggcacatagcaggtccttaataaatggataatccctcccttactttataaagccaggacagggaccagattgacttgcagtcaggtggctgtggaacacatcggtgatgacttctcatgccctgcatcagctgtcccgtgtctgtccctggagaaggctttgtcactcctttttcctatcttgtattcatgaagactgtttttctgaaatccaattagaagccccgcctcaattaacaaacaaaaactttcacagagcacgcttcccaaattttaccatgtactcgccatttcattcagctaattttttcccccttttcctctgatgttggcataaatgcatttttgttccaatctcctgggctgctgtctgctgtcactgtgtgaggtgctggcaccttgcctggaaacccaggactctgtgcacgccccaggcactgccctattcttggtagatcctctgttttctctcctttgggggcttggttaatgatgccatctttcaccttgtcacccccagcccctcggttcctgtcctaacgtgaaggcacctactggttccgtgaagctcaccttcctgcatcggtggaatctctcacctccttcccgtgaacattgcatggttgggacccaccctcggatggtcatggcgtgttcctaactggcctccctgcacccacctctctcctgctatgcatcttttatccatagccaggtttttctctccccgaaagctcagcttttctgtgtctattttcttctctgaaatcttcagtggcttcccatgaccacaacattctgggtcaagactctttctcagtcagcatttaaacacttctcccaatttgtcctcaacctagcctcgccttccacccctcctccctcccaccacctgacaccacagccttccggggacactcattcttcctggaaaatgccccacaacttactgcctctctgcctctaggcatgctggaacctcagcctgaaatgttggccctgcctatgttgacatttacacatcctttaaagccctgatcaaatgtcatatcctttaagaattttaattcctttactcaggaataattggtcctccaagttggatgtaagagaaatgtgtgaagtgggaacaagacaattactgtgagctgtctccctaatatctgtccaccctactctccttcctccagaaggaatttggttctgtttacctgtccactcttggggaatgagctcctaaatccccagtccaggagtgaatcctgattggtctaaatccacatggctatcccattcccttgacagtgattggtttagaagtaggcgtgtgatccggtgttgctgggagactggggaaggtctcttactcttaagagatgtgagtcgacctcttcttccacttcagctgggatagttgcagtcatattatgactgtaagggtcaaaattaaggacaactcatcatctatcatcctcatgatggcaaagcacaaatatgaaaacgccctttctgtggtgatattgttgagctgcaaaattaatcaactccagagatattttccttctaagttttcttttgtgtgtgataagaaaatcccttattgcttaagggagttgagtcagggcttcctgttacttgcagcctaaagcactcctgcagatacaagggcaacagctaagtcaattcaggtctccatgctctttgggatattatacagtcatacaaaagaaactctaagtttctgtggccacatgacacagcatttatgacattatttatgccaaaaaaaactcaacacacaaaactgtaggccctgcatgatgtaaaaatgtatgcaaatttttaaaaagatcaaaagaaaatactttttagaaaataatagctgtgttagggtagtacatttgttcatttctctctctcttgcaacctttagtaatgtgtgtacacacacatacatacacgtatgcatatacattatatgaagtacacatattctatatagtacataaatatctctttaatatatcgatcaatggtattacagtatatctaaatatataatactgtatataatgtctatatttgtgtatatagacattatatatatttgtgcatatatattatatatttttataagcatttatgtgtgtataatttttctcttactgatgtaaatgctttataaatataaatattacatttataaatatcaagcacttaaatatgaaactgaagtaatcctcacaaatcctgagttaacactattgttactcctattttactttgaggagactgaggcccagagaggttaggtaacttccccaaagtcacagagcaagtgtgtggtagagccaagatttgagcacagggtccagagtttgttcttttaattacaagggttcactctctcagagggtacctgaagaaatggctcccacaacactatttgtaattggtttttctggcacgttctctctctctctctgtctttctttctctctctctctttctttctttctttctttcttccttttttttttttttcttgacagagtcctgctctgttgcccaggctggagtgcagtggctcaatcttgcaacctccacctcctgggttcaagtgattctcctgcctcagcctcccaagtagctgggaccacaggcacccgccaccatgcctggctaatttttgtatttgtagagacggggtttcgccatgttggccaggctggtctcaaactcctggtctcaaacgatctgcctgcctcagtctcccaaagtgctgggattataggtgtgaaccactttgcctggcgtttttggcactttctgccacatgcatgcactggtgaggatttctggtgaggtctcctctccctttgctcttagcatgtgggtgccccagggacaggactttgacaaaaggtgtttgggctgtgggagtgaggatgatcctcctggggagcaggagccttctcggggtacaggggcagaacagccacttggccatggctgcccagatggctgtggtgtgctgagtgccacacagagacctgatcctggccgggagcagcagagccaagcttggtggttgtgtctggtacatctcccagtaccaggtttttttgcagcccatgaataccagttcaatttgtcaaatcagttcatgcaaatagtatgtttaaaggaaaagccaggcatggtggcttacgcctgtaatcccaacactttgggaggtcaaggcaggaggattgcttgaggccaggagtttcagaccagcctgggcaatatagtgaaactccttctctacaaaaaataagaacattagccgggcatggtggcgggtgcctgtggtcctatgttctcaggaggcagaggcaggaggattgtttaagcccagggggtcgtgtgaggctgcagtgagctatgattgcaccactgcaccacagcctgggcaacagagggagaccccatctctacaaaaatatgttagagcaggtgtggagttaggagtgatgaggaggcttatgggcatctccatgggatggctctacctgtctgtgtttggaaagaaggctgctgtgtaggattggctgtcatccatcactggattctaaccctggggcaaatgtattggagagctgtccaaagggcagtgctgaaagcttgggtcatgggagaaagaatagtgtagagtgaacaaagagggacgagatgaggagggggcacagggactaggaattcaggtcagcatccacatcagagtctcatcttcccacagaggtgatcggtactatcgatcgggtcgggggtgatctattatcattgagtagggaaacttactaggttaaatagaaagtatataaaatgtatttggttatagatatgtgaaggaaaaggcataattatatggtcatccatgctggggaatattttgtagttatgttttgttgagagaaatagaacatattggatcaatagaattagacaaatatcttgggcatcaagagacctggaaacatgggaatgataaagagagaaaaactgcagttttgacgttcttgaggccacaagagagatggaggaatgagggtagtgtagaggagagagaaataagtcattttgggggtgtgaaggatgggtgatggataaggagaggcacatgtgcatggtcagaacaagggtaaataaatgaaatgttgattaatttgtttattatgttctgatcaccagcactgaaggacataatggactcaggaagccaaaaaaaaaaaaaaagacaacaaacaacaacaacaacaataaaaacagagagagagaaaagaaaaagaaaaagcaacccttacttgatggtcttttgagggttggcttaggttattagaaatagtgacattctgatgccccagtctctttccctgtctcttgcagctgccaacaatagtgggtcacaggtacgatcaaggcagggtcctcaacttgagaaggggctgccgcataagacaggtcactaaaacaagagcctggaaaagaaaccaacacaaagatctggttatatacagggcatatccaagctatcaagccagttcccctaactgagcaggaagccaggttataagaactggggcacaattgagaaagcttgtgagggatgagtaggagttttggagggaaaatgagggagagggaaatccaggcacatgaatgtgccttgcatgtctcttttggggaatggtgggaaattcatgtacctggggtttgtggtgattgtgttgtgagagatgaggctgtaaaagttaacagggttgatgtttaaaaggaatatggcagatataaggctatggagtttaaatagtagtaagaatgacattcaaaatctttaacaacacaccggcaccaaccatcagaacagacactggccgtggtgctggaccaagtcttggcagggaaactccagggttttggagggcatgggagcagtgtgtgtgttggatggaggactgggggtgcggtggggaaagaacaggtgaaacacttggagaaggtgctgaagacagcagctacttactggtatgagctggtaggaaaatattttaatatttgaaccgtcagaatggctgtgcaggtgcatattagctgaccatcaggcctgagtggggagcaggggagtgatataactggatttttgctttgaaaagtggctctggtcacagcaaatgtttgttcaccaggtggattgatgggtaatagaattttagaatgggtagggacctcggctaatttcattccgtctgatagaacataaaagtttccagcccttctcagcctaggtctagctagaaatcacctgcttccatctggccccttattccccacgactaaacatattcccagctccctgcattctctgctcttggccactgcagccgtgaagcctgtccctgcctggttgcctctgctcagccctgtctggacacgcctgctgtgccttgctgtttcctcccctcaccagcaggagaagtggcaatcttctgggatttaattacaggttccctgagggcctttcagcccatcacaggactcctgcaggctgccggctgggagggtgacaggagcatgccgtgatgaacagtgacttcccgggatggctgctatagcaagtgaccggcccacgctcctcaggctgctctgcattttcctgagcaaaacatgtctcactcctattttgcaagatcagatagcaaacggggaaaacacttgcagcagggaagatgataaaagagagagggctgtgcagccatggtggaggacagaaggcactgcagtttccctggaggtggcgtctgcctcccaacgactcctggaaactctccatcgttaaataatgacttagtaatcctgctcactttaattaagtcagcctggtgtgcggacaactcaggtccaagtggggatctttttggcctcaggcagccatgctacagtccaaaaaagcccacagactagggtcagcaaagatacagtaggcacaccatgattcctcaccaccttcgcccacaccagacattgttaattgatcgtgcacaacaaagtccaaatgttttaggagcctggatgtgagttctggttattcagagcttgggaatactttaaaatatgacaattgaagattttaaattttggtcctcttaatgtacaatgggttcatggaaggtatgcctcaaaggaggacattctgaccgagccacaaggccccttcccccgagtcaagattccataatcttttttcaattcagcccccttcggaacatgccatttggcatgggatgggatagatcctcatcaagagggatgggataaatcacttactgctgcacttttggcccttactcccaggatgataaataagcattgaaagatatgggtttttctaaatactctgtctcttattttcctcctttcaggtgaaaatccaatgatatggactccatattatcaactagggtgtaatgttgagccgactccccctcctgtaatgtaatttctccattgggcacccatgtctccatcactctcagcctgtgtggtcagggtgaggctggctctatctccaaggctgggcacacggtccaggcttggccaattggagttttccatcttcttggctgccatgatgagtactggattctaggaagctagatgttctgctgcatttgctgaaaaaatggagctctccttctcctgggtgtggaccaagtcagaggggtgtttgcctggagcttctggtgaatgtctttgtcatccccgtagggagatcctgcaaaggctctgaggtgagaccgagcttggcatgttttgaggaacagaaagagagaatggttggggcatggaaggtaaggggagaatggtaggagatggagtcagagaggaaggtagggaccagatcatgggcagccatgatggccatgatagggaattgggagatttttctaacagcagtgggaagtcattgccactttgggcatccccatgccctggaaccttctttgtactgactccttcctccttattgagtcatcttggatacgaacaggtttgaatgagaattgaaagactctgggcatccctaggctctgcctttgtgatatgcgcaagttgcactcatctctgggcctgtttctactgtggctcatgatggaatcagacaagtttaaggagaatggaaagctttaatccttcatcccttctattctcaattggtagtgcctgcctggacagctgtgtggagaaggattgtgaggcgtctcccaggctccgtgggagagtgccatgatcgattagcaatgtctgccctgggtaaaggaacgggaatgatgaatcatccatcttaagactacacactcccagaggtgtctcccatagcatttcatggtactttacatcagatgtatcagaaacttagagcaccagaccaaggataaaaatgttcagcaagcctttgcagggcttcccattttacaaagattcttcctgcccattttcttgttggatcttcgcagcctcctcaaaccatcttctttattcttttttttctttttctttctttttttttttcttttttttgagatggagtcttgctctgtcgcccaggctggagtgcaatggcatgatcttggctcactgtgacctccgcctcccaggttcaagtgattctcctgccttggcctcctgagtagttgggaccacaggcgcccgccaccatgcctgactaattttttgtatttttagtatagacagggttttgccacgttggccaggctagtcttgagctcctgacctcaaatgatccacctgcctcggcatcctaaagtgctgggattataagcatgagccaccacgccaggccctcaaaccatcttaataggaaaacaatctgttgtgtttgccccatagccagcatccctttttctggtaaccatactctggttgttgtttttttctgctgggtgtcaagctctttctatgctcaggccatgtagtttgtgactgaggttgaagcaggagacccaggcctacggcagtcaaagcatcacattcccctgtggatgggttgatggattcatgaccaaatcagaggttatgcaatacaatgaaatgtctgctgcaacctcaggggaagagagctgtgcccagtggatttgaaggtggttggatgtgggtctaggtgtgttggggctgtttcctgtggccctgaaagctgatttcacacatttcttctcaacttggcattcaaaatctgccacagtagaaggatttgctaaaaatcagggattttttttttggtcccaagagctggcttggcttccggccactttcttaccatggcatggagtctgagacccaagccacagcatggaagatggagccaaaagttagaaaaggaccgagtcctccgtctagctgtgcccgaagccagatctgctttttagctgatgaattattcttctgtttatgcctgtcgtggttgtatttctatcccttgcaactaagagaagtctgatataaattttagattcagcaggctaaagaaaagatggtttaattctcatctctttaaaactctgggaatacttccccactgccttgggaggaatggctggattctcacctggcaccctaggttttctgccatctggccccagttgctgtctctggcttcagaggaaggcctcctatgctctgggttgattgggtttcttaactgccctcaacaaagtctcctcttttgcttattctgttcctctctacctggaacaccctttctttctccacagctacattcctgtcattgtttagggtcctgctcattccccctacatccttggagctatgccagcttctccccccgcccctctctctcagcacacagcactttcttgattgtagagtcctcacgcccagctcactgcctcttctacatttgagcactttaaggtcaggactgcatgaggttcatcttcaaatcctcccgaatacctgttacatcaccttgcacaaaacaggccatcaggaaatacttgtgaagccaacagatccattctcaacccagcagctagagtgatctactgcaaacgcaaattatattgggccaccggcttctttaaaatcctctgaccagaattcccacctcactggcctctggattacagaaaaaaagcacgaagcaagcttgctcccacctcaggcctttgcacttgctgtgtgtggatttatcttcacccaactctttatttagcttcctccttcctaccaggatttagctcaaatgtcacctcctcatagacatcttgcctggacactcttaactgatatagccccactctagacattttttttttgcattgagtgattttaattttattttttccattaatgatgatcaatgcttatatagcacttatgatgtatcacatcgtgtcctaagcaaatacaggagtatattaactcttttagtttttaacaaccccatgagggaggtgcccccattttacacacaaagaatgagtgtcataagctggcttccctgggaacagagcctgagatgggaattctggtgcccatgaatttttggagagatactttcaggtaaaagggagagagcatggcacagtagttcatgcctgccgtcccagcactttgggaggctgagatgggaggattatttgaggccaggagtctgagatcagcctaagcaacagaatgagaactcatctctacaaaaaaaaaaaaaaaaggattaaaaatattagctggcatggtggtttgcaacccaactacttgggaggctgaggtgggaggattgcttgagcccaggagtttgagtctgcactgagctgtgattgcaccactgtactccagcctgggcaacacagcaagactctgtctctaaaaaaaaaatataaatacataaaatttagaaagaaaaacatgtttaagagagggcagaggaagataaattagacacagagggcagagtaagggaaatggcatggaaggggtgtggtctccccagagactgaccccctgggaagctctggagtgtgaattatactgcagagttggttccaccttcagccacaggaagcacgccttttttcctcattgggtgtctcaggggttagagggaatcaccataaccttccaggtgagctggctgcaattcaaccaagggcatgtttctgcagaaggggagagtgtgctcctttagtggcccgtcatggcagccagggagtgatgtatcactgcaaaggggacctgggtaggcaccaggaatattcactgcaaaaaaagttaaatgatttgcccgagggccccacccggtaagtggcagaaccagaatttaaacccaggttgtctgtctgttcctttaacctctctgctgtggctgccgctacctgacatgatcctattgtatttattattattattttttagagacatggtcccactgtgttgcccaggttggagtgcagtggctattcaaaggcatagtcatagctcactgcagcctcaaactcctgggctcaagcgatcctcccctctcagtttccccaatcctattgacttttgaaaacttgtttattttcaatctcctcaagacagcagactcattggtttcattcgtagctatgtccccagcaccttgaacagcacccagcacatagtaggtgctcagtaaatacttgtggcttgagtgagtgaatgaacgactgagaactgtggacctgtgagcctaggcagccaggctgactctcttgcctgtggctttgcttgctcagcgccctgccctgtgtgtctgatctttatttatggctccacaaagccttctgctgttcatggatttctttgctttcaaatatttcttttgtaaccaaaatgaaagtctggcaaattcccctaaatcacagactcccttggctcttctgcccccaccctgcccctccctccctattttccagtgagttttcaaaaccaacagggtgtgtgtgtgtgtgtgtgtgtgtgtgtgtgtgtgtgtgtgtgtacatcctctgggggaagagacacctctgctccctcatcccctctcagagttgccccatccatcagcctgggttttgcctcagctctgatcaatacctgcttggtagcggcttagtgatatctacggttaagagccatttgttcctttcttggttgcaggtagattctcatcaaaacccatttggaatcacagccgttcagtgatcacacaaatgacatgggagcagtaatcacagggctccgaagtttaggcagaagaatgtcacctgccacttgtctacggtcccttccagacacttgttatttttacttaggtgtgggtgtagccaggggcaatctgcaagatatttagcatctggtaggatgcaggattgacctatcagcctggttgtatccttttcccatgatttatatgttattattactaaaaataatagctctagcatcgggaatgcaacttacatgctaggctcatttgtgctaaatgctttcaaaattcctcctaaattatccaggcatggtggtgagtgcctggggtcccagctactcgggaggttgaggtgggagaatcactagagcctgggaggtcgaggctgcagtgagccatgattctgccactgcactccagcctgggcaacagagtgagatcttgtcaaaaaaaaaaaaatagaaaagaaaagaaaaaggaaaagaaagagaaaacgcttctaaaacagctctgggaggctgtatcctcactttgcatatcaggaaactgaggctcggagagagaaccatttttccattcttcataatcattacatttggaagctacagaataatattccatccacaatatatgaacttggtactccacttaatgttgtactaagttcatataacaattctactgccaaaccattcatattgtttccagtctttttgctggtataaataatgtagccatgacagtccttgtatcattagagattccttgaagaattcattttggatgactatataatatttcatattgtcaacgaagacatgtgtacaaggatactaattgcatcattacttataatagcaaaaaatggaatgctattaagccacacagaaaaatgctcctgagattatattaagtgaaagtaacagggtgcaaaactgcatgatctgcaagctcctggttatagacggaggaaacttacatatgcgttaaaaaaaaaaaaaactggaaggaaataggctcaaattttaccagttattgctggtggtgaccttatatgggaaactattttctcatatttctatatttttcaaattctttccgataagcatgtgttacttttaaattagaaaatacgtagaaaaaaattttaaaataattaaatttagtctgtgagtgtaggtcattgctgtagccctggggcagcagacttttctttaaaaggaccagaaagtaaatatctggatagtaaatactggctttgggaaccacacagtctctattgtggttactcacctctgccattgttatatgaaagcagccatagatgatacataaatgaatgaacttgattgtggtccaataaaactttatttgtctgtattccaataaaatcttatttacaaaaacaggaggcatggcaaatttggcccataggctgtagtttgacaacccctgctctcatctcccaaatcattattttccttttaataaactgactttatgaaatattggagtaaatacaaatgaatatttatgaaaataagttcaaaataccattaataagaatgcagcgaatcaccaatttaagcaaaacgtcattaccattagctttggattcctaggtcccttgccctgagatcccagcccctccctcaaaggcaacctctttcttgacttctagatagaacattcccttgcatttgttcagtttcgcgacaagttagtatcattaaatacactgtatctttttgcttatctttgaactttagataaattggatcatggtacatgtgttatcatgttaacatggtacatgggtacacagagttaacttgtttacattatgttcttaagattcctccacattggccaggcgtggtggcttacacctgtaatcccagcactttgggaggctgaggcaggaggatcacttgagcccaggagtttcagagcagcctgggcaacatggtgagaccctgtctccattaaaaaaaaacacacacacacaaataaataaaaataaagattctgccatgttgatgtttgtagccattatccatttctgttcacagcttcctagcaagcattctatgctgtgaatacaccacaatttatttatccattctactgtcgataaccatttagttgtttccagttttttttcccatttcaaactgtgccattatgaacattgttgaacctgtattatggtgcaagaatgtctttaacttttataaattggactgtgattgctgggtcgtaggacacaaacatcttcaactacactaggtaaggacaaattggtctctgaagtggctgcgtcaatctgtggagccactcccacattctcaccagcgtttgctatcttcatactaatcatttttaaccttgatgttgttgttgtgagtatatatgaaatctgaagatataacagccagaccagacctttagtcttttgttttgttttggttttgagacagggtcttgctctgttgctcaggctggagtgcagtggtacaatcagggatcactgcagcctcaacctcctgggctcaagtgatcctcccacctcatcctccccagtagctggaactgcaggtgcacaccaccatgcctggctaattaaaagaatgtttttagtagagaccaggtctcactatgttgcccaggttggtctcaaactcctgggcttaagcgatcctcctgcctcagcctcttgaagtgctaggattataggcatgagccactgtgcccagccagacctttggtcttaatgccagttgtctgaccttaagtgggcttggctgtgaggcatgctgggagcttgggtacatggatggtgagacagtggtaggagtcagacccttgtagggttgcgggaactcaccaagccccagcctgaccaccacaaagcaggtggtcagtgtccttatagcttgaatccaaagctgatcaacaaatcattcatttattcaacaaatgttaaggaatgcctgctatgtgtcaggcgcagttcaagacactggggcccagtggcatataggagacaaaaacccctgcctccatggagcttccactctcaaagagagaaacaaactttcaaaaaagtaagttgtcagtcacatggtattattagatggcaataagtgtggagaaaagtaaagcggggctgaggctgtgaagaagggcagggagtgagagagcgtttacattacagttgggggagccagagggggccttctcaagaaggtgacatttgagcaaagatcaaaggagtggaggacaaaaccatgaggatgccatgtggttgggggagggagtggggaggttccaaacagcagaacagcaggtgcacaggccctgaggcagaaaatacccaggatattcaaacagcagccaagcagcaaggagatgcctggagtaaagagagaaagggatgggaggccaaggtggaagggtcacctgaggtcaggagttggagaccagcctggccaacatggccaaacaccatctctactaaaaatacaaaacatcagcagggtgtggtggcgggcgcctgtaatcccagctatttgggaggctgaggcatgagaatagcttgaacctgggaggcggaggttgcagtgaatggagaatgtgccactgcactccagcctgggtgacagagtgagaccctgtctcaaaagagagagaggagagagagagagagagagagagagagagcgagagagaggtgatgaggctagagaagaaaggaggccagattgtactgggctacacaaacagtgggcttggttgtggctgccaagaaactccaaggaagtccagtcaggctgggtgggggcagcaggatccggcagctgctagggaggaagtgggcaggaactacagggagtgccaggtccccagcccttgactggggctcagggcagggaactggaattttttgtatttttgttgttgttgttgttgttttttagacaggttcttgctctgtcacccaggctggagtgcagtgatgcaatcatggctcactgcagcttcaacttcctgagctcaagcaatcctcctgcctcagcctcccgagttgtacatggcacaagtgcatgccaccacgcctggcaagttttggtatttttgtagatatgggctttcactatgctgcccaggctggtcttggactcctgggctcaagcaatcctgctgccttggcctcccaaagtgctggcgttacaggtgagagccaccacacccagcctagacctggagttcttgggtagactgaggcaggttcctgcatgtgtcagtcatcctgaccaggggcttttgtacctgtgtgtgtttgggtgtctgtgatgggaagactgagggtcatgaaccatgcagttcatcatccatggcaataagactgatgaactagaaagctccatggcctcaagtggcctggttcaaaccttggtcttgccattttctagttgtgtgaccttaagcaagtcaatggacctttcatgcctcagtttcttgactataaaatggggataatcacattacctacctcacagaggtttttgtgatgattaaatcagttgtgattcaaacagcatgagtagtatagtaagtactttataaatactctttcttattagttatagtatttctcttgaatactacatttgtccttgtcccaaatatggaccagaccaggaggggcatgaaaagatgcacatcagctgggtgtagtggctcatgcctgtaatcctgcactttgggaggccaaggggggcagattgtctgaggtcatgagtttgagcacagcctggccaacatggtgaaaacccgtgtctactaaaaaaaaaaaaaaaagtagccaggcatggtggcatgtgcctgtaatcccagctactcaggaggctgaggcaggagaatctcttggacctgggaggtggaggttgcagtgagctgagatcatgccactacactccagcctgggtgacagagcaagactctgtctaaacaaaaaaaaaaaaaaaaaaagaaagaaaagatgcacatcatttaattactgtgtgctcatgggcaagttacattgcttccccgaaccttgatgttcttaacaatgaaatgggactgtgaaacttctctttagagaatcagaagtgacagcttataaagatctaggtgcaggctgggcatggtggctcacgcatgtagttccagctacttgggaggctgaggtgggaggatcacatgagccctggaggtcgggactgctgtgagatatgatcacaccattgtgttccagcatgggcaacagagcaagaccttgtctcaaaaaaaaaaaaaaaaaaaaaaaagctgggtgcagtgcagagtcatgcaggtgtttggttagttccttcgccttctccctcctttcatcaacattgtcctctctggggccaggtcagtggtggctcacgcctgtaatcccaacactttgagaggctgaggtgggacccttgcttgagcctaagagttcaaggctgcagtgagccataatcacaccactacaccgctgcagttcagcttgggtgacagagtgaaaccctgtcaaaaaaaaaaaaaaaaagaaaaagaagaaagaaagaaagaaaaaagaaagaaagaaagaaaaagaaagaaagagagaaaagaaaaaataattgttccctctggcctagtccaaaggcagatagtgaatgaggtgtgggtcctgacttctggggcccaaagtctcacaaggcagaaaaataatggcatgacaatgaggtaagcaccatagcgacaggatagcagctaactagagagaactcttgctgtgtgccagacactacatgaagcccctcccatgggatatctactagatgggtgatgttattgtcatccccattttcaggtggggaaactcaggtttagaaatgttaaatgatgggccccaggtccctacggctggtaagtgtaggcaccagggcttgagctacactctctgactccagcctgttttaatgcagaggggctgtaagggcatagagaagtgagctatcagcctttggggtggggtgggaagaggaggttactgaagccctcagtgggatgagatactgagctgaatcttgcaggatgtgtaggagttggccaagcaaaacactgtggtttgaatgtttttgtcctctccaaaaattcatgtgttggaaacttaatcccaatgcaacggtgttagagttttggcctttgggaagtgtttaggtcaggagggctccatcctcatgaatggattaatgctgctataaaaagggcttgcaggagtgtattagctctctcttgcccttcctgccatgcaaggacgcaggaagaaggcccacaccagaaaagccaccttgttcttggatttcccagcctccagaactgtgagaagtaaatttctgttttttaaaaattacccagtctctggtattctgttatagcagcgcaaactggactaggaaacagaccaaagtgtagacaggacgggcagatggaagagtacttgccaaggctctagagacttgggggaaatgtaacatgcatcagttctctattgccatgacaatgctgcatactgatcacaaccttcagaggtctgcaagtataagcgtttactgcttcaacatgtggggtgatcagctcgatggttttgctgattgtggctagcttgctttatgtctaggcacagacagactgtttggctgacctaggccagcctcagctgggatgattaggttctgcccagtgggtccttcatcctccagcaggctagcctgggtgacaacaggtgcaagcaagagggattgcactggttgtgcaatgtgcttgtgtctcatccgctaacatcccattggccaaagcaagtcccatggctgagctcaaagtcagaagtgggagagtattttaaaagggtacagacacaggaagggtgaataatttgggaccatgcttgcaatctaccaggtaggtagtttaggggagttggagggtggggcgtggggaagctgcagatgcaattgccaaggtcacaggggacaagtttgtggagcatgggcaagagtgggccaatgggaaagtaggaaggaggcaagaggctgttgcaaccacaagaaaggacacaggcctagactggggcaacagcagaggggatagaagagattgattatgctacatttgtcctacaaaaccaagacagccaggctgagacatttgttctgttacacagatgtcacagatggcccctgggatataattggccttggcctctgcagaaaggttaattgctcagatcacacagtctgaagctttctggaatggacagagcagctccccaattaaaaccccagagctgcagagctttctctctcctctggtcacttggccagggctgcacagggcagatgaggagcagagatgctgggagccctgcctatgagggagctcatatccccagagggagactaagaaatgagcaaacattccagggctgggacagacatccttgcagggacagtcaaggaaggcaaaagcctattttggctgcaaaagaaagaaaactcatttcaaacagacttgagctgaaggaggagtttactggctccataattcaagtatcagggacatatcacagtcaggcacagctggatccaggcgctcccacaatgctcttaagagtcagccattctctctctgctcggctctcctgggtttccttctgagggggtctgtactggcagaggtgctcccggcagctccagtttccactttctccagtttagcaactcccagtggaaagggaccgcctcttcaacagatgtttctgcaaattcccaggtctagctctgattggcccagcttgagtcatgtgcccatcccttaaccaatcacagtagactctgaggatactagccctgtagctgggagcagctggactgtcccccatactcaagtgctgagaatggggtagtggtggtctctggaaggaaaagtgggttctatttccaagagggatgctgggctggcccagggcacaggaggggcagtggaggtggtgagacagggtgtccatacccatcggggtctcgggagtcatgtcacagaggggatgggccttcaagttgagtctgactgcccgtttcacagacgggtaaactgaggcaaaggtatgatcatttcaaaatgagaccgctgctagggagacaattaaacaagatgtcagaatggggcgtggccaggggagagaaggttgggtaggtggatgggttaggatctttctggttccttgatgaagagcttacatttgaactgagacctgagtgcagatgaggaaccagccctgtgagaataagaggaaagaacatttcagggggagcaggaggtgcagagggccccgggctgaagcaaacttgatctcctagggacccaggatgctggacacactaacatctcaacacctcctcagatcctcagggaagcggggtaagaaccaggaaggccacacgccagcttttcagagcctggtggccaggactagtcacacagcaagggagcctggggaaatagggggatttcatggcttctgagtgagaagtttgtaaatgtttccgccagggaaacccaccctcccgtcgctatcttctactagaagctcttagttgaaaaattttgcttaatatgctggctacaagctctatctcatgagtgccttaatttaaattttattacgagagaggttgaattaatttttccataggattttaactacgttggtttcttcctttgtgagctatctggaaacctaacctttcgagcctccttaaaaaacttttttttttaaacctgaaacaggaggcatttggaagctgtgatctcaaaggccccgtccaacttgtatattcccgtggattctctgatctttaaaaataccaaaggaaatgccatttatattggcaaaagctttgtgggtgcctcccagatgagagaataaacccctgaagttggtgcgtctagatatttttagacttctctgccacagtgataaagccaggatccttttggtcaaggtggtgaggcaggggtgggagtgggaaggtgggggaagggtagtggcaagagaaaagatgctgtctagtaataagatagagattcagagctcaccatagactcaggcaggatcatgcatcatgcatcccccgccccgccctgccaccaagatgaatgccgtactgagacagaagaagtacattcttcgtgctaggatagacccttcatgtaccattgcagataagccttaaaaaatttctacccacaaatatttgttcattattctgtccatgtcttaaaggtgctggctcatgtctgtaatcccagcactttggaaggctgtgggaggactgcttgaggccaggagttcaagagcagcctgggcaacagaatgagaccctgtctctacaaaaaaataaaattagccaggcagcatgacacatgcctgtggtcccagctaattgggaggttgaggtggggaggatcacttgagcccaggaggtgcagtgagctatgattgcactgctgcagtccagcctgggcaacaaagtgagaccctgtcgctttaaaaaaaaaaaaaaaaaaaagattctggcatgaacggaatagcattttcccctttgtgtggtccagccaagtgctcagtagaagttgaagaaatgtctgctgttaagaaacagagtactgggttggagaccatgctcggctagaagccgtgtgaccttcttcaaatcttgtcccctctctggggtgaatttttagcacaaaaaaatgcagtgggatggactcaatcatgattgggtttctgagctctgtgaaggattggaaactggtgtcctagggcctcacagttgtgtttgaaaagatttgaattcattattttttcaaaatgaaatttcatgtaaaacccaagatttctggcttctttggaagagttggaagatctggcaaccccgagtgcatattcccacctgtcggctgcggctgtggcttctcctgggatgtgaccatccctgaatgtgacccctccaggtggctgcagctgccatgactttctgtgcttttcttgacacggaagcagagcattcacccccatttatgactgtgcttgtacctttccttaaggaggaaagtgagagatgtcttgtaatcgtgtttccatcagaggtggggaaagcatgtgcaaaggccctggggtgggaatgagttttgtggctggaaaggagcctcaggaaggaaggggagggagataaggcaggagaggtgggcaggggccaggtcacttagggccctggaagaaacctggatttcactttgagtatgatgggaaaccattggaacattagagggatttatggaggggagattcgatttacattctagaaagatccttttggctgctgaatggtcatacatgctagggaaaaaaataaaaaggaaagggggctagggagtattggggaggggcatcggcaattttaaatagtgggatcagggaagacatcactgagaagtgacatttaggcaaaacttagaagactgggcatggtggctgacacccataatcccagcgctttgggaggctgagacaggaggatcacttgacctcaggagtttaagaccagcttggacaatatagccaaaccccatctctacaaaaaaattaaaaattagctaggcatggtggtatgtgcctgtggtcccagctacttgggagcctgaggtaggagaggattgcttgagcccaggaattcaaggttacagtgaacaattcaggccactgcactctggcctgggtgataaaaaaaacctccaaaaccttagggcaggtggagagacacaggggaacagcatttcatgcagagggagcagcaagtgcaaagtccccaaggcaagagtgtgcctggcacgtttcagcaacagcaagtgggccagggtgcctggaggaaggtgagcaaggggaaagggggcagaagacagggtcgaaagtgagggggagttaacggccattgtacaggtgaccgctggctctgacaggtaagtgaatgccgagtcagctggggctcacactcagtgtcttcataggaccttggtggggggtctctgtcttgactgggggacttcctggggctgggacttccaaatctgggtgccaggatactgcactctgtccgccaagcccctgacttctggcctgccctggaggatttggtccctggtggctcattgcagctttgaggccactctccctccagggccccaagggggggcatcttagcatctggagccccctccaccatgcactcaaaatgggctttggtggagaggtgggaagaaaagttgatggaggtaggtgggcgttctgcagccccctttagtactcgtccttgtgggacacacatcagaggaaagtgacccggggtccgcaggggacgactctactctgcctcccacgggcagtctgtctcctctcccctgtcttggctgtggtttccaccatccagacagttgcccctgcttccagggagccctgcagaagtctccccacagggcagcactgacaccaggcccacttctctctctctgtgtggcagccagagggaatactgggtacccaggtccgaccacgttgctccctggcgggaggcttcccacaactccctgctgcctggggatcaagtagcctcttctgcgggctcctagcccccaggatttggcctctgggtccagccacaccagctccaggctcccgccccctgggtctcgttcttcttgctggactcccccttgtccttcaagacctcctccagctcctcctccagaaacccctgggactcctgtgcctgagccaggctggtcccttctggatccctgcagcctctggtcactcggctcgcctggccgccactgctttgcctggctgtgtccttgtctctgtggttcatactgaaagctgccttccactgccacctcccagctgcagcatggcacccgacattgagcagcaataggaaacaaaagatggtacccgctgggcacttgctggctactctctgggtaccctgtcctgttcccgcatgtgtcactaaagcctcactgcagcccttaaggcggacatcgttttcattccattttacagatgagaaaaccaagatccagccagatttaaataacgcccaaggcaccctgctggtaagcggaggaggtgggatgtgatcacaccctgcctggctccagagccctgctcttgtcccctccccatccctccctgctgaaagtgaattaatgagtgagtcagtgaatacagatgaccaaagcctcctgcaccagcggccccccctctccctccccttgctctgaagcttgggcgaacctcccgtctcatcatcggcacccgcggggtctgcactgccagcctcaccaccccctccttccccacctcctgaagccagattcccccttggcatcggcctctctgcggaatcagcttccctccccacaaatgtcaccagaggggttccaatcgccaaagcccgtggccttttctcatctctcagtcttcatttcccttgaccttttggtggcattcatgacagcggctcccttctcctggaagcagttttttccctcggcctctctgctgctgaacaactctggccatctccttttcctcctggctggtggcatttcttcactcattcatttagcaagttctttgctgagcgccacccatgccagagccagatgtggttcccggagcgggtgctggacagacagacaacatcctgccagaccagacctcagtaaaccagtgaataacaccacttccaataaccaggagggcagaggggatagtacaatagggggaaggaccgaaagtgactgtgtgtgacggcagtggtggctgctttaaatggaggggttggggtcatctgagctgggaagcagccggccaagtgacgctgggggaagaacactgggccaagggcacagcaagtgcaaaggccctgaggtggctttggaggaagggagctgcccatgaggctggagtgtggagggacaggggatgacaaagggtaggcagtggtctgacaatctggtagaaactcaaatgtcaaggcacggagctggggtttatcccaagcactacggggcatcaccagaaggttgcaggaggagagagacccgatggtatttacatttctgaaaggtaactctttctcataaaatggcccgtgcatctgaacgacctggggcacttgctcgaagtgcagatcccagcctcttcccaaacttgcagcatcagattccacaggggccagcccaggaatctgcattttaacatgcatgcacaaacttgagaaccgctcctgtagcagagattcttcactctgccttagccaagaaacaatagcagagttggttaacctggatgttcccaggtggccaagtggacaggattcaggatctaagaactgaggtggcaggatcacgttaactctcactagcctgtcactggccattggcatcttcctctgtgacgtgtggtggcaacaaacctcagtgggctagatgcacctggggctttgacaccaatcgaaatcacagattttttccaccacaccttataggggttgcagatatcttgaaatacggcttccctgctcactgctttgaaatgattgtagttattagacgtgcactagatcttgttatatcctgtgtcaatcaagaagtatgtgtactaatatacttctaatttttaaatatttattttttgagacagcgtctcgctctgtcacccagactggagtgcagtggtgtgatctcagctcactgcaatctccacctcccgggtttgaggaattctcctgcctcagccacctgagtagctgggattacaggagcatgccaccacacctggctaaattttgtatttttagtagagacagggtttcatcattttggccaggctggtcttgaactcctgacctcagatgatccacccaccatggcctcccaaagtgctgggattataagcatgagccaccatgctcggcctatgtatctgttttttttttttaatgttttgataattccattccaatataattggctttctttgcaattctgcctgtatttgttttatgcattgaaaaacatcattaggagtaagggtccatgaggcttcaccagatgccaaagggtccatgtcctggaaaaggtgcagagctggagagggaggctcagatagacgtaggcaccattcctaactccccttgccaatgctgcaggatcttgggtgaatctctttccttctctctgcctcagtgtccttacctggaaggtggagcctggtagcccctacctcaaatacttggaaggaaccagccaggccccccaagcaggcatcagggaggtgctctgaggccagctgggcttctcgtgccatgggagctgggctgaccaggctctgaaccccagctctgccacttacttgcccattatggccctgggatggggacttaacttcttcacctgcctcagcttcctcacctccatgacgtggagatggtaatagcacccaaggcatagagtggttgtggagatgaattgagtttctatttgtcaaaagggtgccagctcggtgcttggccctccgtgggtgctgtagagcgtggttgtcactgggtgtgtgtctcaccccgcaggttcaatttggggttcctggaggactggatccaagtcctgttctgtctgcattcccaggaaacagtgtctgggtttgtgcagtcactgctgtttttcaggtgagattgaggaggaaggacaattgcattagtgctcaggatggggagactgagttggagtaccatcaggccacaggggaccctggattcagcaacggaggtgcagagaggcaaggagcggaggctgaagcctgcctggtcttgagatcctgggcaaatgtggaatccacatcacccagttggacagtacctccccaccacccactcagtctggctctgtcaggcttgaggcagctgaggattttttctttgttctttccaagacagaatctgttctcctctgttaaaatggggacagctagcatattgaagtctatcgggagtgaaccctgggttatgcctctttacacgtgtcttgttgttatttatttatgtttttgagacagggtgtccttctgtcaccctggctggagtgcagtggtacaatcatagctcactgtagcttcaacctcccgagctcaagcaattctcctgcttcagcctcctgagtggctaccaccacaggtgcacgccaccacacttggctaattttttaaatttttgtagaggcagggtctcactgtgttgcccaggctggccttgaactcctgggctcaggcgatcctcccgcctcagcctcccaaaataccaggattacaggcacgagccactgtgcccagccagtgatgcctctttacctgtttcatgtaattcctcacctgtgagtcaggtgaggaaatcgaggctcagagaggcgaggtaacttgtctgaggccacacagaaagtccctagcacagccggggtttgcctgcaggtgacctggctccccaggccgtgcccttaaacactgggctacactgccaactcgcagcgggtaaatgctttcctgcttttctccgctatgttccagactgagcagtcccagatcatattcacagatgtgttttcaagggtagcagcaggtgacgggaatcagcagatgtctgggggcgcttcccatggagggcctttcctggcctcccatgccagcctcctccccgagccttgcccatctgtgtcctccctgactgcacactttcttccctctcactgcctgcacgctgagctggttccctgggctgtagccctcagcctttgtggtggcaaacaatagggaggggtgaggactgcagcaaactagacagcacctgccctcggtaaagggagcagcagccactctgcccagccactatttccatgtgggaatatggccctggtcttccatgttttcaaaagaatctagattctcttgtgattttcccatttttaaatattggcatgacatctaattcaaatttttagaaatatcacatgtaccaagagagagggagacagagaaacacacacacacacccagagagaaagagagagagagagacagagagagagagagagagaaagagggaggaagagagaggcagaaagggagaagagatagagagagatcacttcttggccttttggctaaggtcaagtggagagagaaacagagagaggagaagaaagaggaggaggaagaggaggaggaagacaggggagggaacaaagcaaacagtaaacaaaacaaaaaatctcaaaaacctgtctttgagccagtttgtgacttctcccttcccctttcttgtccttctgccttcacagtagcccccttttagagatgggaaaaaggagacctggagagatgagaggacttgcccaagaagacctcgcagggggtgggtgggcgggtggggcttttggggccagatctctaccttggacttcaaagttcttcccaccaggttcctactacccatctccaggcccccagcctgtgtgggccagtgcttattttcaaagtcaggtgctgaattctgaaggggaagaaaaataattgtcatctgattctgaaggccaaggtcaccgtgacatatctcacaggctcagcaactgtccccagattccaaaagagccatttctaaagggcacgtctgccagagacgtctctgaactgacaaggcctggaggcttgtggaactctaggggccagaggcattgtcaaaatcctttccaatgataaactagtttgttcagttgttgagtgtggaggagaaaggacttgtttttctgggcccagcccatcagcttcataggctgccgtttacagaggacctagaatgctccaagaactagatgggggctttgcagccattccctcattaaagttgcccagaaaatcctgtgagattggtagtgtggactctgttttatagccaaagaaactgaggctcagagaggttaggaaaaggccaaggtcaaatccatgtctgtttgacctcaagtccaggctcaccccaccacagcgaggtatctctgtggaggtggtagagaagcttccttctttgctaaggtcgatctaggggccatggtgggggccacagtgcgggctagggtggttcggggaggaagtgattttgaacaaagaaaggaagttggctgggcatggtaactcatgcctgtaatcccaaaactttgggaggtcaacagaggaggattacttgaggccaggaatttgagaccaccctgggcaatagggtgagacctcatctctacaaaaaatttaaaaaattacccagacacaatagaacgtgcctgtggtcctggagacttgggaggctgaggtgggaagatcacttgagcccaggagttggaggttgcagtgagctgtgattccaccactgcactccagcctgggtgatagcacgagaccctgtctcaaaaaggaagaagaaaaaaaggaggtgtattagtttcctcttgctgatgtaacaaatttccacaaatttagaatttagtgccttgaaacaatatggatttatctcacagttcttgaggtcagaattccaagatgagacttaaaaatcagtgttggctgggcgtggtggcccatgcctgttatcccagcactttgggaggccgaggtggggggatcacctgaggttaggagtttgagaccaacctggccaaaatggtgaaacactgtctctgctaaaaatacaaaaattagccaggcatgatggtgtacgcctgtaatcccagctactcgggaggctaaggcaggagaatcgcttcagcctaggtggcggaggttgtagtgagctgagatcgtgccactgcactccagcctgggcagcagagcgagaatctgtctcaaacaaaacaaagcaacaacaaaataccaaagtgtcagccggactgtgttcctttctggaggttcaaggggagaacttgtctccttgccctttctgtcttctagaggccgcctgcattccttggctcatggccccgcatcactgcaacctctgcttttcccattgcatctccttctctgtctctgaccctcctgtctccctgtcataatgacccttgtgattacactgggccaacccagatatcaggataatctccccatctcaaaatcttttttttctatgccttcgacctttgactttttaaaaaatttaatttaattttaagttccaatatccatgtgcaggatgtgcaggtttgttacataggtaaacgtgtgccatggtggtttgctgcacccatcaacccatcacctaggtattaaggcccatgtgcattagctatttatccttccatctcaagatcttaatcatgtctgcaaagtcccttgtgccatgcaaggtaacgtatcctggaagtgaacagcttccagggattaggaaggggacacctttgagagcccttattcagccagccccaggggcttagtcacattcaaatgtcttagtgcagcattcaatgcccttgacacatggttcccaagcagtcctgcccatctccaccctgagcacccaccagaaggaagtacagctgcaggctgaacatctcatttcccgcacgcctccagcatgccccacccattggagtgaccccctaggccagtgctccttacactcctatgtgctttggagtcagctagggacctgatgacaatgcaggtcttcagtcagtaggtctgggaggggccagagattctatattttctccagggtcccagggaatgctgacgctgctggtttgtagacctccctttgaggattgagactctagacaagatggttatgcagaaaacagtcatctccaggcctgtgtttccacggtagcatgccgattggcatcggaatggaatcacatccccacgtgctctgttgccctacctttttgcccatcccactaaagtatccactgagggtctctactatgacctggagtcaaagcataaaagctttccggacttattaaaggaagattccgagtgagcgtcgtgaccttgggcaactcactcgccctctctgggactttttggaaaggatttggggctggctggacaagagaactttcgggaacagctgtcagatccatgcccttggcttagaaagtcaattcaggcgtctgagctgaatgtctttccttttcctctaactctgaaaattgagttatgggattgtgtggtgtttgttagaaccctggaccatggggaaaggtttgcaggatatttcacccctatctgtagatatcaggggtccatacagggtcttaaaatgttgcacggctgcagtatcggagatagaaatgactgatttcgtcgtatagggagacaaggctggaaactcgaatgctcttgagagcccggcaagacgcatgaagggttgaggggcaccgggtgggatccgtgtcccctgtctgaggagggcagccccagctcagccccacagccatcatcacgtgatgatgcagttccagtattgtgcatttgcccattttgcaaacgaatccagaaatctggatttttttaatgtgaagcctcctatttttaaatgttgataatgaattcagatatttttaaaatactgtgtgggccaaacaagacatttctgtgggctggattcagcctgttggcagcttgtttgagaatctactcactctgcggagagggaaactgaggctcacagcagcaaagggaccttcccgaggtttgtagcatcagggtttgaactcagggctgctgatgtacagtggagccaccatctgttggtctcactgtagttctctcttccagacagccctttccccctcgaacctcaatcctcatgcctctaatagaaccaaccttgcccccagacacacaacaggaaatagcctgggaggtggaacagtgcctcccacccgactctgctcctgacttactctgtgacatgggaaagtcctgactcctttttgcattgagatttctcatctgtagaacaagggctgggggctcagtgaccccagaagtccctccctacagctctccatggcctctggccttttcctcccagcgccggtacatccctgcctctgagcttcccatattgacattttgcaaacagcagctgccacagagacgttgccagcccccgaggtcccagtccacatcatctacatgattcaacatgctcggtatcagggggcctgtcacccatctcacagccagcggccactgcgccgtgccttattgatttgatgtattaaactgatggattttttgagaaaaaaggtgttttctcttgaaaggccactgtgtcttgagacttcatatgactttgcaacaattcccctctgatcctcataaaggttttatttgtccagtggctgataatgcacttgttccggtttcctaatcctccttggctacttccctttaggaataacaacaacggtaacagctaatgggcaccttagacaggacaggtgttgtcctaagcacttactcattaattaactcacttaatcctcacaacagtccatgggctggctgcttcatgtatgcccaatttgcagatgagaagactgaggttcaatggcgatgtatccttttcccagtctcacatctagttattgatggagctaaggtcacctggtccaggtcctcaatctttctcagtgccttaccacctcttattacaattgctggccagggttggtggctcatgcccataatccctgcactttgggaaaccagggctggaggataacttgaagccaggagtttgagaccagcctgggcaacagggtgcgaccttgtctctagaaaaaataagaaaattagctgcatgtagtggtgcatgcttgtagttccagctacttgggaggctgaagtgggaggatcgcttgagcccaggagttcaaggctgcagtgagtcatgattgtgccatttcactctagcctgggagacagagtgagaccctgtgtcttaataaaaaatgaaaataaaaaattagctgggcatggtggtgcatgtctgtagtcccagctactcgggaggctgagacagaagaatctcttgagcctgggttgaagctgcagtgagccttgattgtgccactgcactgcagcctgggtgacagactgagaccttgtctctaaaaaaataaaaaggaaaaggaaaaattattataattgtgaataatgacacttattagcaagaaatagtcatacttaactttcttcaactctttccaaatgtcgggcttgtgtgatttacaggtattgtctcatttactgcgtgcaacaagtcaattatgcccattttaggaatgaggaaccctacgggcagaggaccactcaatgtcacacagccgagacacagttcccacctatgttttttcactcagtcaaggatctggccctggaagctctctcagcaagggagggatccaaggcaaatgggaaatcatttctgcaaacccatcaatcccagcaatgaagggtcagagttggcatcacaaagctgttttttaaaaaggcaaagagtgcagctaacaggatcagttgtcaactcctggccccacacctgatgagaaatcatttcattccttctgccccctggaggtcacctgttctctgccgcaaattgaaccattagcgcaagtttcggagacttgggacaatcatccccaccattatggaggctttcccggcatcactaaggcgaggctctgccgggcctgctgagagactggtctgttctgacttcctgtccttccgcgagcttgcattccacagcactaagaagaaaagtgagtgttcatcacaggccaggcattctgcattggttcccgaatgtttaattattcccataccaccttttatttgcctgatgccaacacctacttttctttcctagcattgacttagtttttccttaaggtgacttttttttttttttttttttgagactgagtctccttctgtcactcaggctggagtgcaatggcgcgatctcagctcactgcaacctccacctcccgggttcaaggaattctcctgcctcagcctcccgagtagctgagatcacaggcacacaccaccacacctggctaatttctgtatttttagtagagacggggtttctgtatttttagtagagacggggtttcaccatgttgaccaggctggtctcaaactcctgacctcaggtgatctgcctgcttcggcctcccaaagtgctgggattacaggcgtgagccaccaagcccggccaaggtgactcattttttttatttttgagacagggtctcgcttctgttgtccaggctagagtgcagcgacaggatcgtagctaattgcagccgcaacctcctgggctccagtgatccctcccacctcaacctcccaagtagctggggctacaggcacgcgccaccatgcctggctaatttttaaaatttttgtagagatgaggtctccctatattgcccaggctggtctcgaactcctgggcttaagtgatcctcccagctcggcctctcaaagcgctgggattagaggcttgagctactgcattcggcctcattttttacatgtacatttaaaaatgggactttagattcctggttctcaaattggactgcatatcaacatcacctgtagggcccattcaaacagaatgatttttactctcagagtttctgattccacaggtctgggctggggccggagaatttgcaccacaagtgcccaggtgagtccggtggtgctggtggggcactcagtgtgtgctgagaccactggcttagatcaccactctcactggaaatcagagtcccttgcattaaaaaaaaaaaaaaaaaaaaaaaaaaaagatctgtcactgacggtacctgcagaaaacagaatcccccaaatagttcaagtgaagacacttgaatgaaagaactccttacagagaagtgagaagggttaagagaatctgaggccagtcacggtggctcacgcttgtaattccagtgctttgggaggctgaggcaggaggatcgcttgagcccaggagtttcagaccagcctgagcaacatagtgagaccctgtctctacaaaacaattaaaaattagtgggttgtggtggtgagtgcctgtagttccagctacttgggaagatgaagcggtaggatcgcttgagctcaggaggttaaggctgcagtgagccatgatccagccactgcacaatgcactccagcctgggtgataaagcaagactttgtctcaaaaatgaataattaataataacaaataataaaaaaaagttacacaatatggctagaaactatggaagattctgagtctgaggccggccttgtctttgctttaaaaaattgacaagtgttagaaaggtgttaaggccctattagcaccacacagagattcttttgattgaggtaataagaatgctaaaaatcagggaaaagagaatcactttttcactctttggttctgacagtttaacgttgtgattcaacaccactttaaagcactcgtcccctggtgggaaacaggaatgcgtagctcacagcccccagtggcacccagcttctgggacttattcaccagcttacacttggcacggggggagggctgcttctggggatgggggcaggttggtgtacgtcccctggcatgtccagcctgtctcaaagctgggtggaggtgggctctggtggccagggcaagcccccaagcagagagacacaggcgccagcaggtggaaatgtgcccccaagggccgtgggcaggctgggagcaccgcaccggctgtgtctgccgcactttcacagccccctgccactgctccctccccttaagtattgatgtcccctggaatcccacttcccacatgtgttcagaggcatcctgttgactccaactaccttctgacaatcacagcagatacacagggagtgctgagtcttgccagtgccccccacctgtctgagctccagctcatggacattccttctggatgttccacggctcatgtaggctctgcatgtcattgtcctcctgctttagcactgttccacactcagtgaagaatgccatcatctgctcacgtgtccaagctaggaacatggcaccagtgtggcctcctccctctcctttgccaccaggttcataggtgcacagcccactgagtccacccctcaggggttatcagtttatctacttgtcctcattcccactgtggccacagtccaggccaccgtcatcttttgcatggagtgcagcggaagcctccaagaactctttccatcctgtccatccattcttcactctcctctcagcatacagagttccctggctaagcccctcacctgcccctgaactcaggtcaagtccagcttccccaacctggcttccaagaatcctccagattgccttctctaccctgtgacctccttccccatcatgcctggtggctggctggtatggcatccctgagaaccgaagggccattccatcccactcagcggccgtcctcttctggacacctggttccagaattgcttgggactccggagaatatcttgaataagagccttgactagggaatcccacgccccacagccagaccggtggcaacaacctgctaacagagggagaatatggtctccaagtggccactctgtcctgacgacagcctccttgctgaccatggttcctggaggcagagaggcatgagtttgaatctagactatgccactacctaggtgtatagagcagttgcttaatccctcagaagctgagttttgttgtctgcaaaacgggtgatacgttgctaccttgcaggctgttaggaagattcggggatataatccacataaatttttgcgtctaagatcagattatctagaggcgcagcataggatgaggatttgggtgcaaagtcattggtgaaggaaatgctccctggggagactggtaagggaattgaagctgtaggacagggaagggagaacagaaagcaaggggtgctgtcaggccagtctgaccccatgggggctttgtagtgtgggtcacagctcagagttgtcttagccagagccacaggacaggaccctgctggtcagtcatgcattgatggcggctaagagagaaatataagttcccattttctgaacaaagatagaaaaaatgggctctggttgcccaaagacaatcctccaaagacagaaactctaaaaagagagcctaggagattgggcgggacatcaacatcctcctttttgacttggcacataataaagacctcataactgtcagcccttattgtgacaattataacgacaagaacaatcgttattgttattaatttccttggctggagtgggctgaaactctcagacggatgctcccgagcccagtaagaagataaggaaataaatctagcaatctagctggaaaagcacaactcggctgggcacacctataatttcagcgctttgggaggccgaggcgggaggatcacttgaggctgagagttcgagaccagcctgagcaacatagtgagaccctgtctctacaaaaataaaaaataaaaaaattagctgggcatggtggcacttacctttagtcacaactactacggaggctgaggcaggaggatggcctgagcccaggagttagtggctgcagtgaactatgatcatgccactgctctccagcctggacaaagagcaagatcctgtctcaaaaaaaatctatatatctgtatatctatctatatctatatctatatctatatctatatctatatctatatctatctaagcacaagccagctgggtgcagctcaggcctgtaatccctgcactttggaaggccaaggtgggtggatcatttgaggtcaggagttcgagacaagcctggccaacatggtgaaactcaatctctactaaaaatacaaaaattagccgggcatggtggtgggtgcctgcaatcccagctactcgggaggctgacgcaggagaattgcttgaacctgggagatggaggttgcagtgagctgagatggtgccactgcactccagcctgggtgacagagtgagagtcggtcttaaagaaagaaaagaaaggggggcggggagagagagagacagagagagacggagaaagaaagaaagaaagaaagaaagaaagaaagaaagaaagaaagaaagaaagaaagaaagaaagaaagaaagaaagaaagaaagaaagaaagaaagaaagtgaaagagagagagagagagaaagaaagaaagaaagaaagaaagaaagaaagaaagaaagaaagaaagaaagaaagaaagaaagaaggagaaaagaaaagaaagaaagaacccacaaccccgccaggcatcggggtacccgtgcctatttccccatggttaagttacttccggagcatccccacctccaagctctggcccatctcccatcacttctgaaagagcagagctgggccctgctgtgaggagaggggcgggggaagcgtcctggcccggggcccacgtgggcagggttgaacgcaccccctggggtgtgggggctgcgtgggggaggcagctgagtcagtgagcagcgccatgatgaggggcagtccctgccagcaccaacaggggctggaaacccagcgataggagcatcagcatctccgaggtaaagactgttgggttggggatgaaacctcctgggggcggccaccctcctgcaggctcagcgctctctgaatttcctgctttgctccccgctgcctggtggcccttgggccagcgaagggctgggaggctctgagtgtgcggtgccagggggtgttttaacaacatccaggctgccaagagcacattattctcttacaacaatccaaggaattgcccaggagatgtgatattttggtagggaggagaaaaaaaaagaaaagaaaagaaaaaaagggaagaagaggaaaagaaaagttctctgaaactctaaaagcactgttgcgctaggaatgatagtgggtgtttcagcatctgggttcttcatcagggagcaagtggggactcagaattttctgtttatttgttttatttgataaatagtatttcttggatgtccccgggacattccaggtggaaggaacaacttgtgcaaaggcagagagctagaaaaggacatgtttgacaagaaaagctgaagataaggactcctggttgtgatggaaattctcctcaaactggcatgggcaaagacaaagaattaattggttcacgtgattgaaagaacaaaggaccggcagcctcaggcatggctggatctaggggctcaaacaatgtcatcaggacgcaatcttcctccatctcttggctctgcctcccttggcactgggttcactctcaggaaggctcttgctgtctggtgattcagtcaattccatctttacatccttctagcctcaaacgtggtagaaatagaaggcttctagggctgggcatggtgcacatgcctgtagtcccaccactttggaaggctgagagaggatgatcacttgagcttaggagtttgagaccagccggcgcaacatggtgaaaccccatctctacaaaaaatataaaaataagctgggcatggtggtgcatgcctgtagtcccagctactcaggaggctaaggtgggaggattgcttgaatccaggaggtggaggttgctgggagctatgatcacaccactgtgctgcagcctgggtgacagagtgagaccctgtctaagaaagaaaaagaaaaaaaaaagaaagaaagagagaaagaaaagagacagagagcttctctttcccagtagttcctgcaaaagtcctgaggttgagtctcattgaatagacttgggtcatgggtccatgtctgactgcccatgcctggtccgtagttccttctctaaagtgtgggtcttgggagaccacatgactagtgtgacctggaaggcaagccatggggatgtgttcctagttccatcttctattcgctactttttctttcagaaatcatatgtaccctcacaatttcatttctccctgttgactctatctctagccttgaccttgtcaagagcccctgggctgtatttccagtctccattagatatatccccattatgttcttctaaaaaaattgtaatagtacaaatgacttgagctcttactatgtgctatttataagctccttacattgctgtgcaaccgaatcctcacatcaccacaacactgcaagacaggcgttattacccccattttatttttttattttttgagacggagtctcgctctgttgccttggctggagtgcagtggtgctatctcggctcactgcaacctctgcctcctgggttcaagcgattctcctgcctcagcctcccgagtagctggtattacaggtgcatgccaccacgcccggctactttttgtatttttagtagagatgggtgtttaccatgttggccaggctggtctcgaactcctgacctcaagtgatccatctgcctcagcctgccaaagtgctgggattacaggcatgagccaccgtgcccagccattacccccattttacagatgaaggaactgaggcatagagaagttcactcctgaaccaatgactggagttggagggacatggcactctgactggctagacctgagtcatgtccccatcatggagcccagatgtgggtcagctgcaaagcatccatgtagacagagagtctctcccggcaaaaagcatgcaggaatcattataatatgggtaggaaaaacagcagatcctccctaaactagatggcaaatgatggtaatccaatttggacaaatttgtaggaaaagggagctgtgctatctcagggaatacaaagaacatttgaactgccaaactcctggaaggacaggagtgcaggtggtcttcaggaacagctggaaccaggtgctcatgtggtcagaatgctcagactctcatctgaactgctctttcctggtctacttcagtggttctaagtgcaggttcctagaggaagactttgattggtcagttataagtcagataatcatactggaccaatcagctatgccaggagggcaggacctcaccagaacatggctgactgggagaaccacaaggttgaagtgtgggagtagcaatgatgggttctagaaaaaatgtggggtaggatacagggcagataaaagtgtaggtgacccttgagggcaagcctgctgtgtgtgtgaggtggcatacttagagctgcaggtgggccaggtgtggtggctcatgcctgtaatcccagcacttagggaggctgaggcaggcaaatagcttgagcccaggagtttgagaacagcctgggcaatatggcgagaccccatctctataaaaaataaaaaattagctgggtttggtggcgcactcccatatttccatctacgtgagaggctgaggtggtaggatggcttgagcccaggaatttgaggctgcagtgaaccgtgattgcaccactgcactccagcctgggtgacagagcgagaccctttctcaaaaaaaatcccacaaaaacaaacaaacaaaaaagaacaaaacaaaatgtatagttggaggtaacacagaacctctcactaactggcctaacaatacagcagtttatttcatgaaacccagaacagggcagctccgagggctggtgattggtctgatgaggccatcgttccatcactcttctctgcgtctacagtgtcagcttcaccctaaactggtggcggcaagctggctctcagtggtgatcatctaatccatgagaaagaaagggagcccttggtccagccacaggataaaagttcttccccagtaataggatccagagaatgctgacttaagcttcggtccctgagccggcccctgcagacaaggatgggacggccatgacaggcttccatcaggacctcccccagaaccaggttctattctagaatgacttgctaccctctgctgttgtgggaggaataggcacagggtgagtctatcttgggtggcccctcatctcacggcctctctgcctctgttggacaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggtaaggcatggctggtcctgtggcctctcagagcacaggcgagaaagggtgctgcccttggagtaagccctggttgtaccaaccgggaggcattggacaaattgcttctcttctgtgagcctcagttttatcgtttgtaaaaaatgaccaatgcatattgactgagcatctaatacatgctaagcaccagaccaggtactaaggctatagtaatgagcaaaagcaggcagtcccagacctcaaggagcataacacatgtgggagggagaggcagatgaatttgagatgtcttcaggagatcagtaccacatggtctgtgatggattggatctgcagtatcagcaagggaggcggttgtgcagaataggctgactgtgccgcctttccctgggatgtaaaagagaagccactttggggtggagggcacgtcgctcctcttcctgagctcatctggctttgagaactccacgtggagatgctgcatgggaagtcgaatgatcaaacacatccggaagctcaagggcaagagtgtgttgggcagggattgtgggaaaaggccacagagccagggattttgagggtttcaggaagaatgggacagtcaactgcatcataggactcaggaagatggagacagatgattccaagcaaacacttagatttggtgggcaggtgcccagggtcgctgcagcagattcaggtcatcaggggttaagctgggattacgcaggaagggaataaaggaagcctataaactaaaacatcaggaggcctggcagacagagcagtggcttggctgtttaagacatttgttcctaaaaagctgagtgtaaattgaatttctataaatttaatcctattcttcacgcattggaagaactctctatttaatgaaaccaaaacgatgagcctcctggtaagggaagtaatctctcctaattgaggtatgtacatttgacagagggatctttcaaataatagagctgcattcaagaaattagagcacatgccacagatcaaaatgtgccaatctgtcatccccaggatgtgggaaatccaatcatcacagtaaagaaaagaagaaaaatagaacaattgtcacaacacacagacaatgtgggatttggcctccatgcaccccatccccatgtaccccatccccatgcaccccatccccagctgtccaaggacggagagcttgtttattctttttttttcccctccatcttttatttatttactcaacctacattcactgaaggcctaactgggcactgtgcttgtttgggggagttgaaggaaaaagactcagtccttgccctcatgaaggctttctctctcttttttttttttttttgagattgggtcttgctttgttgcctaggctggagagcagtggtgtaatcacggctcactgcagccttgaccttcagggctcaagcgatactcccatctcagcctcctgagtagctgggattataggcaacccccatccccccgaccacgaccagctaattaaaaaaaaaattttttttagagatagggtcttgctatgttgccaaggctagcctccaactcctgggctcaagtaatcctcctgcttcagcctctcatagcactgggattacaggcgtgagccaccacgtctggccaagtttgtgatcttgtggagaaatgtattcatcagacgattctaacttggtgtgttgacctctatggactgggtgtgttaacagctctgcaggaggggcacccacatttgcccagggagtcgggatgagtggggtgggcatggggaaggcaacatttgagtgagacttggaaaataagtaagagtctgcttggtggacaacttgaggagggcattccaggtggagtggacagcgtaagcaaaggcctgatgatgcggcatattctgggaacttcacatagctcaaaatggtgggaagactgggagtagggagaggaggaatgttgagagatgaagctggagagttttgtgagggtctcagtgctttatagagtctttggattttaccatataggcaatagggagccactgaagagtgtggagcaaggggcaacacggtcgggtttgcatttggggattgtatcagtccattctcatgctgctagtaaagacatacccgagactgggtaatttataaagagagaagtttaatggactcacagatccacatggctggggaggcctcacaatcatggtggaaggcaaatgaggagcaaagtcatgtcttacatggtggcaggcaagagagcatgtgcaggggaactgctcttcataaaaccatcagctctcgtgagactcactatcaggagaacagcatgagaaagacccgcccccatgattcaattacctcccactgggtccctcccatgacacatgggaattatgggaactacagttcaagatgagatttgggtggggacacagccaaaccacatcagggatgatctctctgggttcagggtggagcacagatgaagtggagcaagaatggaggtggggaggccaaccaggaggctgcaggagtcatattgatgcaaagcaacaaggcctaagtggagaatgggtgagggcagggacaggtccaccgtgcagggggtaaagtcagctgggctcggggactggttaggagaggcgggtgggagtgggtggttaggggaaaatagagtcaaggtgaagggtttctagcttggagtgcacagaattcaggaggtccatgaacccagttgggggaaataacatctttatttttctaacataaaattagctgtcatttagctttcctccaacaaatcacagtagtggggatgagacccatgacatagtcaccaatagtaatctgtacttttcatgaaatctcaccacagctgcagctatctcaaaatgcactccttcaaaagtatgatacttggccgggtgcggttgctcatgcctgtaatcccagcactttgagaggccgaggagggtggatcacgaggtcaggagttcgagaccagcctgactaacatggtgaaacccagtttctactaaaaatacaaaaattagctgggcatggtggtgcacacctgtaatcccagctacttaggaggctgaggcaggagaatcacttgaacccaggaggtggaggttgcagtgaaccgagatcgcacagctgcactccagcttgggtgacagagcaagaccccatctcaaaaaaaaaaaaaaaaaaaaagtatgatacttattaaagtttccactgaatcccgtttcatatgttaacaaaatggcacataaattcctatacaacaatttgtttgaatatattgctaactgtatttcaatgtaattgatttcttctgtactatgtatttcattttatctagtggaaaacattattctgagaaggggtcagatggtcagagggaccctgacctgggagatccctcggctatcctttggcttggaatagggtgagcagtgatctaaccaagatagggaagaagtggaaggggctggaggggagatgatcagtctgtttcagacagtctgggcatgatgtctcggggggcaggcatccagtcccctctccttcatcagcaggttcatctctccttttcttcccctgcaccaagcatcaaaaaatcccctccatttttccaagcatgtagctcttcccccaacctgctcactccagccacaaaacaaaagtttgtcgttggccacaggcagccaacaccggttcttgcaagcagtcttctcatggggcaggaggtgggggactctcctctacctccaaggggttctcaaagtttctaccctcaagaaaacaaataaaccaagccaggtttcctcctagtggggagacccactgtgaaagcaaatacgattgtctccataattccaggcagataaacaatccaggctcagggaggttaattgacttgcccaaggtcatgcagctggtcattgcagagctgggattaaacccagctccagttggcttcaaagccctgtgctcttttcacagactcacactgcaggagtgaccaggcgggaggacaaagattttaagtcttcagaaaacagtaactgagaaggatgtagcagccagatgatggaataagactgaggtagcaagtggtggagagaaaggattttgtattcatgcccaggagaagataaacaggagagacacaatatgaggagataaactttgaggctgctgctgagagctgggcgtctggccaggaagacatgggaggctggtctttagggagccccttggaaacagggcaagaggtggtaaggggcttggaggaggtggagagggcttctgctctgctcctgtgggagggaaagtgctgctttctgtctaggaagagctggcaggcaggcttgggcagaggccagcagccaggtctatctggggagaggttgggctctgacatctgctggaccagctcagcccaaggtcagtgccttggtagagaaaagactggggcagccctttctctaaccaattacagtcagccctctgcagccatgggttccgcatctgtggattccaccaaccccagagcgaaaccatttgggaaaaaaaaaaagcaattaaaaaataacaatacaacaataaatacaataaaaataatacataaaataataatacaataaaaataataaataaaataatacaaatttaataacaatacaacaactatttacatatcatttacattgttttagattttacaagtaatctagagatgatttaaggtatacaggaggatgcatgtaggttagatgcaaatattaagccattttttaaaagttaaaaaatttattattatttttaaagacagggtatttctctgttgcccaggctagagtgcagtggcacaatcacagctcactgcagcgtcgaccttctgggttcaagtgatcctcccaccccagcctcctgactaactgggactacaggtgtgtgacatcatgcccagctaatttttttaatttttaatttttttgtgaagatgaggtcttgctatattggcccaggctggccttcaacacctgtcctccagtaatcctccttcctcggcctcccaaagtgctgagattacaggcgtgggccccaaattatatcagggacttgagcatccttggattttagtatccgtgaggagttctagaaccaatcccctgtggatatcaaaggacaactgatttataattcattcattcattatcattaatcacaatagccagcattgactgagatgtgataaaggctctctcctttgacccagtttgaatcaggcccctctgagtccttcttctgactagactccaatcttgggttctgtccttggtccactcagtcccattttagcaagaatcctgctggatccgtgtatcaaaaaccccccagccttgatatctgatcaaattcctcctccctctcccctgattgtgttatcaccctggcctgcctccagcaaaaccctgttgagtcaatttagccagaacccccttacccctgatgcttcctcatagtgattttcatctgtgaaccccaccctgctccttggctgtgaatccccacttgtccttgtgttcagagttgagcccaatctctccctactactgcaagcccccaaggcagtggtccctcttgaataagtcctccttaccgtttttacctaaagtgtttggataagtttttctttaacaggttgggtgtgatggctcatgcctgtaaccccagcactttgggaggctgaaggtggaagatcacttgaggccaggagtttgagatcagcctgggcaacatagtgagaccctgtctttatgaagaaaaaaaagtagctgggcatagtggtgtgagtctgtagtccagtcccagcttgatatggtttacctctgtgtctccacccaaatctcaccttgaattgtaataatctcctcatgttaagggcgggaccagatagaggtaactgagtcatgggggaagtttcccccacgctattcttatgatagtgagtgagttctcaagagatctgatggtttcataaggggttcctactttgctcaatactcattctctctcctgccgccatgtgaagaagggcatgtttgcttccccttccaccatgattgtaagtttcctgaggcctcccaagccacacaaaactgtgaaacaattaaaccccttttctttataaattacccagtcttgggtatgtctttattagcagtgtgagaatggactaatacacagctactcaggaggccaagacaggaggatccttgagcccaggaggttaaggctgctgtgagttatgatcatgccactgcactccagcctggacaacagaacatgactctgtctctcaaaaaccattttttttttctttaacagatgctactatgcgctggccctggggtaagcctgccacatgtgttaatctctttactcctcctgtagcattacattcattctacagatcagaaaactgacttgcctgcagccacatggctagtaacgtgttgaaccctagagtctgccatggtgaagtgttctgagcagggctttgcacccaggacttcaggttgttatcattattattattcctagctgcctttgaataaactgagggacagatcttgccccaaggtccagcactctcaaaatgaggctggggcaatttgaacagatatcaaaggtgggcaattttcaaggctggggcccaggggctggggtttggatgattcagtgaagggagaaaaagggtcaaggctgtctccccactcagtgttgctggcagcagagggttatataggaaggtggccccccagggctgagggacagggttggggaggggcaagggaatgggaagttggtgacttctggctcccttggtcaccttctccagccagcacagggcttggagctcacgatactgctagggacccatgaaatgtttaattttgacttcttttaaaaccagaagaaaaaaagaatgtaataataatgaagatacaaaaatgaatctagacagggtcatatttgtctttataccattactgtcataaaaggtaaatcttaatacttcttttatggaggaacaggtctacgatggcaaaagtgcccagggcccataaaagtcataatgtggccctgaactagaccacggcctttctcgtgctctcccagccaagcaagactaattcgagaccagggatggctccggctgcccatgtccccactccccccaagtcttgtgacttcggtcgagaggtattggggaagacagggctctgccaccctcttgctccccagtggtcaggggcttagatccagaaagggttgtgagcgggctgggcaaatttctgttcctcccccagctcctccaaaaattgaggctgatccactaaggaaaaaagagaaagtcgttcggaaaattcctgcacagtccagctaactgtgggctttcaggaaaaacagcactggcacaaagagaaacctgtccatctccgggaaataatcagcctcgtggagaaatcagcaagcatctattttgttacctaaagagaaaatgaaatgtcacaataaaacccaaattaccaaagacaaggtaactctttgaaatccgaatttcaggtgccatcttaagagtgtggaccgagttgaagagcacactcccctatggcctgcggggtgggtgccaccagtgtgttttggacaggagtttggggacctggaggcctgggggccaaggggcaaagcataccaacttcactccattgcctatactcacatcctcgggaactaggttgtgagcaggcacagtgcaactcccctgggcctggtaccagtgccaggagccaggcagcatgtggcttcttaggaaagcaaatttgcagagccatttgccttacgatctcatctgtgctgccttttaggagtgaatgtgagccatgcgctcactgagtttgcctttttccatcggctgccaggaagctcagatctaagttctgtgttcaatcatgacaccttcccccaaggaaggcttccttcctgttacacttcttaattccttggcattttcttggagcttactcttattgtggtgacttttggtcttgtgcttcttcctgtaaatggccacaaattatcttaggacaagtttgctgggaccctaattccaccagtcacccctgccaccttcacctgtgctgaaagaatcccccacccataaccccttctgttcagtttccctggcctggcagacttggtttcttgctcatagcttagagggcaagtatttttgtgtttaaaaatgcagagggtctaagtcagaaagatgaatatttacatattattaaagatccttttatttgtaagtgacaagaacctgatcaaattagctggagggaaaaaaggggatcatgctggaaatctgttggttcagtaattgaaaagtggagggggtgggcttcaggcacagctgcatccaggtgatcatgtaatcaggaatctatatctctaaactctgccttcttctgtgttagtatcattctcagtcaggccctctccatgcggagaggatggctacaagtagcccaggctcatttaaaattctagaggtagagagagctcctttccaatagtgtctgcttggagttttgtccaaaaaggactataattggaccaactaagtcatagactcatttctaaacaaattaccatgccagaggatgaattactctcattagccaggtttggttgggtctgttggcacgtccatgatgtgggctcagtcatggaccaagcaggattatcatgcaacagcaggcaagtggttgccaaaatgaactgcttgatacaagcccaaatgtgttgtcaaactgtcaaattatcagagtgtccacagtggaaccgaacgatccggtgccccaggaatggcagaggccttattttgagtttctccaaagcagaccctaagatgaagattcaggtgcaagcagtttctttcggaggtgatcttagcaagtacggtgggagagtggaaaaggatgccaggaagggaggaaagacattaaagggagtattgacgagaaggtaaccactgtgggccactggggctcagtccctcatggaggctgagtagagcacaccccaaaactgttcactcaaggggtgagaaagcagtgatatttgctcaccaacttccatccaccattagtttagggtcactcctgagacattaactccccataatctccagccttctccaccgaagaaagcaagtctttgaggaaagaagtcaccaacatgtgtgggaattgcctaaccaaagccacagatgacgcctggtgtgggccaaggagatatgattggaggcaagacaatgtctgccacagaaagtcaagtcaagacaagggggggattctgacaccagctggtctgtgctgatgcaattctgatgccatcttcccagaagcagcatcacactccacaggcttaatgcatggtcctcagcaagactgcccccacttcagatgccagctgcaagttcaggggtccccaggccactgtcacttctgaccaactggctacaaatacaaggcttcgataattcactagaatgattcacggaattcagaagtcactctacttaaggtgacagctgtattataaagaatacagatcaagaccagacaaaggaagaaacacatagggcaaggttggcaagggtctcaatgcagagctcccatgctgtctctttgtggaatcaggacacatcaccctccaacacatcatgtgttcaccatccaggaagcttgcctgttagctgggcatggtggcacacacctatatcccagatacttggtaggctgaggtgggaggattgtttgagcctgggaggttgaggaggctgcagtcagccatgattgcaccactgcactccagccttggtgacaaagtccctgtccaaaaaaaaaaaaaaaaaaaaaaaaaaaaaaaaggctctcctgtgcttcagtgtccagagtttttattgggattttatgacataggcacgattgatggaatcattggccatgtcgatgtgtagatgatctcaatctccagtcccctctcctccttgaggtcaggctggctcaaagccccagccctctaattgcaaggctgatctttttagtgaccctcccgcagcccccattttgagtcatcatctcatctcactagcatcaaatctgatgtgattcaagagcctcatgaataacaaagacacttctattacaaacttcaaaggatttagagtgtccctcctgaaacagggacaagggctagtcaaattctttattatacaacaagggtcctgggtggggagacaggagcacatatctgcagctgagctgtcacctgctcccctctcccagctatgttcagtttggggcaactagagccattgacacattaagggagaggcctgggaagtcttccctgtttggggactaatgccttaagcatttgcaatagggctgggcctgcttagcttggccctctatggggagtccctgtgtgttttagatgctacagatttcacccctctgtagccatccatttcacccctcctttccccaaggtagtggaccaagctgagtctctccaaactcagtcttctaaagctaaggtggccagtgctattcttatccctgagcccaggtgtgcaagcaacacttcagctctttcatttctggataggaccttaattttaattctaagcccccatccccctgggctggtagaagatttatcttcagaattttgcgatgttttctcccttctgcctttgcttggggctgtgccaccatttttggctcttaatgcaacatctggcaaagagggggcggggtttgatctttgttgttatcatcttcatcatacaggtcacagtgcccagtctgaaatccttgggtctaaaagtgttccagaattcagaactttttagattttggaaggtaacataagacatagactatccattccatcacaccccaccagcagctggggcagatccctataatcaaatccattcatatttctgctgtaaaacacatatgcaggctggcagggggtgataaatcaagatagtaaatagcctcacatccatccaggtcaggcttatgttccaaagaagttcaggccaagtcaggtattgtgaccagatgagttgcaaaaaacatttggattttagaacttctgggaatttgaaatcacaaacaagaatcatagcaccaatagctcacatttattgagcacctactgtgtgctgagacatgacctctgtccagcgctattgttactggaaaggggtcccttgtccagacccgaagagagggttcttggatctcatgcaagaaagaattcagggcaagtccatagagtaaagtgaaagcaactttattaggaaagtaaagggataaagaatgactactccataggcagagcagtggtatgggctgctcaattaaggatacttagtattatttcctgattatatgcaaaccaaggggaggattattcatgagttttctgggaaaggggtgggcaattcccagaactgagggctcctcccccttttagaccatacatggtaacttcctgatgttgccatggcatctgtaacctctcatggtgctggtgggagtgtctcttagcatgctaatgaattgtaattagcatataatgagcagtaaggacaaccagagggcacttttgtcaccatcttggttttggtgggttttggctggcttctttaccgcaacctgttttatcagcaaggtctttatgacctgtatcttctgccgacctcctaactcatgctgtgacttggacggcctaacctcctggacatgcagcccagtaggtctcagcctcattttacccagcccctcgtcaagatggagtcactctggttcaaatgcctctgacactacaatggtaggtgctcttattgtccccattttatagttgagaatactgaggcacaggcttagtaagtggcgattttggcttcaaggctcatgggctttgctattagactggtccatgtagtctactgctggccatccatgtccatacggccccttctggtccccaggggctctttgctgctaggactggacatgagatgggagaatgaggctggtaacttcagtacgcatggtctcctcactccagactggggggtctcacatctaatgcccagagcgaccatggaggtgacttaaatgagtgcagctgcccagatataatacagcagggaatacggcagcagaggtgaacttcagagctcatatgcatggcattcgaggaaggccaaaatctgttttcttaactcctgatttttaattcaaaaaattttagacagctttattgaggtatcatttacatatcatgcttaaagcatataattcaatgatttttagtaaccatcagcatagcttaattttaaaatattttcatcaccccaaaaagaaaccccatgccactagcagtcgctcttcattttccaccaatcttcccagccctgggcaaccactgctctattttctattccatcaatgtgcctattctagacattttctataaatggatttatagaagataggatcttttatgactggcttcttccattcacttcacacgctttcaagtttcatccatgttgtagctcgtaccagtactttgttagttttatggctaaataatattccattgtatggattgaccacattttcttttctttgttttctttttgagacaggatctccctctgtcacccaggctggagcacaccagcacaatcagggggctcactgtagccttggcccccctgagctcaggtgatccttccacctcaacctcctgagtagctgggaccacgtgtgccaccacacctggctattgtttgtattttttgtagagacggggtttcgtcatgttgcccaggctggtcttaaactcctgggctcaagctatctgcctgcttcagcctcctcaagtgcttggattacaggtgtgagccactgcgcccggccccaaattaatttatttacttgtctgtgcccaattccctggaccaggttttctccaccttggcactacggacctcctggaccagattgttctctgctgttgggggctggcctgtgcattgtggggtgtccagcagcatccctggcctccacctgctacatgtcagtggcaccccctccccaagtcacgacaactcggaattttcatgggggaatgttcagagacagtgactccaggactggctggacacggaatcagcaagactgctggtttggggttgggaaaggggaaagtgaggtcaggtcatggctggacttggatgccaggctaggaagtgtgggggtgcaatgagaaaccaccaagggctttaagtgaaggagtgacaaggtcagggtgagtctcacaaagactgttgttggggtacaggaagggcaggcagggccggtacaggctggagagcacggctaagaggtgactgcaggtgtctggccacaaggagatggtggcagagggaacggaggactgtggatgggctccagagaagcagaactggcaggacttgatggtccacaaactgcagggcaagggtgggagtcatggaggatgcagatgccaggctgcgaccatgatggggaaacaggggagtcatcccatgagggcaagagcattgaaggaggacagtggtgcattctgggcgtgtgaggtttgaggcaggacctcctgcaggaaatactccatcatcacatctcagtctttgcagggctaggagggcggggaagggaagagaggagagtggagggcccctgataaggtaagagatggagcaggagatgggaggcagaggaagatgatgaacaggcccctgggacagagggagacacacacttaaggagagagagaaaagaacacagagagagagagatggatggagacagacagagagagaaggagagagagatggagggagacagagagagagaaagagagagtgatggacgagacagagagacagaaggagagacagatggagggagacagagacagagagagaggagagagagagatggagacagagacagaaagatggagagagagatggagggagacagagacagagagagatggagagagacagagagatggaaagagaaacagaaggagacagagacagagagagaaggagagagggagggagacagagagagaaggaaagagagatggagagacacagagacagacagagagaggagagaagagatggaaggagacagagggagaaaaggaaagagagatggagagaggcagagacagagagagagaaggagacagagagatggagggagacagagaaaaggaaagagagatggacagaggcagagacagagagagagagagaaggagagagagagatggagggagacagagacagagagagatggagggagacagagacagagagagatggagggagacagagacagagagatggagggagacagagacagagagagatggagagagagatggagggagacagagagagagagatggagggagacagagacaaagagagaaggagagagagctagagggagacagagacagagaaggagagagagatggagggagacagagacagagagagaaggagagagaaatggagggagacagagacagagagagaaggagagagagagagatggaggaagacagagaggagagagagatggagacgcagagaggagagagagatggagacagagacagagagaaggagagggagtgagggagacagagaggagagagagatgaagggagacagagagagaggagagagagatggatggagacagagacagagagagagagaaggagagagagagatggagggagacagagagagagaagcagagaaagatggagggaggaagaaggaagtgagagaaaaaggaggaacaagagagacacagggagcaaacagcagcaaatgggccgacatttactgagcacctgctatataccagcccatcatcaaagtgttaatcctatgagagggaaggccactgactctcctcaaaacccctctgcaattcccggagccttgaaggccctccttcttctgttctctccacctccataacttccactcacctgtagcctttttcttacccgtccaaggaaggtcctagaagatcagaggagagctgagcccatcctcagtgaggagccccatcaatgcaggagacccccagctctgggaggacgggaggccccgagccctgctcccatctcctggctgtcgcactcacatctgccttcctccttccttccctcctccctctgcctcttagtgaacacatgctggccttccaaccccatctccaagctcaccttggaagcctttccccaatccagggaacacagaccttttatctccttcaggcccttctcggaggctgaaactcaagatgccttgagtggcctgggagggaatgtggatgagtgagcgagctggggatattgcaggagctatggcagagggcagcagacgggcagacgatggcaccactgaggggcttggcagctgcaggccctcatgaaacgccccagctccagcctagctccagctgagggttgccgagaagaaatgtggacccagtgttgcgtttctgattttttacaagagaagccaaaactcccatattttaatggaaatcctccaaatttttaaaatgttggcatcaaaatatcatcttttttttttttacagctcttgccaacatctgcaggttcgattcagcccatggggtgccagttttagatggtagctggatctatttctattttagcatttgtaataattgatttcacgtcactgtttatgtcactctcctcattagccttggaggaatggccttgccgtatttacggccatatcccctgtggctggccccatgctttgcatacagaggatgcttaataaatgtcagttaaatgaatgagttggagtgttagaagcaaatcagtggcctgcagaagggtctgaggattctagaaggggatcaggacctgttagctggggagggaacagccagtgagtcttcgggaggtgggacagatggggcaggcccctgtcattttccccttcccggctggccattagtaatttaaattccgccacatcctttgcatgttgctagaagcctgggctgggggagtctgcaggccatcaggcctttcatacaaatgagcctggccccaggcacagggccaagtagaaattgggctttagggaggtgggaagaggtaagaattttaataagttcaataaaaattggaaataaaacctacgctggaggaactgctggtttctggcagtttttaagggacttagtggagtgagtgtagcaagggatgctgggaatttctgggcctggtctcgcgagaaacgcaaggaggttgggacaggactgctaggcccaggctccgactcagccggaaagctggactttgaggggcgtggccaggaagtggctggcctcagggggcgtggcctcagggggcgtggcctcaggaggaagccgagtgggtgggtggggccgccggagatcctcagggtgggtgcgctgcaggtaccctcctcctggtggccagtagagggcagcacaggcataggatccagctccccagggagtgggttgggtggggaacccagcagggaaaccgaggccaaagccctgtcgtaggggaaaggctgagctcctggagtctctgacacacagtgagcaagggctcagtggggagagtctaactcctgtctgcccagcgactggaagtagccaggctctgaggaccacctgccacagctcatggggcagcgctcactgatctgccctgcccctgagccatagaggtgggagccaggcccaccctctgcctcccagtggctcccacctctttgtcaatgtgccaggtcctttactcaggcatctcatccccattttagagatgaggagaaggaggcttagagaggttaactaacatgcctgaggtcacacagcatgagtgggagagctgggctgagagccatgcagtgcctgcctgcataagcactgcatcacctgctgtgcgctgaactgagcttgtgcattgatctgggtgggcgtctattcctgcccctcctcctagagcatgagtcttagggcaggacttggtctatctgggtgatccctgtatccctagtaccacagacatcaaggtggcctctgtaaatacttgttgaaggaatgagtgttacagaaactgtggtaggagaggattggaagacacatttgaatctttctgccccttcaaataggcactctctcctctgcccccgggccagggtgggccactggtggggaatgcaggggggttggcgtgagctgcattcatcaccctgaaccctctaataaatgctccattgtaggtctagaaaagtgaaagtgagggccggtttcggtggctcatgcttgtaatcccagcactttgggaggctgaggcgggaggatcacatgaggtcaggagttcgaccccagcctggccaacgcggtgaaaccctgattctactaaaaatacataaattaacctggcatggtggtgcaagtctgtagtcccagctacttggaaggttgaggcaggaaaatggcttgaacctggggggcggaggttgaagtgagccaagatcacaccactgcattccagcctaggtgactgagcaagactctgtctcgaaaaaattaaaaaagaaaagtgaaagtgagagcctgcatttgggtaggggtggagggcagattgctcaggtgtggatcctggcctcaacaccaggtgtgtgctttgggccaaattttccatctttctgagcctcagttacttactccttctccaaaatgggataatagtcagactactggtggggttgtgcagattaaaggagtgagcacatataaagtgcccagcacagtgattgatacatggttggctctgaggatgatgactgtaacagaattggtaatattgtggcagcactgagactttcatggtatttaagtatgtaatgatttggtattacagtgacactgtatgtagttcatgtaacgggagagggggtgtggacaagattaattacagaaagggaagaatgtatctgtgtgtgagaggacagacagagagaggcagagagatatacaggacatacagagatatacagagaggcagagagatatacagagaaaaacagaggtggaaaatagaaagatacacaggaaggcagaactagagagagacacagagagagagaaacagaaactaagagtgtatttggccagatgcggtggctcacaactgtaatcccagcactttgggaggccaaggtgggaggatcacttgagctcaggagtttgagaccagcctgggcaacatagtgagaccccatctctaaaaaaataaaataaaaaattagccgggcatagtggtgtgcacctgtggtcatagctgctcaggaggctgaggcaggagtatcacttggggagtttgaggttgcagtgagccgtgattgcaccactgcactccaggctgggtgacagaacaagaccctgtctcaaaaaaagaaaagaaaaaaagtgcatttactgccagtgattagggcacaaacagatatatatatatatacatacacacacatatatacacacatatatatgtgtgtgtgtgtatatatatgtgtgtgtatgtatgtatgtgtgtgtgtatatatatatatatatatatatatatatatatatatatatatatatagaaagagagagagaaagaaagaagcgtccctgctctgtggttgacatttatccagtgcggccacttccacctccactccccaccaggtggcagtgaatcccccaggggctgagaagacctgtagggctcccagccgggaatggatctcaggtgatgctggggcaggggacacttcccaaggtgaccaggacagtatcaagccaaaggaacctggggatgattcttagtcaatccaggaaaacacactccaaggaccaggtcaggagttgggtgccagagggccagaggcctcgtagacctagagcacagtgggattgaggttgggggaagtaagggacatcccaggagatggctggattggagcccagtatggtcaggagcccagagtgtgggggtgagagttggactggctcacagaagaatgcgtgggactggcgccatcttggtctcaggcaccagacatcacagctgactccaagtctaaggggacctcacagcacaaacctgtctcccaaaccaaaccctgagccttgtggcagggaccacattctgttcatctctgtgtttctggagcccggtaggactcagtgggagcctctgtgaatgttttcagatgaaggaattgttgggtagagttgtggtgttggaggtggacccacacatgggctgggctccttcctgcgggccagaatgcagccagcagagagggcccaagacctggagagcagggtttcatcctcagctttgtaggccaatgtccagagctttcctgagagttcacacgagggctttgcaacctccattttgctgcatcaaagcctgctgggtctcatgtctgggctctggttgtctcatgtccaaggggcggaaacttgttcaatctgaggcaaaaccgtatttttctaaaggtcattctgtaatgtcatctctcagtatttctctttgtggctgcaggtgggcacaggggagagcagccacctttgagaagattaagtccatttgatgactttggcttttggggattttgctgagaactgcagggatgtggctgtcttaggagagaggcagtgaagggctgttttgagcccagcctctgactgtctccatgtcatctccatgtcatagtgttcatagtggatttctgtgcgttttgccttgatagcatcctttttaccttcttcagcttagaacacaatgactttcctttggaaactatctcttttccaccctcatgccatgtttactgcaccacatctcactgcagaggtggccccaaagcccggccaatcaaaacattccatctccttgcccacaatgattggttcagggatgagcatgtgatacaaatcaaggcaatgagattcagttctaggatgtttgtggcaactgctggaacaccagaaatgcccttttaaatgaggagaggatgtaagctgggagctgatggattcaacatatggagggaatctgccagagaatgaggccaatagcagtgcttgagagaggaagagacagattcctgacctcatcatatgagcacctggatcatgctctgtataatgccaaatgatccctacaactttccattacatgagttaatttatttcctccattaaaaaacccagtttgagctaggtagtcaccacttgtgattatgagtcctaacacagctggtataggcttagccacaaagtactgtgggtcttcaatgagggtaggtaggaggagctcagccagggccacaggaactccttgggctgttggatctctttctcctggcccagtataaggaacttgggctctcttttggctgtcatctcgaaatatgatagttccctgagctgagtcaggcctttgggcctggaatcccctgttgccaagcccagctgtacctctgggatatcagtgacacatttagtaagtgctggagttggcagaaataaattcaaattacaataaatgtaactgggttaaattcatcagttaaaagttagaactcttgggttatagaaataaaaacagcaagatccaaccatacaagaggcacactttaaaagacatagaaaggtggaagagagaagaatgggaaaagatatacctgaaaaaaatgaaccaaataaagctgggttaacagttttgttatctgattcaatagaatttttttcttgtaaaaatagaacacttcacaaatttgcatgtcaaccttccataggggtcatgctaatcttcccttatcatcccaattttaatgtatatgctgatgaaatgagcactgagtataatttaagaccaaaaattataagggagcaaataaggaaattataggtgggtaaaaagaataacaaaacaagaaaaaatatgtcgtcataagcatatattttcctaacaacaaaaactttatagcaagcaatagctggcagaacctcaggaagaaacagataaatcagcagtgatagagatttttaacatacacacagacatctcagaaactaatggagaaacagacaaaaaagtgaactgagctactgagcaatacaatgaatacatttgaattattaactatatatagaactctatttcccctaaaaaaaaaaccctagagaatatatgtttatttcaagcacacacatatagaacataaacaaaatatgttggagccaggaattggactcagcctgctctgttttcaaagctctgtattattctgtgtcatgcgtgtgtctgtgtatatggggagcgtaggtgttggtaaagagaaactggctgcagccaggctggggttcaaggtttgggagactagtgtcaggaggggtagttaggtgtcaagaccaaatgcatggcctggtttgggccatgggcatggctcccccagcagactcaggagggaaccagccagccccagagccattttgcctgccctggtcaggcctgacccagagcccactgctgtgtttgccaaatgtgtgacaatattgccatggccttagcaacttaaaacaacacacatttcttagctcacaattctgtggatcagcagtcctggcctggcttaagtgggtgctctgcactaggctgcagtcagggtgttggccagagctgagttcccctttagaacccatctaagggaaggatctgtttgaagctcacctggttgttcggagatttcggctccttttggtttctttcagggcttcagtttctcctggctgttggctggagaccatccttagctcaaggaggtcaccttcagttccttgccttgtggacctcaaatatggctacttacttcattaagtcatcaagagggacaggctccttgcaagagaagtgtcacaatcttatgtaacatagtcacgtacatcctattaccactgccatatcctattgattattgcaattaaggggaaagaattacactagggcatgggatcaccttagagttgctccttcataaccttaataaacggcagcttggcaggcttggcagatggtgccctgtgactagaaagctgaatggtgtgcaacccgtccacttgggttgggtcacatctgagagagtcgagaccactaggccattggcttctcttggcttgagggtctctggctcgtcagagtggatgaatctgctttggcatttctgaagcccagggaatatggcctccaaattgccacagtcacccttgcagaagggactggaatctgagccctgagatagtaacaaataacaagacgtgggtgtctgggggaagaatggctcaagcagtggaaacagtgcatgcaaaggccctgggtcaggaatatgctttggggtatgcaagggacaagaaggaggccagagagggaaagaggggcgggaagtgaggtcagggatggagacacagatttccatggccatggctcaatctatcagtgcactactggtagactttcagggtgtttccaatgctctgctatagtgaatacccttgtccataaattttgcccacacttgcaaatatgtctgagggtaaattcctagaggtggaattgctgggtcaaaaggaaagtgcatttcagtttggacagccattgccaaattcatccttcttccctcgcagagttgacactcccactggccctttctcttttttttaatttttaattttttttgaaatggagtctcactgttgcccaggctagagtgcactggcgcgatctcggctcactgcaacctccgtctcctgggttcaaacgattctcgtgccttagcctcctgagtagctgcgattacaggtgcacaccaccacgcctggctaatttttgtatatatatattttttaatagagacggggtttcaccatgttggccaggctggtctcgaactcctgacctcaggtgatctgcccgccttggcctcccagagtgctgggattacaagcatgaaccaccgaacccggccctcactttcacttttctagacctacaatggggcatttattagagggttcaggctaatgaatgcagctcacgccaacccccctgcattccccaccagtggcccaccctggcccaggagagagtgcctatttgaaggggcagaaagattcaaatgtgtcttccaatcctcttctaccacagcttctgtaacactcattccttcaacaagtatttacagaggccaacacgcccagcctcccactggccctttctgagggtcctccatgactgtgatgtccttggtccctgcctaggctggcgtcctgtcctggtttcacacagaagagctgctgctgtctccctggactcccagcccctccctgcagaaggctgtttggctgcagatggctggggagtctaaaagcccctaagaggacactttcccttgatggaaattctccatattgggaaaattctccccaccaatagtcttttccctgtgctttccccaggatcagaaactccccaatggctattctgagacaatgtgagttcgcatttacccacaatttgtctctgggaaggtggaggtctggcaaactctgccagaggacagagaacagagaacatcttgtctgcaacggggagcagctgtcccctagttactgcccatgtgatattgcaggggctggaaaggctgggggcttccggacctgctgagatagaggctatgagagtcaatcagcatttactgagcacctactatgcggctcctgcacctcttcctgcccgaccaagcccgattcaggacgagggcagggctgagcctgtgtgagcctgtgacctagggtctctgtggcttcacacctgagcctggtcagggcaggcaggtgcagactggggtaaccgcagcccaggtgcccacccagggcctccttagagccaccccttcctctggagcctccccctctcttgcctgtttctcagcagcttgcaaaaccagttaagccttaatctttggtgattgaaggggtgtcctagtcctaaacccagctctgagccagagggagcccctgctgggagcacctgccagagtcacaggccttcctcagaagacaggcaggatggctgggtgtggcagctcacgtctgtaataccagcactttgggaggcagaggcgggagagctgctcgaggccaagagttccagataagcctagccaacagagcgagaccctgtttctgcgcaaaaatgaaaaaaaaaaaatagctgggcatggtggtgcacacctgtggtctcagctactcgggaagctgagatgggaggatcacttgagcccaggagtttgaggctgcagtgagctatgatcgtgccactgcactccagcctgggtgacagggtgagactctaactctcaaaatataaaaagtaaatagaataaataaagagggatagaaaaccaactcctgctcaaggaatgtaacagatgagaagagctgacggtctttggcagggactctagggccaatgggagcaaagacagtgatgtctgggccaggcagtgagacgcatgagatgccctgggctgccagggccctgccctctctgcccctatatttgcttggccctgggcaatctcatagctgcttaccctgatggagctcttagcactcgccggaggatggactagggcatggtgccgagacccccctccatgcttctgcgtgacctcactccagctttgtctgcctgtcattctggccatatatggcctaggtcccaatcttgaaggcttcaaatctcggatcctgtcccagaacagaggtgggcctcgcagagccagacactatcatgggaagtgtctaggcccctctatgagcgccccctagagccagaagtcaggagaagaccaagagcctgcagagacacggagccagatccacttccaaatgggataaggcagacagtgtcactcctacccctcccacagctcaagaccgtctcgtggctcctcatagcaacagtcccacctctcacccacctcttaacctcctcactctttccctgccctgggtctgaaactgtgaacacacttggtctcttcctgcctcaccattctctccatctggggctctctccctccagaaccttcacagttttcaggtctcagcttaaatgtcaccttctcagggaggcctaccctgacttccttggctaaactaactgactcaatcattatcttccatatcccgttctttgccttcacagcatttattaaactgtgaacttcaaaaggtatttttatttatttgtttttgtagagatggggtctcactatgttgcccaggctgggtttgaattcctggccttaagcaatcctcctgccttggcctcccaaattgctgggattacagacatgagacactgtgcctggctaaattctgaatttttaaatgggtgtgttttttcccatcttccttcataagactatcagctccttgagggcagggacctttttgtcttatatactcctttatttcctaaaccatgaagacagcctatcatccagaaagtgcttaataaatatttgctgaatgaatgaatgagtggaagagactgtgatggaatggtaaaacacctggacttggagttgggctgacctggactcaaacacactccttccttgctgtgttaccctggctgagttgatatacctctatgagctttacactctcttttttcaaatagggtgtaatgaaacctagccttcctgggctaaggcaaggattacaaaggacaagggatggtcaagtgctttacaaactgtaaagtgcccggggtaaagagaggctgtcaattttggctctctggacggttgtcaaggtggccgctcatcctctcattttcttagtgcacaggcagctttcttaggtcctggccagtgaaactaattggatggagtcccagcgttgccgcagggaagtgtggaagctcagagcacttaaaacttaactagccagaagagttggatttgcatttcagcgaatgagaccagagggatggaaggtagtgctgggaggaatgttcttgaggtggcttgcaaagggctcagttctatgctaaggcagaaggactgagctggtggggggtgagctggggcctgacactgcaggtgtagacccgtcacaggtgtctctgccgatcagggccctccgagagcaaaacaggaggagagggggaggcccaccatggagacatgaatacagtgactattcctgcttgtcacttggagacatttaactggacgtcttggagagggggtagggagagagaggcagacacaaaacagtggcagacagagagaaagagacaaaaatgagagagagatggagagaaagaagtctcagggagggggagtccgcccagtgtctcccatgagctcaaaacaaagaaggaaattaagataggcttccccggggtgctgcacactcccatttatctcagagaaccccttgcctttcgttttcttgtagagatggggtttccctatgttgcccaggctggtcttgaacccctggcctcaagtgatcctcctgccttggcctcccaaaatgctgggattacaggagtgaaccatcgcacctggccccccacgcctttctttctttttttttttttttgagatgtagtcttgctctcttgcccaggctggagtgcagtggtgtgatcttggctcactgcaacctctgcctcctgggttcaagagattcccctgcctcagcctcccaagtagctggggctacaggtgcccaccaccactctcagctaatttttatattttttagtagagatggggtttcaccatgttgcccagggtgatctcaaactcttggcctcaaataatctgcccaccttggcttcccaaagtgctgggattacaggcatcagccactgcttctggccacccccatgcctttcatcatgcaagcatcttgcctcaaacagggtgcgtctagtatttagggatctttgtctttccacatgggcccccaaagttgagccaaccccttcctctggtgcccaatcgaagagagaccaatctgttgccaggctggaagaaagctgggcttgaacttccaagagaactggtgtgtgcacctatgtgacacctccctgggggattcccaggcctgtcagggacacttttagagcccacctccacgttctgatgggagccaccaccccactcctcacccaaatccgcatctctcctgcttcatctgtctgcattctgctcctgtgaccattgccacatccgatgcccaaggtacaatgttcacttcgcattttctctaaatcactcactgttctcacaacataaattcattcagaaaggaaccttcagatcaccactggaaatgaaaagccagtatcacttgcaataaatacaaaagaactgtcaaaaagaaattaccattgtaaaaatgttcgtgaggagccgggagcgatggcttgtgcctgtaatcccagcactttgagaggctgaggtgggatcacttgagccaaggagtttgagaccatcccgggcaacatagggagaccctgtctctacaaaaaccaaaaatattacctgggcatggtggtgagcaccttgtggtcccagctactcaggaggctgaggtggggggctcgcttgagcccaggagttgaaggctgcagtgagctatgatcgcaccactacactctagactgggtgacagagcaagacccttcctgaaaaataaaataaaatagaaacaaaaacattcatgaagaatctaaaacagtggattcaatgggggattattttgtcccccactgtccctgccctccccaccacaaggatatttggccaatgtttggaaacattttctggtttttatgactggggtatgtggggatgggggggggtgcacattcctggcatctggtagatcaaagccaggtatgctgctcagcacccactaacgcctaggacagccctgacatcaaagccttctctgtccccaaatgtcagtagtgctgaggtttagaaatcctgctctaaaatgagcttaagcaccgcagaggggtgagccccacactttgggcagctgtggcctagttaattcctccttctccttcaggctgcactgaaacatcctgcctcagggaagccttccctgacccccagaacagagcacccggtgtaggctctggctccaggggcccctgtacctcccgagccctgactcatgacccttgagggtgatttcttgctagtacctgccttttccactggagcagaaactcacagtgggtaggggccatgtctgttccgttggtctctttttttttttttttttttttgagactgagtctcgttctgtcacccaggctggagtacagtgacacaatcttagctcactgcaacctctctttcctgagttcaagcaattctcctgcctcaggttcccgagtagctgggattacaggcaccggctaccacacctggctaatatttgtatttttagtagagatggggtttcaccatgttgtccaggttggtctcgaactcctgacctcaggtgatccatgcacctctgcctcccaaagtgctgagattacaggcttgtaacactgcttccggccccgttggtctttttctgcagcccttagcgccgtgtcaggcttgtagcaaatactcaatagctacatgtggaatgaatgaaggttgggccaaaaagagatgtggactctactcctggactcaccacagctcgctgagcccttaacctcttctcagcccactttcattctcacctgtgaaatgcacacctaatgggcctgttgtggggatcaaaggagaatgggcatgaaagtcctcagcaggggacaagccagggcatccaccagggggaggatcccttgcagagtgggagtcattccctcattcatcaattccaccatcacggtcgagcaccctggatgtctgttgtcccagggtaattttattttatttttttaagagtcgaggtcttgctctgtcacccaggctggagtgtagtggtatgatcatagctcattgcagccttgaactcctgggctcaagcatgtgaatttctggggtagaaatgtagaaggtagagatgagatgggcaggattgtgacttaggggtgtgtacatccaagggtggctttccccgctctcctggatctcattcccacccaatcacaagcctgagaactttctccttgtcctctctccatcatccttcaggtgagaggcccacgctcatcttggggaacttgtgagggtacaaggccaccaaaatggagctcagtccaggtgaagaggcatgtggggtgtccaggacacaagtggacacagatgaacacaggtggacacaggtggccatcaggaaatacaggtgacacaggtgacacaggtgggcacaggtggacatcactctttttgaacagccctcgaggatgtgctggctgtgtctgtgagcacacggcccaactcgcaaggtgtccactgttcactcagactgggaaaggaccatttgtgagtgccaacttcacctccctgtggctcccaggggatgtaatggaaagggcttgaagtggaggccggcggccttttagggaagccctgctcatatctgcatagtgcagctcattccttcttggggccaaccatccccctctcctcctattcttccccctcctcctccttccgtccccctcctcctcccccttttccttctccttttcctctccctcctcctccttctctcccccttctcctccccctcctcctccccttttgccttctattcaccctccccattccccagcctttcccatcctcccccttcctctccccttcccctcctcctcttcctcccctgcgtcccagtcccctccaggcgagcaactttagctgatctccaggtggaaggggaagagaaactgtctctctcttgatagcgtattcttctcaacctttttcttggaacacctggatgtaggcttttgaaatctccaaagccaaattgggctcctgttctctcagtcttctgggacagctgtgccctgaggtcatgggtgttttctatctagttacccaaatgacaaggggaacagggaatgctggcagcctggctacatgtccattaatgtcagatatcgtcccaccagcagtttgtcctgggttaccctggacccactaggtcctgcggccatggcctctgggatcactctgaaccccacctgggggatcagagcctagtcactgccacagggctggatgggggcagctgagctgaacaaggctggtggaagttcagtaaacccattacttgaaattggaaggtctccatgaagtgccacctccgatttggaccacttcactttaaaaggcagaattccaaccagagtgacgctaatgactctggtaatctaaaaggggacctttggagaaagggcagagaaattggaatgatctctgcagacaagacaaggttggggggcacctcagtaattgctgaccccccaaaatgctcctctcaagaagatgccaatcggctcacccccctccccgtgtcctcagagggcagagcaagaaattagcttaaattggagcgggaaagatttaggttatgtgtaaggaggaactttttaaaccctgaaatatgctaccaagagaggcttcgggttctcaagagggtgtctaaaaatagcttgttctttaaaaataggtctgggcaagttttaaacatagcatcagctcagcttctcaggggtggccttatgtgcaggtgtacctggccacgtggggttcccccagggcagagggcacagggaaaagccaggctttggtctccgtcgtgaccaacatcaggatattttagatacgttcagataagagatttattttttcctctgcccccagccgattggtctcatgaaacagcagcttttagtttctcaagttttttttccgcgggaggctgttctggggctgatattaattgggtcagtcccaacagcttctcctggttgctcctagtttcccccagtcccttgccattcctgagccagggttcttcagtgcctgatggtttgctgggaagtaagcggtctcagcggtacccggtgccccggggctccatgcctccagcatctcagcgccctggcaagtcccgcccatcctcatcctcacctgcggggaggactgcagctgctcctcccaggctccctgcctcctgctcctctcgcctgttctcaggccacagccatgctcaccatccccacccaaccactttgctccgaaagttgcaattcctgccccgggtcctcaggataaagtccaaactgcctcggatggcttaaaatttcccatggaatgtcctcgtttatccctgcagcagcatctctcacctctcacgtgccccacctaagtgcctgtgacagccacaccaaaccactttgcctgtgggtttctgctggtgtgggttcccctgcctgctccaccctcctcctcctccctctgacccttccactctcagctgctatatcatcttctgtgggagcctcttctgacctccccaccccacagaccccgggacttctcctcttgactgccctgacaccgagaggtgcccagcctgtgtgtctgcctctcccatcccaatggaagcactgggaggacaggccgcttgaccactgtggaaaagcctgaagcacagcaggtgcctgatatttgctcagtgaccagctgaaggtcaggggtttccctttgcagccctcctgccccatctttctggctccagcatcctccaggtccccaccagcccctctgtgtctcaagtcccggacatgacacgcatgcccagcatctacgagaatatttatttaaacatgagtgctcactgcgtgttctcagtaataacttagcatctttagtaataaactctattataaatcaattaatcagctacctccctggtatctcaattaaatggagcgtggcattcgcataaagcatccaaaccctgtcaaagggagccaggccagaggcaggggagatcctggatttggggttgtcaccgctgctctatgtcctcacccaggggtagctccaggctggagaccccttgggaggggtcatgtgggctctggtccacccccacctcgagggaggcgcaggaacctgccacccctctccccagtgattgagcaaaagatgattcgtggcatctcgggttggcattcctgtgtgtcctctggactcaagaggccctgacaggtgtcaccaggccaacttgtctctccctacctgaatcccacagctgccctgcctgggctcactttaaattcatgagcacggatctcacacgacaagcaacactgccctgagagccgcatgcatttctgcagcgtgtttgtgctttcccactctcagaaaagactatttcataccctctgcttgccgctcctcaacccccacttccccactctcagctggtgaccttgtctccagcttgctggagagaaggggggtgaatctgcttaagaactcagatccagcagggcacaggggctcctgcttggatcccggcactttgggagactgtggcaggaggatctcttgaggccaggagttcaagaccagcctggacaacataatgagaccctgtttctacaaaaataaaaatgtcagccaggcatggcagcacttgcctatagtcccagctactctggaggctgaggcaggaggatcatttgagcccagcacattgaggctgcagtgagctatgatggtgctcctacactccagcccgggcaacagagcgagaccctgtcttaaaaaacaaaaaacaaacagacaaaacttgggtctcgctcagacgctgtcttcctgctctcttgggtaacgcatcccaattcccatcaaaagccagccctcttgttttctagaacctcctcgcaccttctggccgtctctggaccttgcttccacaatcgccctctcgctcccctgctctgtccatctctccctctccacgtgatcattctgcatgggcatggaaacattctctatctcccattgttaaaacgccttcccggcgtttaacattctctatctcccggtggctcatgcctgtaattccagagctttgggaggctgagtctggagggttgcttgaggacaggagtttgagaccagtctgggcaacatggagggacgctgtctgtacaaaaaaaaataaaaaaaaaaggtagatgatagatagatagatgtattacatgtatatatttttaaataaataaaatgccttcctgagccccaggccctctccagctatcacccccattttcccacttccccaggcagcattatgctttgaaagctttctctatcatttaccctcctcctcttctaaacctcttgcagttgaagactccacgctggttttccctcagcctccctggccactctgcctcagctttctttgctggtccctcctgctctgcttaatatcagatgttggcttcatcctgggacccttctctctcctcttcctacagtctctctccaggtgacctcttctaggcacattgtgttatttatcattcgcatgcagatgattcacgcatttaagtctccggttctgactactccttgaatcgcagaactggcccttcaactgtttgcttgctatcccagcttagatataaaataggcatttcaaggccggcacggtggctcacgcctgtattcccagcactttgggaccaaggtgggcagatcacctgagatcaggagttcaagaccagcctgactaacatggtgaaacccctgtctctactaaaaatacaaaaattagccgggtgtagtggtggcacctgtaatcccagctactcaggaggctgaggcaggagaatcacttgaacccgggaggcagaggttgtggcgacccaagatcatgccactgcactccagcctgggtgacagagtgagattcccatctcaaaaaaaaaaaaaaaaaaaaaaggcatttcaaatgaatatggcacaaataggattctacccacccaaacttcttcctcccttcatcttcttcatcttggcaaatggcatctgcccagacgctgaaacccaaactcttgatgtcatcctagatcccagggataccacctgtgtgcagcccaacagcgagtcctattgactccaccctcaaaacttgccccaggctgggcacagtggctcacgcctgtaatcccagtgctttgggctggaggatcacttgaggccaggagtttgggaccagcctggacaacacagggagactccatctctaaaataaataaataaataaataaatacaatagccaagtgtggtggcatgcacctttagtcccagttactcaggaggctgaggctggaggagtttgaggttaacagtgagctatgattgcaccactgcactactgcttggatgacagagtgagactctgtctcaaaacaaaacaaaagtaaacaaacaaactaaacatacctcagagctgccagcaacaccagcctaaacaaaaacagcttaccctgggcccttgcaacagcctgtcagccgggcttacctcctccccttacaatcactgtctccacacagtaatcagaatgattttcttagaagaatcagttagacccctgcttaaggcggatagccttttactgacttctcgtcctgcatagggtgagagccaaactgcactgtgggctccagggccctgcatggccctgctcctgcctgcctttctgactccatctgacacatccctcccctttcttttctcttttttttttttttttttttctttttgggatagaggctcactctgtcacccaggctggagtgcagtggtatgatcttgcctcactgcagcttctgcagcttctgcctcctaggtttaagcgattctcctgcttcagcctcccgagtagcggaggcatgtgccaccacacctggctaattcttgtatttttagtagagatagggtttgccatgttggtcaggctggtttcgaacccctgacctcaggtgatccacctgcctcggcctcccaaagtgctgggattacaggcgtgagccaccgcaccaggcccatcctaccccttgctcactctgctacagcatttcctcccagccttcagccccagcctttgcccaggcttctctctatgtctggaatgctcttccccagtcttctgcatggctgccctcagctcctcattccaaacctctgcttaaatgtcacttcctctgagatgctctccctaaccacccaggctgaagtgccccccacctccaaggactcttcaccacttggccctattttagttttttcatggaaatgtttactgcctgaaatttcatgttagtttatatgctaattgtctggctgcctccactagaacccatgcccgttaagagcaggacatctgcccatctattccagtctaccactccccaaccccctggaatagtgtctggcatgtgaaaagcctttgctaaatattcgttggctgattgaatgaatacatgataaatgaatgaatggtgaccctgacacgtgctctcctagacaaagttttgcagtctggtcctgtcctagctcattgccatatcccacactcttgacctttatactaaccagcccaacatccccaagcacctctcaatcactgctcatttattcattcagtaaacacttattgaatgcctactgtgtgtcaggtactgggcttggcgctggggattcaggggagagccaaacagatctggtctctggactagcatacagtctagtgggcctacatagtgagtctcagatgtgcactcttcattcattcattcattcaagaaacttctgtggagcttattttgtgcctagtgctgttctaagtgctttataaatataagccactgaatcctcataccagtctatgaggtaggtactattattatccccatatgacaggtgaggaaactgaggcacagaaagtcaacctacccaatgttacaaagctggtaagtgactgtattagtcagttctcacattgctataaagaactacctgagactgggtaacttgtaaagaaaggaggtttaattggctcatggttctgcaggctgtagaggaagcatggcttgggaggcctcaggaaacttacaatcacagcagagggcgaaggggaagcaggcatgtcttacatggctggagaaggaggaagagagtgaagcgggaggtgctacacacttttaaacaaccagctctctcgtgagaactcactcgctatcacgagaacagcaagagggaaatctccccccatgatccagtcacgtcccaccaggccccttctccaacactggggattacaattcggtgagagatttgggtggggacacagatccacaccatatcagtgacagagctggaagctcggctctctctttcactttcctggctctgctttcctctgggctcaccttgtgatgcacttgacattgtctcttaattcttagcccccctggactcaacactcctggacttaacagaattcagcttcctcagtttggactagcacagggcagggctaggagtcatgacagctcttcctgctctaagttctggggagcaccacacccagcccagctctggctccctggccaacatccccccatttccagtgttctccaagatttccttggggcctggaggaaccatacccacctgaccacaccggttgggaattccatttatagtttcaggagttgggagattccagaaaccacaaggagagatttacagctgtgggtttcctggtgtgagtccaagccaggaagtaatcacggcagcaggaaagcctcattcatttagtctcctctaattcaggaggtgcagtaactcaccaaaaagtctctttttaattcagatgagttggaaatgattccttctgacaaggatttgtaggacagatgctgtgggtggaccttgctttacagaatgaacaagcttttgaaaacataggcaaggttcagatttttttttttttttttttttgagacggagtctccctctgtcacccaggctggggtgcagtggcacgatctcggttcactgcaagctctgcctcccaggttcacaccattttcctgcctcagcctcctgagtagctgggactacaggtgcccgccaccacgcccgggtaatttttttgtatttttttagtagagacagggtttcaccgtattagccaggagggtctcaatctcctgacctcgtgatccgcatgcctcggcctcccaaaatgctgggattacaggcatgagccaccgtgcccggccagggtcagattttgaagcagaatctttaaaatgcaatcagagagttccaccaaggtatctttgagtgaactgtaatttttacttattgaatttccttaaagcatggtctctcgtatttggggataaatagaatttaatttaggaatcaatgcttttctaaactaatagttcagaaaattaattattttgccaacaggctaagtccaccttctgggtgggagattttgtattaaaatactgttgtgctcctactatcctggcataaggagttgtccttctcatgaatattccagccctcagaaaaggaactggcagaagactaagaaaggggtcaacacccttctgagcaggaacagcttctgggcagggtaacaattccagagagactcagcattgggcagtaataaagaggagagacttgtcccttcagaaaacagattgtactgtaaagttacagtgattaaaacagtgtggcactgatgcaggaacacagagaaagatcggtgggacagaatgaacagttaggaagtgcacccatgtaattatgggacttggaatatggtataaaagtgtcctttaaaatcagtaggggaaatacaaaaattagccaggtgtggtggtgcgtgcttgtagtcccagctacttaggaggctgaggtgggaggatcaactgagcctgggaggtggagcttgcagtgagcccagatggagccactgcactccagcgtgggtgacagagcgagactctttctcaaaaaaaaaaaagtttattaattgttttaaaaaggtgtaatctatgcaacagacaagattaatattcagaatacacaaagaattcctaccaattgataaggaaaaagatttttaaaaacaaaaagaaaattggcaaatgatacagacattcaaagaagcagaactagaagtggttaataaatgtgaaaaatgctcaagctcactagtactaagagaaatataataggcttttggggtccccattctcccattagcagccaggcagttttctctgctctgtcttaaaagagtggaaagtctacaaaacactgagaaaataatggtcccctgaccccagccaaagcccactctacagctgggtcttcttactagatgggggaaaatgctttaaacataaacaatttagcctctaatcctagcacttggggaggctgatgtgggaggattgtttgatcccaggagtttgagaccagcctgagcaacatagcaagacgctcatttctacaaaaatgaaaatacaaaaaattggcctgtcatagtggcatacacctgtagtcccagctacttaggaggctgagatggaaggatcacttaagcccaggagctatgatcgtgccactgcacttcagcctggcaacagagcaagaccctgtcttaaaaacaaaaagaaagaaagaaaagagaactaccctctctggcctcccaagctctgttcctgctgacctcccttacccagaggtccctgttctccacagtgatcacaggcagacaggcaggcaggcagcagagaggctgtgggtgtgtggggacaaagcccttccttacttcctgacgctttgctctgctctctgccccacaggcctcctgggaatggtcgcccacatgatgtacacgcaggtgttccaggtcaccgtgagcctcggtcctgaggactggagaccccattcctgggactacgggtggtccttctggtaagtggaccttcaggacaagagcagcttcaggcaccagggcccaaggcacgctgggacttcagcagctcagcccagtggggtggggggcggtgggggggaggagaaatggggggagttggaggggctgtagtccaaaggcgctttaagaccccagggcagggattggcaaactagggcctgtgggtcaaatctggcccaccacctgtttatatgcagccctcaagctaaggatggcttttggatttttaactgctaagaaaataaatcaaaggaagaggaatgctgttttgtgacatgtgaaaattacatgaaattcaaatttcaatgtccataaataaggttttcttggaacacagctactctcattgttttatattatccacggctgctttaacactgagatggcagcactgggcggtggtgacagagactgaatggctcacaaagtcaaaaatactctctgacccccagccgacccctgcctaagaggcgtgctatggaaggttggagatggaagctggcaagacctgaagttaggcgagctgtggagggttctgggtggtctgatggggtaggtggactccagtgaggggctctgaatacaggaaacaggtcagcacctcaaagcggggtttgcatatgaaaggcatgattagtcagggttcttttgcttttgagtgatagaatcccaagcgtaagtgaacaaggggtgttcatttgtttgtgtaactggaaagtccaggtggatcagctagggtgctctgggttgtaacagaaaaacctacctgcatcagtctaagtaaggagatatcatacattggttcatggaaaggaaaagcacagctatggtgtggacttcaggacacgtttgttccagagtcactgaggtcataagggctgagttctcttcctctgtatagtcatctgagcttggcaccctccacatgtttactttgttgcttggctggcttccctgttggggagagctcttcctaaggctggtgcattctccttcccttgtaggagagaaagggcctcttgttctccaagattgactagagtcccaagcttccctctggtgggcttaggtcatattctctctccttattcattgccacagctgggggaatatcatgagcttattcccttagtttgaccaagcccacctctggagcaaagaatgagtcaaaacctctcaaatggtgagtggatggaatagatgctgagtgagctaccacaaagtctgcttcagacacagctggatccaggtgaccagatttcatctggaacccagtcatgccctcatgccctctccttatcttgtctctcttccctttgaattggtgttggcttcattctcaaacagcttttccccaaatgctagcaaagattatcacaatgcacagaccagccttcctttttttttttttttttttttttttacagagtctctgctctgtcacccaggctggagtgccagacttccatcttaaaaatgtagcaataccagcagagagatagggtttctttcccatatttccagctaaaatcctggttatgactttcattggcttagcttaagtatgtgaccaaacctgaaccaatgatttagaccctgggggagactggaatgacctgagccacatggtccagagcgtggcattagcctcacccaaacccttggacagaaagagaagtaggggaagtctcttcaggctggaaagacagagaccacaattgtccactacacagggtatccaggtctggggctggtagttggggagcatttacccattcagtcatttaacacatattaactgagtacttcctctaggacagctgttcttctaggtgctcgggatgcagcagtgctgagacagcgttgcaacagggattgagacaagtgaaccagctgtatctgaactgtgctgtgatgtagatgtgtgtggggaggagagttcacaggcagctgcaggagcacagaggaagggcattgactgacacagctttgggtggggcgggtccccaggaagaattttgaaggcaaaacaggagggaatcaggtgctaggcagagggaacagcaggtccaaggacctggaggtgagagagcatctcagaatggagcaggagggactatgattataattttaaaaaagaccccataccagttcagtgggcaccccagctccatctccactctctgctcaattccatccttttaaaaccaaaagcatttgccttaaagggaccttgacccattaaccctggccccgatccctttaagtagaacaatcccagggaagccagctgaggttctgacctccctttacccaacccttccccctgcagctgttccttcctgagaccttgaacttggaagatcttctccctgagctagagaagggcacagaggaagggaactaatatttgtgttgaccatgtgtgtaataatatcttagatttactgagcgctgatgtgccatgaatcaggtaggtatttcatggaggcacagagaacttaagtaacctgccctgaggtcttccagctgcgaggggtagagctgggattcaaacccaggcagtctggctctagagccatactggaagcctctctgagaagatgggtaataatgagagttcattgatgtgctttctgtgatgttccacacatggtgtgttctcagtaaacaccagctcttatattgttgctactgatatgaaatttaacacgcgcaacaacgtgctactgatgtgaaattcggcacgcgcgacatcgtgctactggtgtgaaattcggcacgcgcgacatcgtgctactgatgtgaaattcggcacgcgcgacatcgtgctactgatgtgaaattcggcacgcgcgacatcgtgctacctgatgtgaaattcggcacgcgcgacatcgtgctactgatgtgaaattcggcacgcgcgacatcatgctactgatgtgaaattcggcacgcgcgacatcgtgctactgatgtgaaattcggcacgcgcgacatcgtgctactgatatgaaatttaacatgagcaatatcatgctactgataagaagtttaacacatgcagtaacctcgtgttgcatatgcagatgctgagaatcagaaagtttgaatcacttgccctggtaggaactggttcctccccatgagtccccctttccagaaggccctggctctctcctctggtgctcagtgtctcaagtcaagcctgctggtgtcagccaggggaacattctttccctggaagccagggatttctgccctgctcctctgctccctccttcggggctggcctcccaaggggcaccgaattcccactggacttattaaaggccggggcccagtgtgcagcccctattagtgctgatccatttctccctgtcactgagacctgcaagatggatcagccccgtttttcatccctcacatttggggcctcgccagggctgcaccatgtcatctctcttgtttaatatgtgtgaggccatttgtcaaaatcctggcccgagagccttccctgctccctcccccggtactggagaggagaacagctctgagaagagatggcacccgcctctgtcttcctgcccagcagggaagaacaagctgcagggtctctggaagctggaggggttttgaggcgctcaaagccggttgagtgccggtttcttagagggacacctttgcaagaagtagaaggtctccatggttaagagtctgacagcctggggttcaaatctcaccccgacatacactgctgggccactgtggcagcgtggaggggcggtcaagggtgtggctcctggagtcagacagttcgggttcagatcctgcccctgcccctcaccagccggggaccttggccaagtcacttacctcctctgcacctctgtgtcctcagctggaaaatgggacagcccgaatttccgcctcatgggggtctcttgaattgtattccatttctctgttgaggtgtacacatcacccccaaatctagtaaaaaatatgttattatgtagtaataatagtaactagtaaaaatgtgttgttatttgttcttacgtttggtggtggaccgggctcatctgggtggtgcttgctgggttcttcctcgaagcttcagttggatgtcacctgaagctgaggtcatctggggcgtggctggggtggacctccaaggtggcacctcatgacactggcagctggtgccggctggcggtggctggcggccggaggggcttcacacagcctggaggctgggtccttggggagactatctcaagagtgagtgttccaggagacccaggtggaaaccacagtatctgcatgagccaacctcagaaatcacacagtgtcactcctgctgcattctattggttaagagcaagtgacagggccagcttcaaggggaggcatgaaccgcgggaggtgtggctccctggaggccagctttggagacagtaaccaacacgaggagctagtgaatcaatgcatgtggagcactcagcacagagtttgctcggtgagtgcgagccctcctgcccactcctccttttggcgccatgtctcagctctccctacctgtgacaacgtcaggtcaggaccctgatgggtgcccaagcagctgcttggcttaacgtggcagggaccaagtgaatcagattaaggttggggctgagcaaagtggctcacctgtaatcccagcaccttgagaggccaagatgggagaggggctgggcaaagtgactcacctgtaatcccagcaccttgggagtccaaggtgggagaatcgccagaggccaggaattcaagaccagcctgggcaacatagccagacccaatctctaaaacaataaaaaataaaaataattacctggctgtggtggtgcacacctgtagtcccagccactcaggagggtaaagtgagagggacactcaagcccaggaggttgaggctgcagtgaactgtgttcgtgccactgcactccagtctgggctggaggttctgtctcaaaaaagaaaaaaaaaaaaagattaaggttactacacctactttgtgctgtgcacagtgggaggcactttacaagcactgagttgcctggtcctgtcactgatccccaggagaggggctgccatcccccttcagggaccaggaaacaggttgaaagccaaacaattagccttggatgctgtgaactgcatgcagccggggctgaacccagcctgcggatgatttcttaggcctgccattgtgtcttgtaaaagtttggatttatttctaacatctaaaatggtaaaacttctacataaaagtccaggtttctgattcatgatcattggaagatctgttcctgcacaaccagcattgccaccaggcagcctggagataaggctgagaatgactgaaactttagataggcatctggtctccagctcaccccagtccccaccacaccctattgccttacatttacccacgcttccacacttagtcatcatctgcctgatcttgcaggaatttgagtctgtggcccctgcttggaatgtcagctttcctggtgacagcaggagtgtggaaagctagccttgcgctttctgcttctgttttgccttttatcagtctggagagaaatggaaaaaggtctcctcttactcctgcacacacagtgaaatcttatctcaagcattcactctgcagactgagggtagtgggacatcgtggtgtggaagcttataagagctggagggcccagagaagttatgcaatttggcccatgtcacacagcaagagagtagcaagttgggccagatctagggaaggttctcactcctgtcctagtggcccctttctgtttctggggccctgtccctgtggaatataggcctcactgctgtccctccctttctagtctccatgactatgtggaaacagcagaccagcctctttcctctctggggaccccaggcggcccctttgctctctggaggggttagctggtattccagcaggccaatcccttaaggggttgagtctgctgctgtgaccctaccagagcctgggccccaaagacaactggagagggtgtgtgtgctgatgtctctgctgagaggctgtgtgatcagcaggaagtctgcccttactcatcaacctgaggcaggtggctgcggcctcctttattctaagaccagggttggggaaagggatgtggctgcccaagggtgccctgtgggccatggagggaccagctgggccctcagagcctgccactatccagctcctagtcccatcagctcttgggccctgagggtggcctggattatgcatctgtgcccagccgtgccccacatggtgaatctgtacccctctggtctgcaggcagccaaggcagccttccttagtgatccattacaacctccccactgggcagggcctggagtaggttgcaaggtggtgtctatgtgcctctaaatctgctccccctgtgtccctctgcccctgctgctcccaggggatgaagaattgacaacccctgtcaccaccctccccttttctccctatggtgtccaatctgctcttggctccggaaaccaggccaatcacccacgcagctccgtgtgccagttcagaagtacaagctgctaaaaccagcaggtgttctggccccagagttttcaaactgtgtattttgtgggtgcgttggggccctggggggtgagaggaacagggagatgaaggctcatggatatagcctctcacccatgctaaaaccagagcagtgttttcatatctgtccttttctctgtttttattttatctgtgtttatccattcattccacaagtatttactgagcacctattatgtgccaggcaccattctaggtgctaagggatagtagtgaagtgaacgaggctcccattttcatgaagctggcattctgggatagaagaggagataatcttaaaaaacaaacactaaggattccaattctgagaagacagagtagacatgcttcttcaatacaaccacaatccttggacctaaagataaaacagacatcagaagactctgaaaggcaggaagaagacagtaggctggttaggtaccaagaaacgacacattgctgagttctttttgtgttacatatcccagatttggagctgaagaagtcagcaattcagaaatgcctaaaggacagaaaaaaaaaaaaaggcccaactaaagtccgctttctctagccaaaggaccaagaaagggtcagcccactgagacagaaaacatttagcaataacttcactactccagtcacacattacagaaaagaaaaatctgtggcttcacccacacccatgccaggaagggaatgagtggttagattttggtgacaatcaccaggtggactttcatctctgctgggcagtaacaaggtgcccctttctccctgcagggattgtgtcagaggagaactagtggagagtcaggatttttgccactgccttgtagtaataagaacatctccctccccatggtgtcagtgatgtgtggggagcagggatgaggccccctggtcccctcccagccaggtatcagcagaggcctaatggggagtcagaactcccacccccaccctcacctggtaagaaccaggaaccatctccatcttgaatgtcaatggtggctgatatggttaggcttgtacaaatctcaccttgaattgtaatccccataatccccacgtgtcaagggagagaccaggtggaggtaatttgatcataggggtggtttccccatgctgttcttgtgatagtgagttctcatgagatgtgctggttttataaggggctcttccacctttactcggcactcctccttcccgtgtggccttgtgaagaaagtgcctgcttcctcttcaccttctgccatgattataagtttcctgaggcctcctaagccatgctgaactgagtcagttaaacctcttccctttataaattacacagactaatacactcgcccagtgggaaacctagacttctacccctacctggaagtaactgggcagagcctccacctcgccaaagccaccttgccagaatgatgtgaaaggaagccaactagagcagacagtttaaacaagatccagagtctcaaaacatactccaaatgtcaaggttgcaattaaaatcacataccatgccaagaaccagcaagatctcaacttgaacaaaaaaagacaatcaatagatccatgctgaaatgacagaaatgttaaaaatcatcataaaaatgcttcaacaagcagttgcaaacacccttggaaaaatagaaagtctcaggaaagaagtagaagatagaaagaaggaccaaatggcaattttaaaactaaaaaattcaataaccaaaatagaaagctcaatggttgggctcaacagcagaatggaagggacaaaggaaagaatcaatgaacttgaagataggacaatagaaattatttaatttgaacaacagagagaaaataaacttaaaaaaatgtacagagccttaaggacctctagaactacaaccaaaaatataacactggagtcccagaagaaaaggaggaagaggatgggactggaccaagtactgaaagaaataatggctgaaaacttcccaaatcctgtaaaagacataaaccttcagaatcaaaagctgaatgaatctctaaaatagtataaattcaaagaaatccataccaagacacatcacagtcaaacttgaaaaaaaactaaagttaaaaaaaaaaatgaaaacagtgagaaaataacatcctccctaactacaggggaaaaaattcaagcaacagtggattttgcatcagaaaccatggaggctagaaggaagtggcacaacattttgaaagaaaaagaaaatgaaaatgctgaaagaaaagaactatcaatttaaaattctatacgtggcaaaaatatactttagaaatgaaggggaaatcacgacatcctcagatgaagaaaaactaagaacatttgttgccagcagacctaccctaaaagaaaggctaaagggagctctctaaacaaaatggaaattttaaaaaggggttttgaatataagaaagaatgaatgaaaaatggacagagaaactttacttctccttttgagttttctaaattatgtttgatggttgaagcagaaatcatgatatagtctgatgtgattctaaatgtatacagtggaaatatttaagacaattatattataaatgaaggaaagtaaagggtcacaaagggagccaagatttctatgctttactcaaatgttgacaccagtagactgtgattagttatgtatatataatgtaagacccagagcaacccctaaaaaagctatatacagagataccctcaaaataactatagataaatcaaaatggaattctaagaactgtttgagaaatccaagggaacacaagaaaaaaaaaaagagaaacaaaaaacagaggaacaagcaggaaagaacaaaattaggtggcaggcctaagccataacatatcaataatcactttaaatgtaaatggtttaaatacaccaattaaaagtcagaaattggccgagtggatttaaaacatatgacccaaaactatgtgctgtctacaagaaactcacttcaagtatgaggagatagataggctggaagtaaaaggatgaaaatcatctatcatgtaagcattaatcaaaagaaagcaggattagctatattaatattagataaagtagactcaggcaaataaaataaccagaaatagacattaaatagtgataaaagagtcaatccactaagaagacattgcaatcctaaatatgtatccaccaaacatcagagctgaaaatctgtaaaggaaaaattgatgtagctgaaaggagaaataggaaaattcataactataattagagatttcaatatggctttctcaacaattaatagaacaaccaaatggaaaatcaccaaggatataaaagaactcaacatcatcaaccaataggatctaattgagaaatgtttcaaatcaaatcagctctcatcccaagaacctagaaaaagaagggcaaaataagcccaaagccagcagaagaaagatgagcaaaaatcaatacaattgaaaacaaaaaataatagaatcaatgaaacaaaaaagctggttctttgacaagataaaattgacaaacctcttgcaagagtgacagagagagcggacagaggagagacacaaaatgccaattcaggaatgaaacagaggatgttgctgcagactttgaggacatcaaaaatacagtaagatcatactacaaacaactctacacacataactttgacagcctggatgaaatagatcagtttttctaacagcacaaactgccacaatttaccaaatgcgaaataagtaatttgaatatccctataactactaaggaaatttagtttataaataaaaactttcaaaacagaaatctccaggtccagatggttttactggaacattccaccaaatatttaaataagaattagcactttttttttttcagaaaatagaagaggagagaaaactttgcaattcactttatgaagctaacattaccgttattaaaaccaaagatagtgcaaagaaccgcagactaatagacaccatgaatatagatgcaaaaatccttagcaaaacaatagcacatagaagtcagcaatatataaaaataattatacgtcatgataagtggggcttattctagggattatggctgcttcaatatttgaaaaatcagtcagtgtcattcaccatattaacaggctaaagaataaaaaaatcacatgaccatattaattgatacagaaaaagcatttgacacaattcaacattgattcatactttttaaaaaactctcagaaaattcagaataaaggggaacttcctcaacttgataaagaccatctataaaacatctacagctaacattatacttaatgttgaaagactgttttctttctaagattgagaacaccattattattcaacatagtgctggaagttctaactaaaaataagacataaaagacatgcaatacataagacatgaaaagaaaataaaaagtatacagattgtaatagaaataaaatataactatttgtggatgttatgattatctgtgtagacaaattcaaggaatctaccaaaaaaattgcctagacctaataaataagtttagtgttgtcttaggatagaagataaaaatacaaaatcaattgtatttttataaactagcaatgaacattcggacaacaaaattaaaaatatatatcatttatactaaaaaagtgaaatagacataaatctaacaaaacacttacaggacttgtacgctgaaaactgtaaaccacagaataataccaatgaaagaaatcaaggaagatctaaataaatgggtagatatactatgttcatggatcagaacactcagtatatagagaagacatcaaatttcttataaatatagagaaaagtattctaaaatttatatgggaaggcaaaggaattagaatttctaaaacaattttgaaaaagaagaataaggcaggatgaattagagtactcaatttgaaaacttattgtatagctacaatactccagactgtgtgatattagtggaaggataggcacatagatcaatgaaaaaaaaaatagagaactcagaaatagaccaatacagatatgcccaactaatttttgacaaaggtacaaatcagttcactgtgtgtgggtgtgtggtagtggcaggggtggggcaggcagggaatggccttttcaacaaatggtgctggagctattggacattcactggcaaaaataaacaatcagccttactttaaactgcacaccacttgcaaaaattaatttaaaatggatcacagatttaagtataaaatgtaaaactgtaaaacttttagaaaagtaagagaaaatctttggaatctagggctaggcaaaaagttcttatatttgatatcaaacacataaaaggaaaaatggattaatgtaattcatcaaaactaaatacatttgttccacaagagaccctattaagagattgatgagaaagctatagactgagagaatatatttgtaaaccacatttctgacaaagaactaatctctaggatatacaaagacctctaaaaccccaacagtaaacaacaacaaaacaatccaattagaaagtgggcaaaaaacaccaatagacattttgccaaagaggatacacagatagcaaataaacaaatgaaaagttgttcaacctcattagctgttacggaagtgcaaattaaagccacaatgagatattattacgcgtttatcagaatagctaaaataaaaaatagtgacaccaccaaattctggtgaggatgtgaagaaactcatacattgctggcaggaatactgtacttagcaatataaaggaacaaactactgatgcacataacaacttggatgatgctccagataattatgttgggtgaaaaaaagccaatcccatacatactcctgtatgattttatttatgtaaaatacttgaagaggtaaaattattgaaatgaagaacaggtggctttcaggatttgtgggaggtcaggagggaagtggctgtagctataaatggcacagaagagatccttggtctgtagtttgactgtatcaatgtcaatatcctgcttgtgatattgtaatattgtattacactagttttgcaagagtttaccattgggggaaactggctaaagggcacatgggttctctctctatatcatttcttacagctgtttgtgaatctgtaattatctcaaaaggaaaaatttaattgaaaaacaagagtaaataaatgaaaggaaaaaagataaaaagaatcacagggtgtgataagggctgagatgaaactaaacaggggcatgtgatacagaatgatggagagggggcttcttagagatggtagacagaaaatgcccactgaggaaggggtgacattcacaggtgagaagggaccagctgggcaaaaagcctgggtaaagcttggaaagcagcgagtccagggattccacagggagggaaggcaatgggggaggtaggtttgggaatgagctttgagttttttgaggagtggaaaagagaccgtagggctgggatgtggagagcctgagaaatcaagctcagggtgacatgttatttgaaaaaagatcttgcatgtaaagtacatggaaaggcggggatgtaggcttttcttctagcacagtctgactttgtgcctgtccagccattgcctgtctggctctgctccaccgcatagcatctgtttctggggcccttgggctctagcaaaccccctctctccccagggaagttccctccacacactcagttactggactccaccactcatgcaaggtatttttctttgctcaggcctttagtttgagaatcccctgctctgtcccctgactgggccatcagggttgagccagacttggtcacccttaagatccttggctataaagactagaaattcacgtcaaaactaactcatgcaaaaaaggagaatttatagcaagtaaacatataataactttggttcccaatgaccaaaactcaattcaaactggcttcagggtagaaaaaaatcaaggaaaaaaaataaaaagaaactgagacttccatgattgaaaagttcagggataatggcttcagctcagggatccagccccttttcatggctctgctttcttttgggtcaatttcattctcaggctgggtggtggcaagagggtccccagcaactcctggctcaaatcccaccagcttagcaccacagaagaaagatgagctttgtttcccagtagcttcagccaagtccaggagttgagtctcatgaacctgacttgggtcatgtgcccaccccccaaccaattactgttgccagagaaaagcagcattttcattagccaagccgaggtcatgtgctcacatggatgttggggttggggccagccccacacaaaacaaatggcctgagaagaagggagtgatcccttaacagaattggagtgtggttaccaaaaggaagaatggctactgagcaggcaaaaccaacatactccttactcatggaatccagaaaaagcctacttgttcattctctatcctcgggttctgagtttccatcatgctagtataaagagacatcccaggttgaagtagaatcttcagctttgttgctcaggagagagtatctgattggaccagctttcaccagatggtcagcccttgtcccgtcatctatgaatggtggggggtggtgagtcacatgctggacactttggtggacagggaagctcttagaggggccgggctgatatcctaaaactgtctattacagacagtcagggcttctggaagatctacatcagctccttatcatgaaagaaatgggaactctatcaatgggtttggtgttaagggaaatagatggtccttttgaggatccctttgagaaaggcagagtcctcagattttttccttgctttccttctggggtgctcaggggctgtcaaggggaaaagcagtgggtgcaggcagtgggcttcattgaccatggggaatgcaggggtggtgatgatgtttagaaaccagctgggtgggctggcagcaggggaggcctggagctcccaggcaatgcagggttggaacagcaaaactgagtccctgatttggaggaaaccagttaccaaggcagagactgaagaacagggatccaggagccaggccagaggtaactgaggccaggcaggtaccccactcctggtactaaacgttgaatgcatagtcttgatcagaggaaacaggcaggccatttctaggctggaactggatcagctgagtctcctcgctctaccccacccttcctacctttccaagtgtggataggacaaattctccaggtttgggctgggctcagcatgtacatcaagtgagggctgccaagagtcccagctgtacagaaagttgtggaggagaaagccaagcaggtcattcattataacctcatctctcagggggagagtttacaaaccaagtcatatggaagtgggtaatgaggatgttaatattaatgataataatgacagcaagactttcttgagtgcctactatgtgccagacactattctaagatggtttcagtggatcatctcctttaatccttgtaacaaccctatgaggtagtgctgttgtccattacgatgaacgtgaggaggtgctgggagcagtggcacatacctataatcccagtactttgggaggctgaggcaggaggatcacttgagcccaggaagttgaggctgcagtaagctatgatcgcaccattgcacttcagcctgggcaacagagcgaatccctgtgtttaaaacaaatagtcatgaggaatgtgaaacagaaagggttggcatctttcccagggtcatacatgaacaaaggtaacttaactttcataaaaaatgagcttttagggtgtctgcccccatctccttccccatcaccaactccagctaatcttctcatgcatcctcacttctgctccccaaacctcccacagtttgtagaacattccctgctgtttgatgcctccatgcctttgtacacactattccttctcctggaatgccctttcccccggccaactctcactctccttaccagactgaacataagtgtcgctgtattttgggtaactttccttgatgccagcccccttggacagaatgattcactctcttcttgcctccccataatgaactctgttacatctgcatcacaatgtgcagataattctctgtctcccagactgcgagtggggcagggaccaagtcttatccttctctgtggcagtaactgcttaagtaccagaggaaaaggcagccatgcagggatgaatgaatgtttggtgggtgtgggatttttcctgtcccttgcccaccctcacgatggcatctctctcctgatctcttggcagcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggtcagtgcacagggggttacctctggccaccacggggactctaaagcccacggcctggcctcagtggccaccgggccccagtcaaaaactggaatgaatggtatgacagaggggttatggaggggggaggcagaagaaggcagagtttggacgccactatgtcagaatttctgggatattttaatgttttataggtcatgaggttgccttgggcttatgtgatcaaagcactagaaacccagaagggaaccaagtttgagcatttaccattaggtcctatgcttcttggaaccatgataaagagataaagaagccgaaccaaggtttccttcttgggctctgtcatggcattgagtgaaaagaggacccagctgtgggattggtgatggctgcaggaggaggatggcttctcaatgttgggaactacatgtaatcacccaagtcttcagggtccagctgggattagaggaggtgacaataaacagtgggtgggtagatggatagacagatggctggacaggtgagcgggtggatgggtaggtagatggatggctggatgaatggatggatcaataggagagtgagtggatgggtagatggatagacagatggctggacaggtgagcgggtggatgggtaggtagatggatggctggatgaatggatggatcaataggtgagtgagtggatgggtaggtgatggatggatggatggatggatggatggatggatggattgggtggatagggtggataggtaggtggacggatggacaagtggacagacgggtaggtggatggatggatggataggtgtgttggtggatgggtaggtagatggatggatggatggatggatgagtggtggatgggtaggtgaagggatggatggatggatggatggatggatggatggatggatggcatggaatggtgagtgggtggatgggtagatggatgaatggttggatgaatggattgataagtaagtaggcagaggtatagatgagtaggtatgagtggaaggacagacaggcagaaggctggctggatgaatttcaggagtttagaagctggagatatccttaggcagaactcctcccagacaccttcttctgatgaagccactcagagagagcatcagcagcctgaaaccagaaatttctgagcttttcctccaggggatgagttcattgtttctgctgtatccacctcactctgtactgctctcctggctccacccagaactgctcctatgggccagctaccactaccactctccaacctagtgccaacctacaccctgctagctgctccagtctcttctgggctgtcagggtctgctgccctctttaactcagcctacatccttagagctgctgtgcctatgtttgtggcagggcttgcacaatcacaggctgttactctctctgagctctgtctgcctcccaggcctatcccaatcagtagcagcacctagaggtacccacgaatggccgatctggcctggggtccctatgctcccagtctctcctcttgagagaggggatatagaacagcagccctaggtcagagtcaaccatcataactgccatttatggagcacaagttatgtgccaggccctgtgcccaggaatttcatttcaaccttaagacttcactatgcagttaggactgttagctccattttacagatgaggaaaactgaggctcagagaagttaagacacttatgtaaggttgcacagtgatggaaggggagttgggccccaggtctgcgtggctctttcctagaatgaagaaaatcagagctggcagtgcctcaggatcaggccacccagattcaagaggcagccccaggatttaactcaggcagctgcttgagcccatgcaggtgctgttatgccctggacagatctgctcagtactcacagttcatgaacaggctgggggcttctcacaagtccatgtgactctcagccttgaggaccctctttgaccccagaatctgctttgcccaacacgtggggcttactggaatgcccaggagactgatactgtcaggagttggtgggtgttggtggatgaagacccaccttcccacccttgggtgcaaaacggcctggggcacgctctgccatgggactggtctccaggtgcccttagcagggatcagcctttatcacatcctctgctggctccgtcccttccctgtcgcacttcccttcttccctacccatagttcctgggaccgcctcccctcaagaaaactacctttacccaaatccttatcacagggcctacttctgggggagctgaaggagatgggcattaacacctttcagtggcaggaaggcatcactgcacatcctcagggctcagcagaggacgaggacgaggaaggggacaggaggctgcagggtggggcagcaatgaggagctggactgtctgtggggcccttgggagggtttcagtcagaagagaagcatggcagcgcatggggtgaggagacccacacaggtaccctgactgtaacaggcccctctctcagcctgccactgtgtctttccccagccacatcagcctcctttccatccctcaggcactccaagtgcgtccccaccttgggacctttctacttactgtgccacgggatgcttccgtgaggcctctcctaatcactgggtctaaacacacactccccacaaccttatcctagacactctaacccattgctattttttatgttttggagacagggtctcactctgttgctgtattagtcggttctcatgctgctaataaagacacaactgagactgggtaatttatcaaagaaagaggtttaattgactcacagttcagaagggctggggaggcctcaggaaacttagaagtatggcagaaggggaagcaaacacgtccttcttcacatggcggcagcaaggagaaatgccgagcaaagtggagaaaagccccttataaagccattagatctcatgagaactccctatcatgaggacattattaggggtactgtccccatgattcaattacctcccactggatccctccaatgacagatgaggattatgggaactccaattcaagatgagatttgggtggacacagctaaaccatatcagtcacccagactgagtacagtgacacaagcacagctcactgcagcctcgacctcctgggcttaagtggtcctccctccttggcctcccaagtaacatgtgccaccatgactggctaattttttcatttttagtaaagatgggggccttgctattggttgtcccagatggcttcaaactcctagccgcaagcaatcctctgacctcagcctcccaaaatgctgggattacaggcatgagccactatgcctggcaccatttctattttttcatagcacctgatacaacctgccaggattttctttatttgtttgccagtttgcagactgtgagctctgggatagaagacctatgccgtcttgtttcccactgtggaccaggagcctagaattgggccaggcacctactaggagctcattcagggttttctggtgattgactagactcttgtctttggaggcctcagccctggctccctcatgctcttttatttccatctccaccatcatctcgctgattcagtgccccagcacttccatgccaaagccccaggagagaggatgtgattgctcggtgtaggtcaggtgttcaatctcgggccaggcagcagtggccaggaagatccggctaacctggcatgcggctcatctcgtcccaggctgtggatggtggcaatgcccagcatggcacagggcccgaagtgggcactcagcaagtgtttgcaatagacacataagcagccagatgtccaaagctgccccattagcactgcggtcagttgccacccctgctacggagattcacctccttgggcatctgtgggtaaaacacacctcattttgctgaggcagaagacaagacctctccgtaccccatcaacaagaagctgctgtttgctggtgccccagttccaatggctcctaacagctcagccccaagatgaattcttcccagcatatgtgcagaatatcactttacacattcataacttgaacattatgcagaggttcatcaaattttatttcccttcccctctgaggagagcatttcagcttagccaggctgttctatttcttttccttttttctttttttttttttgtgctttccctacaaagagctcagagcacatagatgtctgcataggtttgcaggatggctcagatgcagggctgacatcttacagtggccagcatccttggagctgcagccaggaactcaagggagggcgatccatggccccacctgcccaggtttccttctcctccacgggggacagagggtgctgtggaaagagcaggggtttggagtgagttttccaaatctatctctttgctgctatgtaatttggggtgaggcgctgagcccctttgagcctgtttcctgtgacccaggatgggagaatccagagctcttggtgtctcagggaggctcaaatttgaaaacccatgtgacatgccgcgccaagtgcctggcacatggagggctttttgtgtgtgagttcctgtcccttctgctcctaatgccctcaccagaccccagagtgaagcatgagcttggtcatgaccagcttaggatggagatggcgagggtatttcgaagcatggctgataatctcgttattatctgtggccctgtataaggctctcctctaaatacctcagatgtgactcagttaatttctgcgatgcctttctatgtgtaagtgttattgtcacctccattttacaggtggcaaatcgaggcacagagagggagggcgacttgccccaggtcacacagctggtaagtgccagagctgggatttaagcccaggccacatagtccttccctgtgctgtgtggcctctcaggcttgatcaattatctctgctgggtattgagctaggacctgggcacacaatgagagtaaagggagtcccatggctgaggagttcatcgcaggaggggcaggtgaggtgagagacagaccgtgagtgggtttctggtatgatgcactctgtgggacagagctcatgggctccctcacgcccccacgtttcctatctgtgggagagggctttctggagcccatttcatccgagtctttcctgctgtcctcctggagaccagcgacaaggtagtgccctgcgggggctgatggacaggaagaaattaaactgtccctttcccacccctacccccaccacccatgtcctgttggattaccctctgcaagagccgactgcatggctgaggagcagttgggcagatttgaaatggtgttcagcgctgtcgaagaaaggcgtattatgtgtgtgtgtgcgcgtctgtgtgcgtgtgcgtatgcatgtgcacatggtcatgtggaaggaccagtatgcacatgtgttgggtttgctggattggagggcctgcaccccccaattcctgccccacccctgagaaacatctggaattaaaccctcccagcgtcaccctgcctgtcgtcccctccttcgtcttaatcgggcctcccaaggggagggtcagatgctgctgaatgaaaggtaaatatttgcagattggggctttcttgaatacttaatgctcagatctggtttaacaatgtgtggaagaaaatcagacctgttggattggatcccagagggaattcagctgtgccaaacaaatgacccgcctcacttgggaacgtggcactgtgtgggggacggaagcccccggagctttttgggagggcagatcttccttcctgggacccctgcacctctctctgtaccacttaggactctctgaaattacttgtttatttattttcgtgtttatgtctggcccatttcggtgcacactccacgagagcagggagcctgcttttcctggttaccactctgtccctgcacctagaaccacagaggcccaatcaattacggtattaattattaacaatattaggccaggctcggtggctcacgcctgtagtcctagcacttgggaggctgatgcaggcagatcacttaagtccaggagctcgagactagcctgggcaacatagcaagaccctgtctctacaaaaaaattaaaagattagctgggtgtggtggcatgtgcctgtggtcccagttactcagggaggctgaggtgggaggatcacttgagtccgggggatcaaggcttcagcgagctatgatggcgccgctgctctcccacctgggctacggaacaagaacctgtcttgaaaaaccaaaccaaaccaaaaaaacattaattctattgttaagtatagtagaaagttatgcagtgcctcctgttgcagacactgtttgagcgcctggctgacttcatgcattcagcccttgtggaacgcctgaagaaatagaccagggttggaattaacttcgcagtttactagctgtgagtccccaggtaactcgcttcacctctccgagcttcaattttcctggctggaaaatgagctaatgcctaccttgaggctttgttgtgaggactttatgaaatgatacaattatgtttctggaaacaaagctggggttcccctctccctgcccccgcccccctcaccccatccctctgttagagacctccctctgtgcagggcaaataagatacactccctgcctgaaaagggggcctgtagcaagcggcaaatggtagtccttggagaatctggcctgcagatgtgttttgtttagcttgcatggtggtttcaaaattcttatttatttatttatttatttatttacttttttgagacactctcgctcagtcacccaggctggagtgcagtggcgtgatctctgctcactgcaagctctgcctcctgggttcacgccgttctcctgcttcagcctcctgagtaactgggactacaggtgcccgccaccacgcccagctaattttttttgtatttttttagtagagacggggtttcaccgtgttacccaggatggtcgtgatctcctgatctcgggatccgccctcctctgcctcccaaagtgctgggattacaggtgtgagccaccgcgcccggcccaaaattcttaaatttgggctgagttttaaaaatcaggagatttcatgttaaaatatcaaggttttgcagaaacagaaaaagaaatatggcattttctcacttataagtgggagctaatcactgggtacacatggacataaagacgggaacaacagacattggggactgcaagagcagggagggaggaaggcaagggttgcaaaaccacctatcaggtactatgttcagggtttgggtgatgggatcaactgaagcccaacctcagcatcatgcaatgcacccatgtaatgaatctgcacatgtacccctgaatctaaaaaaaaaaatacaagaaatcaaaaatcaaggtttttggcttttcatgacaaagcagagatctggccacactgggcccatgttcccgcatggcaacaacaggctgaaacacttgagttcacagccccctgctcacaccacagcaaagtgcaactgggtggcacaatcgagtctcccggaagtggcttcaggcaggaggggccagtcccagtgggaggtataggatagaagaggcttcacagaagagacccctgagctgagtttttcaatactcatgcagcattcaccagacagatcggcagtgggtgaggaaggctatttcaggcacggggaacagaacaagcaaaggccaggaggggccgacacacgaagcacatttaggaaaatctaagcaacttggtgtgatttgagagtgagcgcctcgatgggagttgtgcctgggtctctgatctctcttctcctcccacggtgtctggggttggaggctggtggtagcagctatctgtctatcactgggatgcatttatcttctaaaagagaggagatggagtaggaaccatccaaagcccccttccttgatgccagtgctcactgcactcccagcccaacacaaagccatcagatctcagatctgcaagaaaccagcatggacaaaagtggtttgtgcacagggaaggggtgacctcaacctggctccttacacattcaccggattggctgagcagggatgggcacgtcaaccgcatgccccaatggctcctgttctctctctcctgtttgctgtgggggagccttgtgaagggcctgtctccacatcttcacctcccactcaccgtccagccccctccaatctggctcccaccccctcactccacgaagcagctctcggcagcctggcacggcacccacctgcctcccgaattgctctctcttcggctcccacagccacttctcctggtcctgtgtgccgacgccgtctctggtttcctacagggctgtcttcccttctatgatgtgcagctcctcatcctccatggccacgtggccgagggcccccatattagaagaacccgctccgccccacccgatgccatatgcagttgcttccttggtgtttctacttggattctcaaaggcacctcagatcaatatgtccaagactcattcatgatattcacacccccaaatgcagtcttatttccatctctccctccataagtggctctgcttgtgcaagctggaaacctgcagtcctgacagatgccgctgcttcttcaccacccatgaccctcccgctcaccacaagcccagggccttctctttatgtctccttcctttttctctgcctccacttccatcgtcctagtctgtggctgcaacaggacttacctgggtgaatccagcaactttcttcatgatctttgcacacccatttttgtcccctctaatctactctcaccccagaagctgcaatgcctcctcaatatgctaacgtcatcagggtaacaggacccccatctttctgcctaaaacactggagtggtttcccatggctctcaggacaaagacccaattcctcatcataacttcagagtcccaccgtgtactccgggccccttgccctgcatgcagcatctcctgatcatacacagctccccagcccggccatgttccggcctgtgcagctctgacccactcttctctctgctggagtgctgcctgacaccttccccaccgtctcctccgccaagctgggcagcatcacgcctcaggtatcctcacgtctgttctccctcctggcgtcgtctgggtgctgaaagggacttctgagacaagtcctgtctggaggtttcgtgctgtcggtacggcctttatgggtggagggactccttaggggttgtcaaagatggggatggggttttgggatggggaccaccaccatgccagtgattatttgtattgccaggtaatcattgctaacccatgcgattctagaaataaccaaagtgtaacttcaaggtgttaatatctagaggtctgtttttttttttttaagacagagtcttgttctgtcgccaggctggagtgcagtggcgtgatcttggctcactgcaacctctgcctccccggtttaagcgattttcctgcctcagcctccctagtagctgagattacaggcacatgccaccatgcctggctaatttttttgtatttttagtagagacggggtttcaccttgttggtcaggctggtcttgaactcctgaccttgtgatccactcgcctcggcctcccaaagtgctgggattacaggcgtgagccaccgcgcccggccgaggtctctttttaaaacccagtattggagaaacgggagacaaaactgtaaattacacataaagatcaagctaaggcactgacatgcgcatggctttatctccttctgtgttattttccaaatgttttatatcatgatgatatttactcagaaaatgggaaaagaaaaaaaaaagtccttcttaaa

SEQ ID NO: 1001 - DNA, 752 bp, Homo sapiens
cggccgctgacgcggggcgccagctgccaacttcgcgcgcggagctccccggcggtgcagtcccgtcccggcggcgcgggcggcatgaagactagccgccgcggccgagcgctcctggccgtggccctgaacctgctggcgctgctgttcgccaccaccgctttcctcaccacgcactgctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggtcagt

SEQ ID NO: 1002 - protein, 251 aa, Homo sapiens
  VARIANT (1)...(251): Xaa = Any Amino Acid
RPLTRGASCQLRARSSPAVQSRPGGAGGMKTSRRGRALLAVALNLLALLFATTAFLTTHCWETGDDRFLFRNFHTGIWYSCEEELSGLGEKCRSFIDLAPASEKGVLWLSVVSEVLYILLLVVGFSLMCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERSX

SEQ ID NO: 1003 - DNA, 43800 bp, Mus musculus
catgtgtgtgtgtagaggggttttgggtgggcacattcacagcccagatgtggaggtcagagaacagcctgaggtatcgataggagctagttctctccttctactgtatggggtcctggggtttgaactcgggtcatcaggcttggcagcaagctcttttttctgttggctctcttgaagactataaaagctctctgcagggataagcatgcgcttgctgtagggtgcttgttgagtatgtacaaagtctagagtttgacctccaacactccagttgctgtcttcatgtggagctcttgatgaattctagaaggagtgccaaaagcgaatgaaaatgaaaacttcagtgagtcaacttgatactttcttttcagctgtggtttccttatccatttgcaagtgagttctaagtaaatgagaatgaaaaacccggcttaacttccatctttgggaagatgaccgccacaggtgcaatgtgtttgaagcatgtcatcgtgacatggcagtgaagccctggtttacaaggatagcggtatgtgtctttgtgctgtcaaccatattataatcgttcatacctctgctatggggagcctaccagagatgacctctcagaagcagtttatattgcattctccctcccagcaattgcaagcaaactgaaagtctttatcccagtcagctgggactacactcaagtatttgggttctaagcgtagcacagagtgtccagagcacaggggttttgaaggcagaaacccaagtcctggcatctgtggtgggaacttctcataagcgatttgacagaggctgaggcaagtggttggctggaggggtttctgcacatgcgagcagtttaacagaagctaagataagttagctggggcaacttgaccttggcttcctagaataggattgggtaattttctatgggattctccatcaaggagatcaaattctagataaacccaaaatctctgtacttgcttgccctgtcacacctcaaaaaaaaaaaaaatgctgttaggtcccaaagagtaaagacctttgaaatattcaaacagtgttgctcacctgctcctaacctttgacaaacaccatgcattcagtcctcatgccccgtcccaccccaaccctggatgctttccaacatattactggagagaaaagaacgaggaattatttggaaatttggaatgaattgtctgctgttcccagaggagtgaatcaacttcaagtcagacaaaagggcccctggaggctgctgtagactgaggagtgttggggaggagcccactcctcctcacttctgttcattctaaaagcaatgagatcatctcccatgagagactaagcacaagaagagagtgagcataaggcacggcgtgaaggcgttaacacaggacccgggtggatcacactgtctcagtgcgcctcttgcagatatcgtaatatagggtggagactccagcctccgggctaggtagtctcccagcccccaggtagccgtctgtctgactatgcatggaagggcaactgtagataagagaagccgtgttagagcctccttggggggtgatctgaggctttgattagcttgctctgaattcagcttttcatcagtgttggctgagatgttggaaaaatcattatcacctggcatcttccctggaaataatttctctagtaacttcattacctttcagaaatagtcaagaatgccagggcaggccagactgagggcgagaagagcaaacaggtgggacgcgttcttacacccaggcagcctttctgtttgatcacacaggctatatggcttttaaaggatgtaattagccagacatctatagtcccaggtgcttcagagggttctattccattaatttattgtatgtgtatgtgtgggtgtgtgcatgtacccaggggcccagatgtggatgtcagaggacaatttgcaggagttggctctcttcttccaccatatgggttccaggagctgagttcagattgttaggcacctttacctgctgggccatcttgccaaataattttttattttgagatagagtctcactaaggtgcctgggctggcttagaatgcactctgtagtcctgatttttttttttttctgacagtctcaatatgcctggctagggttttttttcccaaggctataagccagcaccattggacagtagtgaagaagccactgtagcagacctactggagggaactccaccactggccactcaggccctcctaaattaggtaccaaacagacttcagtcatacacaatgccacagccaaaggatcctctggagcagtcagcttaacatcttagaggggggtgatgcctcccaccctcaacttttcctaaggttctggtctaaagtcagccaagagtcagacctggagtgacaggcattagagggagtgtaaatgattcatctctgtttaccaagagcccagatgtaagtgcattcttcaaccccataatcctacttctgggaacctgagcaagctgggatgtcttcagcagttaacatgcagacaatgcatcttagtcttcactgtgtcagggaagttccacttgtcagcaaagtgcttgaagagaatgctggtagcacatgctaattccaggaatgctaggttgcctaaagaccatgacatcagcaagtattcagtgccagaaaaaaacaccatagtgcagcatatataaaaagggggcagagattagtgctgggattaggggcctgtgcctgtaattccagctactcagaagtctaaagcaaaatcaaggcctagtaagatctggggacacatgcctataatactagtacttggaacatcggcaggtagatttctgaatttgaggccagtctggactacagagcaagttccaggacagcaggactaaacagagagagcctgtctccaaaccaaaccttaccaactaatcaaccaaccaaccaaaacaacagcaacaaatcaactaacatctttaggactagagccctggattgtagagatatcacacacacacacacacacacacacacacacctcgtctttttcttccatctcaccaatttttcatagatagtaaccctgatgcatgcattcttttctcttgaggttttatgtttccatttgtgtgtttgtgtgtgtgtgtgtgtgtgtgtgtgtgtgtgcatattttactgactacatgtgtatgcaaaggtcaaggatagtttgccggagtcatttctctccttccaccatgtgggtcccggggatgaaaatcaggtctcaccactccttctttcttccttcttcattctatgcttttaggaatcacatatataggaactgatgagtatgggttagctcattccttttaaggtcacacatgatacaagtatatttttcgttttcatttccttgacagtggaagtgtagactgttcccatctttcctttgttgtgtcaaccttcttggcacgcaagtgggattctccagtggctttcagacaagctcaattcctgaatgagctcttgcaacatcagagacaccaactgtcccccacagtagctaggatgcttctaccccagcacataaccataagtgctggtctcttcttaactcttggcaacagttcatcacttttgtgggtgaaattttatatttttttcttgtttttattttcagtgagtattaaggttaaatttttctcttttcctattcctttttttttaaaatatttatttatgtattttatgtgtatgggtgttttgtctgcatatacatttgcatatcagaagagggcattggatcccataggaatacagttatagatgtcatgagccactatgaggatgctaagaattgaattcaggacttctggaagaacagccagttctttcaaccatggaggtctccagacctctccatatcttttgttatatcagtgtattagtcagggttatctaaaggaacaaaactgatagaatgaacatatatgaatattcatgtatacaggatatatattcacatatatgggaatattcatatatatgggatatttattagagttctttacaggctgtggtccagctagtccaatgatggctgtctccctacagaaaatccaatagttgtccagcccatgatgctggatctcttgtttggtcttcagtatacattgaaatcctgtaatttaatttgttctaatgccggtaaattgtgatcaagggcaaacaggcaaagagcaaagtgtctttcttccatgtcctttatatagactgccacagaaggtgtggcccagattaaagttggatcttcccaactcaaaaaaaaaatctggattaaaggtgggtcttcctacttcaaataatttaattaaaaaaaagcccctcataggtgtatccagctactcggggtttagttaattccagatacagtcaagttggcaacaggaatagccatcacaaccagtaagttgaccttgtgcatctgtttgtgatagagctgtgctgtagctggagagacgctcaggggttaagagcacattcaagctcttgcagaaggacctacatttgctacccagaatccaccttggatggtttacagccaactgcaactccagttccaggacacacatactcagacacacatatacaaaaaaatgaagaacaaatcttttcacaaatagttatacttggtgttttctctaattttgttcttgttcttttggtgccaaggtcattgccctcatagaacgtatcatacagcttctctatcttcatattcttgtgaaacttgcttaatatgatccctacctctccccccatctactttctttccctcccatatcctctccccttccctactctctcctcttctccctgcccacttcagttctcctctgctccttccttctggctgagttcttggaccttggcctgtgcattctgggggctggagcaaagccatccttattatttcaactcattgatacttactgctctgcctttcttcttcagccaagtttcagaatttgcatccttatcaagaaaatatctctttaacttaacctaactttccaaacactttcaccacaagttgtttacactgagtcaagtttgatggtgcaaacctatacccctggagatggagggcagaaagatccccagcagcctgtgtgattgtggcaagtcctgggccaggctcagctaagcactgaaagtctgccctccccccccgccccccatcaaattacccatcagcttcttaggcttcctccgagtgtcactgtgtttgctgtgtcccctttgccatttataatattgtttgtgccattttcttgaagtttatttcacgggtctgtaacagagcaccagcttttggtttccataacttcattttgtacccatttctgcttttctattattatgcccttccttctgctttctctgtttagctgacattttcctgccgattaactgtgtaacttagcccatgataatgtccgttggcttgaattcctggtctgctggaacccaggctgcccggccaccccagctctgaccctcatttcccttctaatttctgtgtcttgggtccgcagactgctctgccagtgtcacacactccctcctgagtgttcagtaatttccatactgcttttcttgttaacctgcatgtatttcccagttaccagataggctatttttctgttttttaaagacagtacgacaaaaacacttttccagaagggccacaaagatggacacagcaagcacctgcgtgcacattgcctcatgcatcacttagcttcagaaaggaaactcaaatgaatacttagaattttaaattttatttttttgcaaataggtgcgtacagtaaaagagaaaaaagaaaaaaaaatcgcctgacttcctggccccttcctcggaagcagctgccctgactgactttaggtgcagtttgcacaagggcttctggcctggcctattgttgacttccagtctcactgtgctgtggctcgcagagtgtgatctgaagattctctggaagtggtcaaagctctgaggcccggtacacagtcagcttctgtacctattccaggaatatctgagaagagcagatgccatcaaagccctttctcaacactccaaacttaaaatcacctcctctctgaccccttccattgtcttctggcaaatgacccacctgctcagtgtgaccttcctcttcagctcaggccttgaccacctacctcagcctcttctctcctcctacttcaacctcctctggtgtctcaccagcacttttttatttttatatgtgagtgaagttttctgactttccttgggagcatttgagctgaaatgttgtcgtgagtggatagtcagtgcttggcatatcaaagtggtaaacacagagccaaaaggagacttcatgtcttcactactggagtgacatgtgtcctgtggggaacctgttctccctagtggaccctagtcatttctcatgtttgttcctattgcaaggtgttggatgtgggctgaagagagccactgaggcaaactgttgagagtatgtagcttattagaagagttattaatgccatggacagacagacatacagcatggaagggctctgaagtgaggcgttaagagcccacacagcagcagcagtaattcttttctgaggacgggcgtggttttacagtacaagcctgcagctttgatctctgattccaactccaatgctctctttaaggtaaattcatgtccctgggtgagaaatcctggcagctggaagtgtgttacactcaaaaggccatgtctcaggaggtgcctgtgctaggtaggggaaggactgctgccaggtgactggatttcaacactgccttctcaggcccactgagccagttcatctcactgaaccctccgactgacttagcctcttcattctctattgccagaactttcctgtggcctgggttgaagagaaatatcccctgtcctctgctttctgtcatagccacagagcatcacttcaaggcagcgccctgcaggggctttacagggagtgagctgcacaggccccaaagggcactttaaggtgactccagattagctttgcctctgggctcagctagcctttgcttctgcggtcatggtgccaaaccttgcctctcttctgcacttatcccgatgttcccgatgtgtgttctaaatcttctagctctgtcctctcaccctcctccctggcatttcctcagcatcactagacagcatcagactcctttatagagaaaatagaaagcatcatggcagaggaaatagaagacattgaggccccaatgtctctattccagctggctactgagttttcaaggcttccctttctacaccgcacttcctaagagaacgctcagctgcccctgcttcgatgcctcactccttttggagtctgttctagattcctggctgccctatggaaatggctgtcctgtacattgttgtctttggggcctctacttctttccttgggccttggcccctgggattgctgctgttcccgggttctatctttgctcctcactttttccatcttagacaagaggaaaacacattgtcatgacaacagaggtgaggctctccccaactccaaacagactctgccaaggcaaaatgctggatatgccagtcttctgtgaggtacccttactttgataacatttatttgtgtgtgtctgtgtgcacatgaggacaacttttgggagtcagtatttctaccatatgggtctagttgaaaaatgagtattttggtgtcacaaaacaaatataccaccagacgaaagttagcagcaaggcagtgcttttctgttaaaacgtgtgccatgcttggtcaacagatcacacgtagccaaaccgtcctgtctcatcttcagttcaaggctgttcctcaaggctgaggttcaaccccacaatctattcctgattggctaagccaaaaagcagtctgagaaggggcagagagttgagggagaatgtagactctcttacaggtttaagcagttcagggaaatcaggtagcagattacacctggttcaacaagtgtattggatgaacaaggaacaaaaaggcttttcaggagctgggagcattagggaaagtgggctttcagcttctaaacctgtctgtaaggaaagaaacgactgcgtctctcagttcaggcttgcgtggcaagtgtcttcacccactgagacatccccttgactttgaatactgacaatggtttgaaaggctttttaagacttcagggcaaaccaactgttcgagcttcccatgagggctgttttcagagtttatacaaagttttttgtcattgatagttcagttaccaagaatttattattcaccccacccccagtggctcacagttcatcttcataaccctgtcctcagtttgatactatggttctttataaatggccaggataaggctagggctggcggagtgctttgtcctagagatgagagagtttgggttcaagaaccaggatttgaccttggccttccacctccagagatgaagcttttaatgacctctgtattgttagtctccctactcagttgaagagctctccagaagataagaagctgtccaagactccaggggtggtgagaggccatgtatgttttcagagattggactgtgcacttcgtacggttgtataattagtcacttttcctgggcgaggctgcatttccagctctgagacgtgcatctggaattctcggaaaggaaaagccttgagcaggcagaagtgatttctttgaagttacccttgtggcaatttcatcaggcctcacaattcttagatgagagtggctaaggcagtaccacaccacacttctcggcggccgtcctagttttccctgcacattagtaaaaagtttctgccccaggtagtaaatgtctccgctgacgtaataagccagatcatgctgaattaaaaatataaaagcaggtttaccgggagcaactctcgggcagtttcaacggtctcagagaacgaggccaaagaagtcgccatgagacccggagaaaaagagcctagcaaaagagaaacagaaggcagagcgacagagaagagagtcctaggatggctggggtggaggccttttctccacaacacgcacctgggtgaagacttaagcagccgctaggtccctgagagcaggccagaggggtcacctgcataggaacaattagttcttttaaatctcttattcaggactggtgtgtgtgtgtgatcgtctcttatgctttttcctctgtgtgtgtgtgtgatcgtctcttatgctttttcctctgtgtgtgtgtgctgcataggaacaattagttcttttaaatctcgtattcaggactggtgtgtgtgtgtgtgtgagatcgtctcttatgctttttcctctgtgtgtgtgtgccagaggtctacgcaagatgtggttcctcggaaggcctccactttgttttttgatacaaggtctctctttgcctgggcagcaagcactttacagattacgctcgcggaccccagaaccggctgttttaactccacttagtagctccatgaaaggtcaccgctcaaccagtagcggcagagccaagtttctagctcaggccacaggaaaacaaaagccattcttcgtctccagtctaaagcctgcagtagttttactacgacacaggccgtgggccgtggatcgtcccgccgtgggttctcctccagcgagcgagaggcgggggcggcggaagccgttccgggaagtacgaaaaccgcgcgggaaaccgcgtagctcagaaggcggctcacaggtgccaaggcgccatagcaacagagcgggcggggaaaacggaagtactccgctggtgagcgggagaatgcgcgtagcccaccagtaggagctccagtctggcgatctctccgccctggaggcgggctccgatatggcttccggcgtgatctcgctggtttgcggtacgtatgaaggctttggggtgctgcggggaccagagcgggcatctgtgggcaacgggatcgaccatggggtcggcgcgggctttggcgctgacgagatattgaagcccgcaaaaggcaggggttggaacagctctataacaacataagttgtttatttgttaatttaaattttaaaaaattgtcttttcgagacatgctctcaccatgtagcctaggctgacctggaactcctgtagctcctgactcccgatcgcctgatgggtcaggcggagaaagtgtgccttgtcactgacactgtttggtgacagccacttgtacccttctgttcaaaacggaccacaccctccccttgcgtgccccgcctccccactccccccccccccctttttgttttgtttgtggagccagcatttgaaagcctgaggctaaatgtgttcagaatcatccgtttgtccgattttggaaaagtataggattcctgtgctctgtgttttgttgcatttcgtactgataaccataaataacacctctaacccagaccaagactggagaagtctagagaaggaacctagatcatggtttgttctgtctgtctgcctatcatctacctacctatctaagcaatctatctaatcatctgtggttatgttttctagacaggttttctctttattgccgtggttgtcctggaattcactctgtaaattaggttggccttgaactcagatctgcctgcctctatctcccatgtgatgagattaaaggtgtacaccaccactgcccagcaaccacggttgggactggcagtgccttaaaagaaactgcttttgcagtactgtccgtcactatcgccatcacttgtgtacctttgtagccccagctccctcctggggaacactgttcctcatgaggttctggtgcgtttcaaaccaggctgtgccatcagcggattaacactgcctagcacaggccacccatgctgtacccaagcattgcttattctgtaaacgccttggttttaaagtcctttgagtgggctgcacctatctatggttaatcctctctgcagagtccctcattgcagatagttgccatcctagccacaaacaagcatggctcctgtgatcggttccacacccattttctgacccctttccccacatcacaccatttgaactttttctgtaccactcttctctaattaatatttaagttgtctttaagtatttttgttttgtaacatacttatgaagataaaatgaacacctcaggtgtagcaccaccagattaagaaacgtattattccatacccccagccccccattgaatctcctctacaaagtttcccactactctgaattctgttttccttgctgttgataggcctcactgagttgctatggccctgccatgatcgctgtgtacagttctttctgtgtttggcatccttgtgaatgtgtgatttgctttttgcatatggtgtggttttgtgtgtttgtggtttgttttgtgacagtttctctttccctggctgacctggaactggcaatggagaccaggctacccttgaactcagatctacttgcctctgcctcagggtgctgggatgaaaggcagccacagtgcccagcttgcatgcagtgtgttctgagcagtacccatgtggatgtgagcagccttgctttctttgtcactgtcctggattccacggtgtgatttgaatccctttatatgactgttacttggttgataaggcatttatagtattgccagacttccattacatgatgtttctatggacacatctcctggggccagtgtggacacttttgtaaggaatgtacataatatgtttctggggtcatgcaagtttgctggaatctgtttcccccagaagaggatgaaagtcacaggccagggagtccaccactgttacctgctgaagattcttcactttctctccgctcctctccccttcccttcttctgtgttctctctcccagatttattttatgcatggatatgtgtgtctgagtatgggtatgtgtgtgaagccctcggagaccttggatcccccgagctgaacttaacaggtagttcttaacatgctcttaacccctgagcaagagtctttctatagcccacactggcctgcaactcactctgtacagagtccagactgacttcagactcattctttctcctgccaaagccttttgagtcctgggaatgctggtatgtgttattgtgaccatgtcagtgtgtctttgattctcttgtgtgatcacatgtagaccagcttttaatgtgttttgtttagccatcacctctcatgctgcttccacatccgctcttctctttatttttctcttcttcttgatccacaggggttctttgtgcgttctgaagaaggctctgtggttagtgtattttaaacaccttccagcatgttgcctcctccccttccttcccctcctttggtatttttggtgaggttctataatgaagtcagccagtactgtgttcttttatgctttgtcctttgtggcttttgtgtcttctaaggacatcctttcctactctagatcttggttacatgtaacgtgatcacgttatcaacatgttttctgtgtgtactgactcaatacttgctttcccccctttcttctgacttccgctgcattgattgacggatgccaatcctggaaccgatggatgacttatggctcgtcctttctttccttctcccctgcttcaacccttcctcgggctgggttcatgaggccctgcacaccagacccggctagaagggattctttataactgcattccttaaatttgagcaaatgggcttgccttactcacctcttggatattggcttctgacttcattgtctcatagtcagtccagcctgtagcctggctctggctgccttgagtcctgttctgcagccagcagggcagacctgaccctccccttcagcttttgctgtcctgctgatcacctctccctgtgttcttagtgtcctatgcacttagcatttcccgtgttttcatctcgtgatccagagggctgcaagcttccccaccccacagtggatttatgtgtgctgcaaccctgataaactaacatgaatgtttgtgagacctcctcataaaggcctaaacatttgaagaagttgtgtgtgcgcgcttgtgtgaccgtttgccactttgtgatgatctttatttctgctaatcctttttttaaaaaaaaccataaagtacattttgactcattaataaaaccacactagctcagtttgcaggatagattgttttttaatccttaaattgggtttcttctttcttttctcttcccctctccttttctccctcccttatcccagggttgaacctagggcctggtgcattctaggtaagctctctgctactgagctctttctcttcattattatcattaatctaattgtggagccagaattcatgttgcctgtcacgcagaggcagaaattgaatccttaagccatgcttattcattgagctggcaatcttggaagacagaactaaaatttaaaaaaagaaacatctgagacaggcatggtaggtagttcatgcctttcatctcagcatgctcaggaaacagaggcaggcagagacaggagtatttatttctatgagtttgaggctagtctagtcttcatggtgagttttaagccaacccggactatatagtgtgactctttctcaaaaaaacaaaaacaaaaaacaaaaaacaaacaaacaaacaaaaacacccaaagatctgctttcctcttctcatcttcagaaagctaatttttagggattgggaaacagaggctgtcagtcactccaaagcatactcttggacctctggtcacgtggtcagcctagcctccaagatcccggatgcttttctggatatcctctgcagagtttttcttgtgtttggagagaaggggaccagagtgtgatctcagttgtgtggctgcgtggcctgcaccatccacccagccccgccctagccccgcccaagccccgcctgcctggcaggagcaggtgtgtgtttatcagctctgatctttgtggtttgcagaaagataagtttttattacatttatttttgtgtctctgtgtgggtgtggctcacctacatcagagcattcatgtagaggtccgaggagaacttgcaagaatcggttctcttccaccatgtcggccgtggagattgaattcaagattgaactttgtggcacttgtctttacctgctaggccatgctggacccaaaagatagctttctgtgagagagcaggggactgtagaaatggcccatagtcctgatacatgttttattggcagctggggagaggggaagctagagtctgttaaggtcgtcttgccagagggtaccttacttttgtagaaagaacacaaggccttggcttagtttctccagggctgttgagctggtaagtggtccagactcagggcacagggtacagactgagaattaccctgtggtgattggcacagctttgctgctttcctcggcactataatgtcacctgtgttaactcactgacttacaggagttcttgggagaacatttctgtcaccattcccactttttaggttagaaactgaataagatggagacttgagtggtccgggtcaccactttgcaagtagttagttaggagggctgagaacctgtgcttatggctccagaacctccagaaccagtgggatggactcgagccgacccagttctttttacttctggagtcatcagcacaagctgaactttggcagccacatgcagtgcgtgtttctgaacatgatggagtacagacccccaccattgctcttgtgtgcacggaggtgacggtgccacctgtttttcagctccctccaacatgcagggcagcacgaggagagcaggagccatgacggatgtgcaccggcgcttcctccagctgctcatgacccacggtgtgctggaggagtgggaggttcggcgtctgcagaaccactgctaccaggtccatgaccgtaagtgctgtgtccctgctcccacagcccctgctgatgatgatcagagagtagcgatgctgggatagcaacaagagaagaatgatctggtagccctgaccggaccattcaagactctgatctcgtctttctctacctccccaaagtgactgccatttagtctgagaagcagaagcccggattctgaatgtgtgaagttacagttcacagcagggctccagcgtgcacttctgtactggtgtccatgtcttcagagtcggaagcgtgactgtaactcacgggatcctgagagttgaggagtgactaggctagcgcaggaagagtgcttgggtgcctgttgttagaaagagggctgtttagcacatgggcagggcacagccttagatccagccagcctggtacgagtgccggctgtgtgccctgtggcctccagtcattggaagggcagtagaagcaatggggtcagtaaggaaagctccttagactcacaggaagccgactgtgtccagcgtccgaatgggagagtttgtaaatgagaagaaaagttgaccctactctacgatgttactgttaggttctgggaaagtgcaaaattactttcctttcttaggaaagtaccagaggggactggaaggttgtgctgtgagctgcagtgctgctggcttttgcatgggagggtgtagaagaggatggccagtgggaatcagacacttcatcttgtgctgtgttcctttctaaagaagaaagctggactgagcacattgtagtattagtcttttctttctttttcttttcttttccctctgtgtagccctgactgtcctaggactctctgtagaccaggctggcctcaaacctagagatgtatgtgcctctgcctccggagtgccaggattaaaggtgtacatccactgcctggctgtgttagtatattcttgactacaggtgttcgcttttgttctgcagttctgtttccctttctgtatttctaattttaacaacgagaacaataacatggcatttaaaaaagtgaaccaaggcaggagtgaggagaggggtatgggtcgagaacttggaggagtggagaagagggaagcgttcagttagagctctatagaggtaagggagggcccatagatataggggtacacggactgaggggggtgggaagaacatagaaacggggttcctccaagacatgcagtggggagagaatgtaagaaggcaacctggagcctgttctccagagcagagggcatgagacactctagcacatcccgggagggaactaattcgcagaagcaatcagaggctgaaggccttgagcagggcggcctactgaagcttgccagtgcttgctggcgctgtttccagatgagaagagcccagcgcacagtgcagacctctgggaggatttgaagcagggaactgtgatcagtgtctgcttggggattgtcctctaggaagcctgtgagctgtctttgcctgaacagcagtggaagaggaacttggttgagagactctttttttgtttttgatttttgttttttgttttgttttgttttttgagacagggtttctctgtatagccctggctgtcctggaactcacgctgtagactgggctggccttgaactcagaaatccgcctgcctctgcctcccgagattaaaggcatgcaccaccacgcccagtggttgagagactctttactgagcaggagggccacacctatcctccctgcttcaagccccatagaacttcatgtctaccactcagcatccttcagagatggcctggtggctgtgagattgtctcttatgctttttcctgtgtgtgtgtgagagagaaagagatgtgtgtgtgagagagagagagcgagaagggggaggggggaatatgaatgcaggtgtacatgtgagagtcagaggacacccctggatgttgcacctctccttccttccaccttgtttaagatggggtctcctgcctaaggttcctggagttctcttgtctctgccccacttccccatatgtgtaatccagtgggattacagatgtgtactcccttccctggctctacttggttgctggggatttgaacccagtcttcatggcttgcacagctaacattttcccagccaagaccatctcttagctatagggcaggttttgttcttccctcttccttttggtttcttgttgacagcacagttttgtggtgctgtcctggagccgtatgatgccttactgctcagaatgaaagaagtttggcctttctttaatctctaagttgctatgacctaatctaggaaagtcctgtagaatttgtctaggaagtgatttatagcagtagctccttgtctgctgggatatgttgtgagactccccgtgcatacctgaaactagggctagtactaaaccccgagtgtcctgcgctttctcctgtccatgcatgcccacagtgaagtctagtgtgtgaaggaagcacaacgggagactcggagactgggcaggagacttagcagccattggtcaagtgagtgtgcacttgtcttcatgccgccatactgcctgccctgttctaacgtgacggccactgactgtgtgcaccctgtctgtctgtctatctgtctgtctgtctctccccccgccccccttcttctttctgggttgtttgagactgggtttctttacgcagtcctggagctcactgtgtcgacaaggctggccttgacctcacagggcttcacctgcttctgcctccagagtggtgggattaagttttgcaccaccacacctggccatgtgcactattttttgtgcttgcatgtgctaaggtaagcagggttatcaaggctgtcgtgtcctatctgccatccaagaattcttgttactagagagattttaaaacaacaaatgatggagctaaatgatacaaaaatcagaaatgcttacaagacccagtcttatttctcttatattccgaagtactgcccagaataatcccttgcacagtgggaccaacactgtaggagacgtgttgtacaaagtagcaactgatctgcaggccatgccctgcctgccacgggtgtagtcatgctcattagaagcactgtttgtcctggtgtatccttggggcccctggggaatgtttattccccattgtccttgacccagaggagttagattttgacctgaactcctggtgcagagccgcctggctcctcagagagaatctggagacttgtgtattttgctaaataccttggattctctgcagggcttatatccctgtgcatgtaccttgttcagtgttactgcctgagactgctctgtgctagggactggtggccttgagtcatgagtcacatcatgtctgtagaattcccttgctggtcacagatacaggcagtttagaaaacagaggttaggagctaagtggaggatttccacattgggtctaggtggagtaatggggacatttccttctccaaacagtccagagagggacagaatgtcagcacaggccagtgaactcctgagagactgactgggatccccaccacacactagacatgttgccttttccattctccagggcaggtgtccagcagttcacttaagtttgaccctgtctttatgagagaagcatcagattccacaagccaaagggtgacagtcccacacactgtcccaattcaggtgctagctgtgagtctcaggtcacatgcacttttgactgtaagtcaagggcttctgtgaccccatcttcctcttagctaattcgctggactgactcagcgctcaggaaagtactttgtatacatttgttaggaagtggggtctctgaccttttgacgttgtgatatgacaacttcatcatctgtggctgtcctgagatgcatgttggctgtgggctggacatgtctgccacaattgtgtaactcatacataggcagatagagaaaatgtgaagggtgggatttgggaggtgagatggtgtggtacttttgagctttttaagtataccaccctcctagaacttggagtgtttttctggggtcccagttttgttcagggggtttatgtcagcatcctgtctgtgattaactcaggccttagtccttcctttccctagtgtttgggggattctgatgctgacactgtctttctggtgaccagctcctaccttgaaactacctagagcttccccattagaacaaaaggtgccctcaccctggaaattccagggcttttaggaaccaggggcagtaaactaaccagtgttgggttaggttactatttgggtggttcttgtatgataggcagcagtggggtgagacttcagctgtcctagctcagctgggcagggtttcagccatggcagactgaccaggttgagctggaggcacatctagaagacttcagaggtacccagtatatcaggagagtctatgtcaccagagaaataagcacttgaaggccagagggtcaggcagcttctggggagactgggaagagctgccccttctaagcttaaccctctgccataattttaaataagaaacataagttgacagcgggctgttgagataactcagtggataaaggtgttttccactaagactgacgacctgagttcagttcccaggacttacatagtggaaggagagaaccaactctgactgctgcaaaaataaacgaatgtgaacggaaaataaaatttaaaatacagatgaagcgctcctaaaccaaatgctgcacagcctggaatctgctgagcaccggcctgacacagtggaaggtcccacactcagtctctcacatacaacattctttaagctgttacgtaaaattatctttagcctgtcattaagtgtataggaatcctgagtaaatttcatatttagactagggtctcgtcccaagatgtcgtgttatataaagtcaggtattccagagtctgagaaagttccacattctcgtctgttataccgattctgccctgactgagcgaactgtgatgagaagggagtgcctatgcccttagtttatgaggcctgcatcactgtgatgtcaaaggcgttgtgaggacagagatcacagaccatggtttacctcgggcattctcaagctgatatgctgattctaacccaaagatgatacagggggatcaagtgggcttatttgaagagtgttgggttagtttagcatttgtcttattttggttttattgccatgaagagacaccatgacctcgacaactcttataaaggaaaacatttaatttgtgtctggcttacagactcagaggtatagtccattattgtcctgggaaacacagcaacatgcagggagacatggtgctagggaaggatctcaaagttctacatcttgatccaaaagcagcagcaggagattgtgtctcaaacggggtgtagcttgactatataagacctcaaagcctgtcttcctccaacaaggccacacctccctatggccatgcattcaaacacatgaatgtatgggggccattcctattcataccaccatagcatttgaagtcagccagtgaggtcatgcagctcagttgatagtgtgcttatctagtacacatgaagcctggattctcgccctggaccacatgagctgggtgcggtgtgcacgcttgtaatctcagcatttaggaggtggatgctggaagatcagaagttcattcttggctacagagacagttcatggccagcctgggatacatgatagaggcaaagaaagttaactcataaaattatgtaattcagcccattaacaaattgggttccaggccaacaccacacactcatataaggttactttaacactttaaatatttaaaaatgtcgtagctgtggaattcagtgtgcatttttacatagagtgtatcagtttggagtagccacagctgaagtgcacagtagctgcatgaggtagctgtagagagttcctcagcttctcgcgtatggagcctcctcctccttagatccaggccactttcaggagtgtgtggaggcctgcaaaactggtgttgggtcttccccactcagatgaggtcagatgaggtgtcaggaggagatgatgtcggataggcttttcctcactaatgtgaccagtgtgtgtcttatgctttagacacattttctttttataaagatttgtttatttattttatgcatatgagtacactattgctcttttcagacacaccggaagagggcatcagatcccattacagatggttatgagccaccatgtggttgctgggaattgaactcaggacccctggaagagcagtcagtgctcttaaccactgagccatctctccagccccctagaaacattttctagtatgtgtgtattgatgagtgtaggttgtcctggagggtgtgcttgtggaggtagagggcaacatctgtgaggtctgttgtgtccttctacctttctctgagttccggggattgaactcgagtcctcccgcttccatggagagtgattcaccaactgagcatctccaaatgggagccatctggaggcaaggtcaatgtccatttggctctctggctcatagttcactagcatttctccctaaattctttaagggctgctagtgccattgacattttgtaactgattttgctttatgttaattattagtaaagtgtaaaagttattttctgaagataaaatatttaaaatttagatataaaaaaattaagggttgggcttagtggtgcatacctttaatcttagcacttgggaggcagaggcagagccagagaggcagagaggcagagaggcagagacagagacagaggcaggtagatctctgagtttgaggccagcacggtctatagagtgagttccagggcagccagggctacatagagaaaccctgtcttgaaaaagcaagcaaacagacagacagacaaacagattggtggctaaagagatggctcaagggttaagaggtcagggatggctgttcttttttttttttttttttttttttctttctaagatagggtctatataacccaggttgttttggaactgactctgtagaccaggctggcctcaaacagagatccacctgcttctgcctcccaagtgttgggattaaaggcgtgcgccaccactcctagcatatggggtggctactctcgcagaggacataggtgttcggttcccatattgtggctcaaaccagtaactccagtctaggagatccagtacccttttctgacctctagcacatgtgatgcacagccatacatacagaccaaagacccctagatactaaataaataaatacatctaaaaaaaattaagattggaaagcattcccgtaagcccagcaaacaagtaccggaactgtgctgtgtaaacagtttggtgaacatggagtctccccagtgttcgcagacgtttccctgctttggccagatttgatggcagcaagctgctgacacacttgcacctctttcctttttctcatgctgagtcacatgtgatgctggcattctagcagtgtcatgttgtgtaaacacatcttcccagagaggtcttagtagcaattagcaacttggtagctccaagtaaagtactcttgtatttttagtgaatttactgtacgcctgtcctccttggctgtgatgagcagtttataagctcacccgagcctgggggtgcttcccctggaaggaatgttagatggggtggagctctgggcacgagccacagaaggtcactgtagtggagttcatcaagaaaactgcagagggaagaggaaagagatcaccctgaaggtggaacacatggagtctgaaaactggtagagccctgtggtatgtggtgccctatagtggtctaagtcagttaacatgctaaaaagacaccccccccccccccccggtttgtatatgcttgtttgtttttagtaaaaacctgctgagtgtgtagctgctgtggcccgtccttttggtgggagactgcgcttacagtggtatctcctgctgtcagctggtgtgtcagccagcattgctctcatgaaacctgagaagaaattccatgttacagatccagcaaggtgaggcgctctggtttcagctgggcctctcctgctgcgctggtggcacagagctgtcacccttgctgcttctgtaaagggtagatggacacccgctttaagcaagagcagttgcagtgggatccatactgacaaggtcaacagtaaaattctgagaaagtggtttgcatgtgacgattcatgttgacattcagaactcaaccaggatgggaaaatggcagtgtggagcagtgctgcacagcagacctctggccagaagagtgtccttgcatggatatactgtgcccatggcgtggcagtgctcagggacattcagcgcacaggcaggaccgttaggtgctctgtagtgaacacatcatcttgtcttgttttggtgcagctgagtagacctgctcactagaatgtcttcgtttgttaagtagtggttgtggcatgcttgaaaatgggcccctgaacaaagaaagcatctaaaacccaagctagcacgctggatctggtggcccatgcagactgagtgaggaccatgagcaatccacgaggagcaagccagtaagcagcacccctccatggcccctatagtagcctctgcttccaggttcctgcctgaatcctgccctgacttcctcagtgatggactgtgatatggaagtgtaagatgacaccccccgccccccgccccagttgctttggtcatggtgttttatcacagcaatagaaagcccaactaagccagttcatctgcttattgcacccttgagtcttatctaccacgtgccaggtcggctacttttctctttcttgacttgactcctgaagatgtcattaggcagttgtgagcccaaggattttttttgaaacattgatacaaggaagaacaaccatagaaggtggaggccagtgcaggcggcccccatcattcatgccgaaccaaaaggatggcccctgtgtgattttgattctctcggatgcacccctacatgtccatcctgggtggtgcttcctgggggtctgctgagaaaaacgagcagtgctgcggtggtctgacgtgctgctgttgagaactgtcaggcgtgttctgtgcttcatgtaaaatgcttctttctcctctcgctgccccgtgcagggcacacagctgcactgtggtcttctcatttttgcacccgcatatccaaaggtcaagatagtcttttctctaaggactgatgagtgatatgctctgaagggggaatccccagggtccccatgtacctctgtgtccttcctgccagcttttcctttgttccagctcagtagttctcagcctgtgggtctcaacgtctttggagatcaaatgaccattttacaggattgcatatcagatatttacattgcgattctgtagttgtgaagtagcaatgaaataagtttatggttggggtcaccacaacatgaggaactgtatataaagggtgcagtgttaggaggcttgagaagcactggtgttaaagggttgcagcacgaggctgagaaccactgctccagctgaggtcagctctgcccagcacttgagtctgtagcagggctctaccttgttagtaaactcagcaggtggccttcttgctgtcacaggacaagtcggctcacaaaggtttggacccctagggctgatttttactctttattttctctgtctaaaaatagcatttcctatctttggtgacttgtttagaacaaaaatacttgttggccagaggttagggcagcagacttcctgactgtctgctgttggggtccagtgtgtagtgaactgtgagccccacagcctatagaagcaggctctgatttatttagcaggaggctctttagtaaaagcacactagattcagttacaaaagggagaaaatacgtctaagccacagaaaagcggactcagtgggctaagctttgagtctgagaggcctgttttgtttagtgggatagcgccgtgtgaagccgggctccaggcgctaactggttctctgtcagacatgtcctgatggaaaagcagcagagcttcttcccgcccttacgggtctttccctttctgcagcccatcttggggtaggaccaggcgatgactgaactgatgtcgtgcatgccaatgtcagccacttggcttccagcaaaccatctccaatttcagcagcccctctggtgacctcatccagggtgctacagttcctgtgctcccctcccgtcccctggcagagccccttttttgtgactgaagtactgtgacagctctgggttgtgctgggggaaggctgtcagcttttctctgctgagggtggatggcttcttgcctgcgctgaggatctggagtttggcagcccagctccatgtccaagttagggaaactctgagacttgtttactctctttaggcagccagtgtaggagggggacattaggaatgcacctggcagggtggttgcaatgacaaatgcatcacaccagtacccagtgtgtccagcaggctgcacgatgcattaattacagtctcatgatcacagcctggaagaaaagcaggtgcctgcatgacaaggagacagccccggggtcagcccagagcctgctcaccttgtggctgagcagaccacacttcatactgccagctgcaggctgctgctgttggggaaagcagtctctgatgggcttgcatgaccctcgatgttggaagtgtgtgccattttctcagtaggttcaggattctgaagagaggttggcgtgagtaatggtaattaactcttaaatctttcacagtaggatttcatgcctggaaatacttgcctttgagtcacatggcacagttcggggcatgtgtagctctgcaggtttgcaaactgtcgctttttggccaagacctcctggagcaataaaggcagaacaatgaccttgatgctgagtggtagcacaagagagaccccagagctggccagcttagcatggagtgggctgggaagcttctggaaggacatggggctgcttggcacctggagccaggcttgggattcctgggtgggtgtccagacatggcaattggtgaccaccatgaggttactgcttgagaactctggagggcagtactggaaactctggctggcttgtcagggccaagcctggccaggaggctgtgaagattagagggcaccacggagagctgtgcaggccatctggagtgactaagagaggctttgaggtcaaaagttacgttggctctcagggatgaaagggaagacgagctcacagagaagcgggtctttgctgctggccctgttgctaccaaatagcaaagcaaatcggagatagtgaaggtgtggggacctgttgagcacgaggtcattggtggaggcagccacatgaatgtggccttcctgggggattgtgtgaaaagagggttgctcgcatcccacccccagaggactcggaaagtacagtataaaagagagtgcctttgatctgcccacagagagcagttttctgaatgatactttgaggtacctctttggtggaaaatatgaattgtccctttcagagggaggtgagactggtttgaacctgttcacaaaggatcttgtcatttacccagtgagaggtagtgatactgaagaaattcaaagtattaaaactagtgttataaatgactcaataatagatttgctttggagaactcaagtcacacaagtggaatttagctaaaggaacactgcctccaaaatattccagagataagtggtctgctaaacaggcccgctgcaataggggcagttgagaatcctaggatgtaaatgtttgcttcgcaggagtgaccagcctttaggttccagtcccataacaaaggagacattactgacttagaaccagcctttaggcccattcccaaagacatacctctaacggcagctcaaagagggcagtgcaggatcacaaccatcagtagtcctgcctgccaggtgggcaagtggacctaggtaacaactattcgaaaagaccagcactgatgtacataagagagagttttggcagtgtctttgctgtgtaagtctcccatctgcccaagaggacagacttgtagtctctacctgtctctctataaattgttctaagtatgacttggggctgggacctaaaagtgattttattaaagaggtcagctatgtaaagtgcacaagcctggggtatagaagttcatctgttcagggccagttcctccttgggcattagccagcgccggacacatcctccttccttcctgagtgtgtaaagtgattcctccctgggaagccatgttgtttctattacagtggctcttgagcacctgagtcccttgtcagaattagtatcagtctttcaaagttggtacctgggacgagaaggggtcctcaccgtgtgtcagccatcttacatgcccagcagagtgtgtcatgggaaaggcccctttgcatcggctctggtgtcagggggccgcagtgggaggtgcgaatgtcagctctgagtcctggcttcctcctcccgcatcattgttttccacttaatagctgatactgatttttcatttaacttggatttattaaacaaagggacaaagagccactgcagcacatgtatgttgctattactgtgaacccatgagtctgggtctttgtttgcccttaatgttgcatgtcttcccctgctaccaatattaccttttgtcttttaagctggctttatttttgttacacagtgttagaaatgcccactttctgtaggaagtgagactgaccctttagatgagtcttctttctagtgcaagccttagtaagcttagtaacataaatggtggcatggtgtctgtttctgtttttgtttttcctgcagtttttttctcagtggttctgttttttgtttttttttctttatttaaaatttttttttgcttgttttttttttgttttgttttgttttttttcatgacagggtttctctgtgtcgccctggctgtccctaaactcagtctgcagaccaggctgcctgttaaactctgaggcctacctgtgcctcccgagtgctggcgttaaaaggcgtgagctaccactgctgggcttcccaaagtaactctaaagtataaatcctttgacattattttaataagtgaaaacaggtatactctggtcttgaaagtatcacactgcagatcggtaattctagtgtatgaagctggccgtatgccttcactgtgttagagcaggttctgtagccgacagaggggctgactctccaagctgggatgtgtaacacatgccctctccctttgcatcctttcctggtctttctcaccagctgttagtatctgttcacccaagccccctgcttctggaccttttcccctcctcagactcatggctctcaaaaaggtccctgttggtggcctcctgatggctggtggcctcctgatggtggcatagcaggagcttccgctagagccaggctcccacagttcacaccgtctctgcctgtgctcagagctgccagggcccgagaagggccagtgggaggacacttgggcaatagctgcttggattatgcttagaacagggcctcttctgctgtgagtgcctcacttaccctgttgtggctcaggcctgggctggcccaaggccttcagatgtgtcctggctagctttctaggaggagggagctgtggagggccactggtgcagcatgaagccttggggaagaggaaggaaggctactgtctcagtggtctgagataacaatcttgtccgcctttctgcctcactacaccatctgtctcagcttatctttgagcactccgggaagaaagaaaccacaatattggcattggcccaagaaagccaaaacatttctgttggggctgctagtgtggtcaggggccagagattgaaacaggctgtgtgtgctttttcgacgaatccactcccatccctgcctgcttatttccaggaaatgcgactgtagataagctggaggacttcatcaacaacatcaacagtgtcctggagtctctgtatattgagataaagaaaggagtcacggaagatgatgggagacccatttatgcactggtatgcgaggcagcgccctctagtggcattttgagaaactggctcagagggctctgcagtggctcgtgcgggacccatgcttctgagagaggggtgagaaagtgatcagctttgtggtggacacgtggcctgatccttatgtggtttatttttaggtgaatcttgctacaacttcagtttccaaaatggctacggattttgcagagaacgagctggatctgtttagaaaggctgtgagtacagtactcattgctaccatatgcagcgtttctaacgggaggaaatagaaacggcaattgtggaggccactgtcatgcttcccagcttcctgggtctcacagggagtgacaggccttaagctacctgtcaaacagagcacctgagaactcgtgggagtgcatgggtcccagtccctggcccagaatgctccaaacccagccctgcactttaatgaggcgctcactggacggtttgtccaagctttgtagcagtgtgctcagcccatgtgccacacacctggctaagacgttctgagtcctgggagcacatagcagctctggggaaggtgggaaaggagcgcccctctccagtttcagcttgactgggcccatcgaggcaggtagactttctagtttaaccattttgtggtgctcctaggctgtctacagtgtgtggagaataaagctaggacaagggccacaacctgtgtgcacattggatacctagcacctgtcgtagggatgtgcctggtgtgggtccatgcagcttctcctaccagggctggctggaggcttaggtgtcgagtttgttattcaaatagatgaataaggcacctctttctcttgcagctggaactgatcgttgactcagaaactggctttgcttcttctacaaacattttgaacctagttgatcaactcaaagggaaaaagatgaggaagaaggaggccgagcaggtgctgcagaagtttgtgcagagcaagtggttgattgaggtaccctggggcctccccgttcactcaggagtgcacagtctgtgtgctagcagttgagcccggcctgtctgtgggcccttctctattgtaagctttccatgacctctgagaggagagcctgtgttccctgactttcacatggtctgtcttaagtgctgcagccacaagtggaagaggctggaatcaatggaaggcttatcagatgcctttcagaatgaagttgctggctgtcccttctgtagacagcttggagctgctgcaagcgttttcttttttgttgtttgtttgttttgttttgtttttttttcaaggcagggtttctctgtgtagccctggctgttctggaacttactctgtagaccgggctggcctcgaactaagaattctgcctgcctctgcctcccaaagaatgctgggattaaaggtgtgtgccaccactgctcagctttttttttttttttttttggctgcaagggtttaatgggagtcctgaaaaaaatctgtgagctgttgtggaggggagcatggaggccctccaccttgccacccatcagcccctcaatcttctcagtcctgtcactgggtatcccttgagttctcgttcaccatgtatctggtgaaggaaggcacaggctcaggcagtaggggtcgcggttgggagagcacctctgggctcctccactttctgggcagggctgctgtgagttctgtaggggccccactgaaggattgttgaccgggttgctggctggtccctgccaagccttcctaggcatctggttccttgatccgagggactcggttttagaggcatctttggcctcagaaatgcagcctccctttgctaaggcttcccacaaggtttcattgctcaagggcttaggtattatgcagctggatggtccactaggaggctctggactggagggtggtaagtcaggcatcagagcttggcccacctttcctcgtagttcaggttggctccctctagtggcatgcagcctcaagagcaggagaaggaggttcaggaagctggccactagtatggacccgggatctttgacaggttcccacagaactgagactagcttgcaagttagccatgctcctgccacatctgaggaggccccacgtccctgtctgcctagcaataaccactgctcaggattcttgtgctctgtgtacaacagcctttctatttctgaactccttgcccactgcccactcttgctcctggaactaatttcactcacttctttagtcaccaggccgcctcataaatgctctgtttccaccctgccacttctgccttggaaaggaagcctgtcttccacaagcatccttccccactggtgggtggggagggaactccagtgtggaagacaacagtatcagggggactatcttgttggactgtctcctcagcctccttctattacagggccacctttgtgtgtggccgtcctgtcagcttccctctgtccacgtcacatgcccaggatcactgagcctccacgctggctcttccagcttcatttgtaaagtggcaggcagggctggcagtgatggggcaacactggtggtaaagggctgggaagtgggcacccggctggggttatcttgggttacccattgggatattgctctcctccctggcctctgtcttctcttgctgacgacaccaactgtgactagcttgtagggtggctgtgaagatggggtcatcatatctgtgaaggcaggggaggttctgagatctggagggtaagaagaccttcgcctccattgtctgacatttagtttccctttctggagatttggctaaggggactttgctgacattggttggctgggattggtgacagtgtgcagtgactagagtatctagacctagtcctcctgcactctgggctgtgggacccggagagtcagcactgagctagcgtgagtgtgttgtatctctgcagaaggagggagagttcaccttgcatggccgggctatcttggagatggagcagttcatccgagagagctacccagattctgtgaagatgtgcaacatctgccacggcctcctcatccaggtactgcaggcagcagtgggagtggggtcctgatgctcagcccactggacctctactgttactatatacttcaggatatagcagctttaggacaggccatgctatactcctgctgctgcactccctagctctctccctggccactcagccgtatcccagggtactgttaggtgctggctgataccttaagccttggtagctctgtggcaggtttttctgtccccaccattctgctgttctgctttgcagggtcccctacgactcagtctggctggatgcctgagtttgcttctttttgattatcttggacaaccaggctccatactgatcttctatatgtgtatccatggggcccatggtatttctatgttcagattctctggcttataacatgcttctcttgatcgtaaagtgtgcgatacatgttgctacttggcctactacaaaactgtatgcctctatctcccaccagggactctctggtcaggggcttgggtttattgccagcattaagttggggcctagaaggttaaaccctccagcctgctagccattttcttgcagctttctgaaggtttgtgaagttgagagatgtgcttgtccatggtcatcaggctttcttgtttcagggtcaaagttgtgagacgtgtggaattaggatgcatttgccttgtgtggccaaatacttccagtccatccctgaaccacactgcccccactgtaatgactactggccccacgatataccaggtacgtggcctccagagtgcttatgggatggggtgaccttgtgatgggctgtctgtgggacctctgttctaagtctgggccccaagagcacccgaggcatgaggaggtctctgagcatgaagatcatcgttagtgacctgctgaagcacaggtgaacactgccttatcctacagggctctaaaatccaatagaccccaaggtttgtgagagccaaacaaggctgtccttatagccacccagggacagggatgggaaagccactccccagctccctcagtgagccatgctgcctggctcacggtgctgtgggaggagggttaacagtgacatgtcctcatgggaaacagctgtagatgtagctgctgtactgtactgtgtgatcaggccattggtcctgctgctcattgtgtgtctctgtgctgttctatacacagaagtctacaaccctgagaaggagagggaagctggcatctccaagtcgagcagaaagtccttacggacccggcagcactagctgtgtcctgcatcgttctgggctgaccctcacagtccatttaggactgccgtgcctcctttgttatttgttcttaacacgtttttagtaaatgtttcctgatggcgctgtgctctgtaatccagggcttgtgtgaggttgggttccccttgctgagttgagtggactggcctgaacggcagccctgggcagatgtctctttggctggctctgggtgccattgcttcgttgcagttttggcccatgatattaaccttagtgtccacagctacaataggcccttactctggccccaagtgcagtagacccctgcaggctgggctggactagatcaggctgtcctcaaaccctgtccatttggcctcacgactgctggccagactggatcccacctctcattcccagctgccgcagctgctctgctcctggcctcagtcccctggacagtcaaatgccgtaccctgccgccgagaccttggtttgatttcagatggttgcattgagttaggactcatggtgagggttctcacctgctcacctcagccttccttccttcctcagctcctcctctttggtccctgggctcacaaccacagtgcccgttgaacttccttgatcactacttgctgcactgtggttccctgcctgcttctactcaccccaatatgtcaggactcatactggctcaaatgaggagggacatgctagcattccttctggaggcttaggctggtggttccgatgatgtcaccaggtcaccccactttttaacctctgttgaactccggcaggaaagcagaacaggtctagaatagccagggcttggagttgggggctctgggttgggagtgtttgagtccctggtcccaggatcctctgcatcctcacagccttcaaggtgaagctcaggggcagtctctcaagccctgccctcaggactacactgggcaaggtggctctgcagtccctgctttgggatggctagctgcctgcttatcctgtgtcacagtggtacagctcaggccatccctgagggtgaccaaggagctctggagatagcagccttcctgccacctgtctccatgcctctacccattctcttatcatggtaccaactagtcagtgtaagcatcccacaggactgacactccccacccaaggtcctcacctttccagatcttagtttgatgttcatcaactacactctgtcctttacagtctgtcttgccttctggtccctctggtgccactgggtgggaatcattgactggaccaggccccttctgcctctccggctcacaaccttcccacttgcaggcctttgtctacctgtggcatctgagactacttggctggcttcactgacagccagtaccgctccagctgcactgttcttcctttcctgggcctggttgtccctcttgggccttgtcctacttcactcctattgatgtggtaaatacccgtgatcaaagggggtctgggaaggagagacttccttcttattacagctttcagcccatccgaagtgcaggaactcaaaggtaggagagaactggaggcagacactgaagcagaggccatgggaggagtgctgctaactggcttgctcagcctgctttcctatacaacccaggagcacctgcccagggttgggacaatgggctgggccttcctacatcaatcagtaatcaaaaaccggccccacagacttgcctctagggcagtctgatggagacatttttctcagctgaggttgttcttcccagatgactagcttgtgtcaagttgacaccataaaagtccaaccaaacaagaacccaaccaggacaggctgctgtctctgctgttgtgagtgggtcctaatgccagtctgaagtcctgttctgtccctcatcattttatccttcatgtctgctacccaggatgtccccagccctccttgttgccctgtcctgtcaccgtgcatgttgcatgcacacctggtcttatttgtcatattttggtcttgctgatacctactccacggtgtgtccaacaccaggagaacaagaagcccatgcagctgggtgccctgtctccagtgtctggcccagggccacagtgtgagcagccctgtgtgctgagtgacgggctggtggatcttcacacttgctcttttcttggctttgaagggcctgttggcactgtgtttccaagccagcttgagaattcacactccagagtaagaggggagtcctgcaggcaggttccagccaccttgggacctgcccataggtagagacctttcatcctcctgcctccccctgatgatggccttctgctgctcagcagtgacccaggagagcatggacctgtcggttgtcacaggtgatgctgtaaagtgtccaggccactgcaggaagccggagccacatagctgatacacctagcagagtgtgccagtgctcgaggccctggggatgtgtggctcctcctcagcttacacaagctgccatgctagctttcctactctgtgcctcacccagcagcaccgggtgagattaactgttaactgtaccagacaggatgccagtctctaaacctactctccgggccttctggctcctcagcctgctgtacatcccctcctgccaaagctagctgtctataaaagggtgcattctgatggtttgccctcccagaccctctctgtgtgaccaagttcagattccttggcctggtcaccttcttgtcatgtggggtgaggcagggctgtgagctaggcctgtcaatcatcagtggtccctgagacctgattcttagtttgaactgaaaggaccagcagctgatattgggggtcaagatatggggagggagatagagtcagagctgttctccccccaccccttccagaaaagggtaaactatgaaaccaagtaggggccagaggtgaagggaggcagggaacaggggcctagtgctgtaaaaaccccaggttttacataagccagctgaaaatgggttttttttttttttcatttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactaacttctggcggaatcaccatgccagacctaaagctttactacagagcaattgtgataaaaactgcatggtactggtatagagacagacaagtagaccaatggaatagaattgaagatccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaaaatgggtttttatccctacaaaggcaggctcattcatcagaaactgaacttgcactctgataaacacctttagttacagcagcctcctgctcactgtgctagttacagcagcctcccgctcactgtgctagttacagccagccccctgctcactgtgctagttacagccagccccctgctcactgtgctagttacagccagccccctgctcactgtgctagttacagcagcctcctgctcactgtgctagttacagccagcctcctgctcactgtgctagttacagcagcctcctgctcactgtgctagttacagccagcctcccgctcactgtgctagttacagccagcctcctgctcactgtgctagttacagccagccccctgctcactgtgctagttacagcagcctcctgctcactgtgctagttacagccagcctcctgctcactgtgctagttacagcagcctcctgctcactgtgctagttacagccagccccctggtcactgtgctagttacagccagcctcccgctcactgtgctagttacagccagccccctgctcactgtgctagttacagccagccccctgctcactgtgctagttacagccagccccctgctcactgtgctagttacagcagcctcctgctcactgtgctagttacagccagcctcctgctcactgtgctagttacagccagcttcctgctcactgtgctagttacagccagccccctgctcactgtgctagttacagccagcctcctgctcactgtgctagttacagccagcctcctgttcactgagctagttacagccagcctccttttcactgtgcaggcccctaggccgtaagactcagatcctgcctggctaccagttcatcaatggtcctgacagactgacctctgattctctgagccagcctcttgtgtgacatgtggctcggcctccttcagcacttcccacagagtccacagatgtgggtgtctcctttccagggtccaggcttctcttcctttcccaatgcctcttttgttgcctgccccacccacagacagcaggggagtctggttaaagaaatgtttctttttgtttgttttttaattaataaaatatattttattgttattgaaaatatttaagttacatatggggcaagtggaccgggccaccagacagaagaactggtaaggttgagcaggctcagactggggaaatctcagaattgagaacagctggagtagagccagctccctgccaaactacctgatctggaacatgacaccccactgagaggacggtgacagtcagtcttgtaacataaaaacctggagttctccatggtaatgtggtatctaagtgggccccgagtgttcagccaatgagcttcccttcctgggcagtccttcccacaagaggtatttactccttgattcaccctgagtaaggtgtgtgcatgcacatccgccatcaactaaaacagtttgaacgtaagaaccatctcttcatcaaggaggcttgggggcaggggcttccttgtaaaaggccgctcctatatattctgggaagacctcgctcttctctgtattccccacattcacaacaaagtagttccgctgccctcctcttccagcctggtgcataagtgccccgaggggaagtatggagccaaggacctctgtttccaactcctagtagtaagctggcagtgaggcctgggtacacagaagactgggaccacagcagctgtcccagacccggctatattccacccaagaaaacccctattacaggttgtgttctgtctctgagcagcttgccagctgcccttgggcacctagcagcaagggatactcagcccagcagttacaaaggaaaaaaagcacccataatctggatagcttaggtacatgtagcagctctgccctacacacgcgggcacacacagcaggtgggccacacgtgggtacatagcagctctgtcacacaacagacattggctgggggcagggctgctggagtctagcggcatgcagggcccacactgacacttggtttactgcctttgggtaaggtgtctgcccagaggtcctttccagtctggtcctagctatgaccaccagaagctgacagagaagctcaggtccagggagcgcacataatgccagtacttagcaggtataaagagggtgtctcctggggacagaatgcaggacaggaatggggcctcagtgaacttgggaaacttctcaaggtcggggttttccacatcaacctgcagaaagcaacagaagtcatctgtggatctgtaaaggcagaaggcgccatgtcaccctgatttcccgtgagcctacctggctggtgttatgaagaatgtgcgtctcgtgagggtacactgcctcagactcttgcggcgaatacaatcggatgtacttccttcctagcacctgggagagaaggcccattagcttcaggtgatgagctgtggtgcccactgactacaggtctgtggacctgtcttccaggcctttctgtggtctgtctgctattgccttgccctatcacaagctctgacgttctgagagtgctcaccttcaggtactttaaagatcagtgttctatgtgtagctaagctcaggccagcattgagtgttgacctggtttaatctcaggggtttcctcttcaccctggctttgaggatttatggcacagaggtaaagtgaattgcccaagctgactaaggtgacagctggtgctatgccaggcagtggactgtccagacctggctcttagctgctactgagctgcacagcagggctggtccagtgctcttcaagaacgccctcatttactaagtttctagcggttgggcccatgacaaggctttacagcagtgagtgtgtgctgattcccttgtgacaaacctgcctgagtctctggaaacatctgtcagtggctgagaggcctgtccgtcagcccttacccataggtgcaagctggcagtaggaataggggaggttggcaggcactagaacgtgctaggcctccacccaagagctctcctatctagcccagcgaaatcccacttggatgcagccttgacctgggagcagccctatcccagggtcacaggactgttttgtttttctgtctatatcccttccactccctttccttctcccactccctcctttttgtgactaggagtcatgtagcccaggcttgccttgaactggctatgtgctgaggatggccttgaaccacccaagtgctacgattttgagtatttaccatcacaagctcctcactcagcccctgtctggcagcagctcctacctggaccaggaagttctgctgggggtcctgatgcagtggggagatggtgccttgtggaccaaaccaggcattgatagtgatctcttcctcttctccattgcccaggcaacagtaatcagggatgctgatgtcccgcttcaactctgggatctgagggtagcggcagaaagcagaggccagggctaggtatgccagccagggcccagctgacatctgactgcttgaaagccaaatatacgcacttccagacgcactttttatttagtttctctttctcatcctctgccttcagcctcccaagtgcagatatagcacacatgtgccatcctacccagctcaggttcatagtcaaataaatacaaatcttaagatagaaataatagagatgaattataatctggcttcatatttgttcctacatcatatggttattttctttttagaaacctgatactgttgctttgtacttttttttttaaagcataatagtgtcatttactaatgaacaatattttcttttgttttgagatgggcttactttgtagctctggctggtctggatctcaccaagtagattagggtggctttgaacttacagaaccccatcttcctctgctggcattaaggcatgagtcaccacaccaggcaagagttaagtcaccaccaccaccaccaccaaaaaccatgacaaaacaaacccagaagacaaaacaaaaaacctcacaggtattgagctagttggtgcacacctgcaatttcagcacctggaaagctgagacgggagcgtgaaaaacatggcgcaggaggtaagcgtgggtgtcaccatgggatcttatttcaaaaacaaacaaccccccaaagtccaatgtactggatatttatcagatctctggaggataattttcaaaaagttactaccattgaggaagtcacaactggtatattttaaataaattactacaaagactggcaaagtaggctttgtactatacttactctgagaagaaaggagtttattgaagagtgttcagaagccagaaaagcgagccttaggagtatagctgagtacatctcccagccaccaggggactaaagcaggcactcagaagcaaattagtgctgtggaagggtttgggtcttactagcaagtagcagaaatggatagtccacaatctccaaccccaggctcctagcataccaatattactgttttgattgaatgggatcaaaccttgcccctggacactgagcataactctgattggttcctgatgatgtcatcaggaattctgaagggtgactggttgggtggatatcaaaatcattggccaaggattcagagaccctcagaaaacacatgctccagagatgtgactattgacaagcccaaggcagtggccagaggcttccaagacaccacactgggagaaaagtcagagcaaggttcctggcaagcactagtcagtagcctaagcttcctacagacacagaggtcctagaacatagcctgtgtcctgtccccaagatacatggctactcaaactcctccgtgaggtgctctgaacagcagataaaaacgagtgctgagggagcagacagcatgatctacctgaaatagccttacactattctgactcaccctaaagataatggcagctttgccttttagccctggtcaaggctccagacgagcaggtaatgccatccccaggatgagccctctgccactgtttcagtgccttaaccagacagctcagaaggattccttatgcagctcagcctctcaagtgcttcgattcaaggtgtgtgcaccacacccaggtacagaccactcaaaatggaaaggcagtctagctgctgatgcagagtctgttttcccacagtgatggtcatacagtcagatgatgggctgggtggcagtgggctaacaccagaaggggcaggcctcgtaatctgctcttaagggcctactctgggagaggaggcagcagtagctgctccattcagaaaacgtgcatttcttttcttttcttttcttttcttttcttctcttctcttctcttctcttctcttctcttctctttctccctccctccctctctctctccctctctctctctccttccctccctccctcccttctttctttctttcttcctttctttctttctttctttctttctttctttctttctttctttctttctttctttctttctttctttctttctttctttctttctttcttttggttttttgagacagggtttctctgtatagccctggctgtcctggaactcactttgtaaaccaggctggcctcgaactcagaaatccacctgcctctgcctccccgagtgctgggattaaaggtgtgcaccaccacgcccggcttgtgcatttatttcttaccctgccagggatctccagggagccttcttgctcatcaggggacttacaggactcatcatttccagattgaatctagagacctggctggccttccaggcctctactgcctggctctcccattcttgtgtataacctcctggctggtgatcctcacactttcctaaagctttagtgctgggctgtttcttttttgttttgttttgatttgtttttcgagacagggtttctctctgtagccctggctgtcctagaactcactctgtggatcaggctggcctcgaactcagaaatcctcctgcctctgcctcccaagtgctgggattaaaggcgtgcgccaccactgcccagctggggtgtttcaaaataagaatattatcccacccaatcctactccagctcagccaagctgcacctttaggtcatccggttccaaactgggcccccagtctcagcatactcagtctcttaagctggcagttccatttgcctcactgctgcctatggtaatcaggaagactctttgctccaaagggtagccccaggatagccatgtgtgcttcctgggagcggaggagcagggcaggaaatgtggtctcagactcacctggtcgaagagctggtgctgagcaaggtacccgacatcctttgcctgacccagaggaggaaagcagaggtgaccgtcggttagtttgtgtcaagc

SEQ ID NO: 1004 - DNA, 960 bp, Mus musculus
ctccgatatggcttccggcgtgatctcgctggtttgcgctccctccaacatgcagggcagcacgaggagagcaggagccatgacggatgtgcaccggcgcttcctccagctgctcatgacccacggtgtgctggaggagtgggaggttcggcgtctgcagaaccactgctaccaggtccatgaccgaaatgcgactgtagataagctggaggacttcatcaacaacatcaacagtgtcctggagtctctgtatattgagataaagaaaggagtcacggaagatgatgggagacccatttatgcactggtgaatcttgctacaacttcagtttccaaaatggctacggattttgcagagaacgagctggatctgtttagaaaggctctggaactgatcgttgactcagaaactggctttgcttcttctacaaacattttgaacctagttgatcaactcaaagggaaaaagatgaggaagaaggaggccgagcaggtgctgcagaagtttgtgcagagcaagtggttgattgagaaggagggagagttcaccttgcatggccgggctatcttggagatggagcagttcatccgagagagctacccagattctgtgaagatgtgcaacatctgccacggcctcctcatccagggtcaaagttgtgagacgtgtggaattaggatgcatttgccttgtgtggccaaatacttccagtccatccctgaaccacactgcccccactgtaatgactactggccccacgatataccagaagtctacaaccctgagaaggagagggaagctggcatctccaagtcgagcagaaagtccttacggacccggcagcactagctgtgtcctgcatcgttctgggctgaccctcacagtccatttaggactgccgtgcctcctttgttatttgttcttaacacgtttttagtaaatgtttcctgatggcgctg

SEQ ID NO: 1005 - protein, 282 aa, Mus musculus
SDMASGVISLVCAPSNMQGSTRRAGAMTDVHRRFLQLLMTHGVLEEWEVRRLQNHCYQVHDRNATVDKLEDFINNINSVLESLYIEIKKGVTEDDGRPIYALVNLATTSVSKMATDFAENELDLFRKALELIVDSETGFASSTNILNLVDQLKGKKMRKKEAEQVLQKFVQSKWLIEKEGEFTLHGRAILEMEQFIRESYPDSVKMCNICHGLLIQGQSCETCGIRMHLPCVAKYFQSIPEPHCPHCNDYWPHDIPEVYNPEKEREAGISKSSRKSLRTRQH

SEQ ID NO: 1006 - DNA, 52510 bp, Homo sapiens
  misc_feature (1)...(52510): n = A,T,C or G
nnnnnnnnnnnnnnnnnnnnnnnnnnnnnnnnnnnnnnnnnnnnnnnnnnnnnnnnnnnnnnnnnnnnnnnntgtccttgaaaacaggaactgtgctgttgtatggtcacgtctatctctgccaccaactcttgtgtgtcaccttgtgccctcttagtctcagtttcctcatctgtaagatggggtcagtgaccctttgctcataaggttgttctggtttgggttaaatgaggtcgggcatgtgaagcactagaattgtgttagcacccgcacgaatggtatgactgagatttacttattccacaaacatttctattttaaaattattaaatttaaataaattgatttaattaatgcatttaattaatttaataataaatttaaacgtatagatgtatttcttaaaatgtgggtgataggaattttaaagatttatataatgcttcaaaagccttcgaaaaggtttttttaattggtttatctgtatatatgaactcttgaaacttatggctaaaacactaggatttatctgcaaggttgcagagagataattctgccttaaattggctaaaacaaaaacaaaaccagccaacctatattatacatgggattaaaaccaatttttctcccattttttttctccttttttcttttgctgcccacattatgccttattttatgagccccagttttctgggcttagttaaaaaaaattcagttctaaacattgaatttagggagtttttgttcttgaataaaaaggcatatacttagaaaaaaaatctgtttatccgggaaaatatattgaaatcatgctgctgagcctctattttctttgatgttttggttctgtattattttatcataactttttagcatttaaaaatttactgatgtacatttaaagccaataaactgttttaattaatttttttaaaaaaagtaatttttttttttctttttgtgacagagtctcgccctgtcgcccaggctagagtgcagtgacgcgatcttggctcactgcaacctccacctcctgggttcaagcgattctcctgccttagccttctgagtagctgggattacaggcgtgcaccaccacgcctggctgatttttgtataaaataaaattatttaagtaggtaatacatgtctatgctaatcccaccattctccctacagtctcttctcatagagacaagggacataatatgcataaacaagcttatggttgtctttcttccactcctacttttcccactccttttccaccaaattatagcattcaatcctatcctgttctcattctcatttacatttattttggctgttatttaacatattcacattattttgttgttgttgttgttgttgagagtggatcttgctatgttgcccaggctggtcttaaactcctggcctcaagcagtcctcccgccttgacctcccaaagtattgagattacaggtgtgaattaccatgcccagcccatcacatttaaaaacattgtatgtaacatacctatacaattgtgtggaagtgtaagtttgaagaacaaaaataaaatgaacactcatgtacctgccaccaagttaagaaatagacattttcagattgccagaccctccactgaatcctttcttccctcctcaaagataaccaccgccctgaatattgtgttacttgttgccttgttttgctttgtagtttttaccatgtatgtgtgtatttctaatgaatgaatgtatgcttttgctgagttttcgattttatgtaataggatcctaaaatatattttgtgtgacttgcttgttgcacttaacattatctttctgagaagtatgcgtgttgatgtgaggagctctactttgtcttcattgctgatttgaattctatgggatgattatattgttttaatgtagttcttcagttggtaggcatttatactgttgccagacttttgttattacaaggtgcttctgtaaaaacatatctcctagggcaaatgtggaagtttctgtaaggtatatacctaatagtagatttcgggggatatgcaaatttgctagtaatatcaactgttatctgaaatggttacaataatttatactcagcctggagtggtggctcacacctgtaatcccagcactttgggaggctgaggtgggtggatcgcttgagtccaggagtatgagaccagctggggcaacaggtgagaccccatctctacaaaaaatacagaaattagccgggcatagtggtgtgtgcctgtagtcatagctgctagggggttctgaggtcagaggatcgattgagcccacaaggtcaaggctgcagtgagctatgactgtgtcacttcattccagcctgggcaacagagtgagaccctgtctcaaaaaaaaaaaaaaaaaaaaaaaaggaaaagaatttatactctcccagcagcagatgaaagtttcagcctcagccattcttttaaaatttttgcctgtctggtggtggctaagacattccttcactgtggttttcataatcatttgtctgataacattgagattgagcatcttttttctgtatttattcatcatttatgcatcctctttttgtaaaatttctgttgcccatttctcttttacagttgtgtttcccatgctgatttgtaggaattccttatatagtctgaatatgaatcttttgtattttgtagcttatgtttgttttaaatgccctccagtttgtatcccctaacccccacctttctggcatttttggtgaatagaggcccttaattttaacaaaagtcaagtttatcagtatattcctttatgacctgtactttttatatctcttaaagaaatccttccctacccttaggtgataaatatattctctatattgcctaaaagtcttacagtatttttccttattatgaccttatcccttcagaattgatgtttgtatatagtatgaggtaagaatcaaattttattcatttttttacatatggataacaagttttcctggcaccttttattggaaagtttgctttcatccgccatcaagtatccatatatgtatacctttccgtttctgagttctctgttctgttccattgattggtcttatttgtctatctctgtaccattaccacactgtactcgttactctagctttataagaagtgctttttttgttttggtttgtttttagacaggatcttactctgtcatcctggctggaatgcagtggtgcaatcatgactcactgtagcctcgacatcccgagctgaagcagtcctcccacctcagtatcatgagtacctgggactacaggtgcataccatcatgcccagcgattttttttttaatttttgtttttagtagagacaaggtttcaccacattgcccaggctggtgttgaactcttgggctcaagcaatctgcccacgtcagcctcccaaagtgctgggattacaggcatgagccatcgcgcccagcaaatatgagaagtctttatagctggtaggacaagtccttctgcctttattttctcccaggaatgtctttgctgttttgcctttgtgttttctatgtaaatttttagaatcatcttgtcaaatcacacacacacatacacaaagcctcttgggatgctgactgtaatagcattgattcaattgcattgggtcaatttggtttttaaagtgattgctgccaacatttcatttttcagtatgatgtttgctgcaggttttttgtagacgtcacttagtagataaaagatgttttcttcgattccaaatttgtttttggtgtaggtacatgttgaattttatcaattgtatattctgcatcattaagatgatcatatgcttttttaaaaaaacttaggtttggcagcacacgtgaaggtttattagataggtaaactcacgtcataggggtttgttgtacagcttttttaatcagccaagaattaagtccagtacccaatagttatattttctgctcttcttcctcctcccaccctccatcctcaaatagaccccagtgtctgttgtttccttccttgtgttcataagttttcatcatttaactcccacttataagtgagaacatgtggtatttggttttctattcctgtgttagcttgcagaggataatagtctccagtttcatccatgttcctgcaaaagacatcatctcattcttctttatggctgcatagtgttccacggtgtataggtaccacattttctttatccagtctgtcattgatgggcatttaggttgattccatgtctttgcttctgtgaatggggctgcagtgaacattcccgtgcatgtgtctttatggtagaatatttctgttcctctggtatatacccaggaatggggttgctgggtcaaatggtagttctgcttttagctctttgaggaattgccacactgctttctacagtggtttaactaatttacactccctccaacagtatataagtttcccttttctctgcaaccttgccagcatctgttattttttgacattttgataatagccattctgactgatgtgagatggtatctcattgtggttttgatttgcatttctctaatgatcagtgatactgagcttttttttcatatgcttgttgaccacatgtatgtcttctttttgaaaaatgttggttcatgtcctttgcccagtttttaatggggttgtttgattttctctcgtaaatagtttgcaaatattttctcccattctgtaggttgtctgtttactctgttgatagtttcttttgctgtgcagaagctcttaagtttaattagatctcatttgtcaatttctgctttcattgtgattgcttttggtgtctttgtcgtgagatctttgcccgttcctgtgtccaggatggtattgcctaggttgtcttccagggattttatagttttaggtcttacatttaagtctttaatccatcttgaattgattcctgtatgtgctgtaaggaaggggtccagcctcagtcttcacatatggctagccacttatactagcaccatttattgaatagggagtctttttcccattgcttctttttgtcatctttgtcaaggatcaggtggtcataggtgtatggccttaattttgggctctctattctgttccattggtgtatgtgcctgtttctgtaccagcaccatgctgtttagccctgtagtgtagtttgaagtcgggtaacgtgatgcctccagctttgttctttttgcttaggattgctttcgctattcaggctctgttttggttccatgtgattttttttttttttttgagatgaagtctcactctgttgctcaggctggagtgcaatggcgtgatcttggctcactgcaacccccgcctcccaggttcaagcgattctcctgcctcagcttcctgagtagctgggattacaggcgcgtgccaccccgcccaaccaatttttgtatttttggtagcgacagagtttcatcatgttggccaggctagcctcttaactcctgacctcaggtgatctgcccgccttggcctcccaaagtgctgggattacaggcatgagccaccgcgctcggccctgtgtgaattttaaaatgctttttcctttattaatgtggtgactcacattgattgatttttagatgtgaaaccattgctggaataaacctaagtgatgatatgtcattccttttacatatctggattaagtttgttagcattttgcttaggacatactgtagctgtgttcatgaaagatactggcttgtaattttcctttcttttgacatccttgttaggtttcagggccaaattaggttagccttgtcagatgggttggggagggtttgctttttttctggcgctgcgattgtgtaacatttgaaattatttgtttttagactatttggtagaacttcttgataaagtcattgggacctgaagttttctttgtgagaagatggattttctataaaatgtcattaatggttataggagtgtttaggttttcagataattcattcattagttttgaataaatttcctatgactttttacatagttaaatttcagattattataaattattgataatatttttaagtatcttaattgcagatatttgtctcatttgcagttaatttccttttttttcaaatattgtttgtttataagttttagctcttggaaaatcttgtcagaagtttttcacttttattatgttttttcaaagaatagttttggttttgttgaccttagatatatgcttattttcagtctttattaatttctgccctttattattttctcattttacctttctttggatttaatttgtagttctttttatagtttcttttttttttttttttttgagacggagtcttgctttgtcacccaggctggagtgcaatggtgccatctcagctcgctgcaacctctgcctcccatgttccagcgattctcatgcctcagcctcccgagtagttgggactataggcacgcaccaccatgcctggctaatttttgtatttttagtagagatggggtttcaccatgttaaccaggctggtctccacctcctgacctcaggtgattgacctgccttggcctctcaaagtgctaggattataggtgtgagccaccacgaccagcccccgcaaccttttttttttttttttttttttttttgagacagggtctcactctgttgcccagcctggagtgcagtggtgtgatcacggttcactgcagcctcgacctcccaggctcaagcaatcttcccacctcagcctcctaaatagctgggactacggaggtgtgccactatgcccagctaatttttgtgttttttgtggagatgggattttgccatgttgctcaagctggttttgaactcctgggctcactgtgcccagcctataaggaactcttataatatagaggtagattttattcattattaatttgataaggttttaaatctggtctaacagtccttgtctttaagctggaacatttagtctatttttattcattgttattactaatctagttggattatttctcctgacttactttgtttttttgtgtttgtttttcctatcctggttttcctttccattattttttctcattacattattcccctttactatttggaaattatatacactatttgtttttttaaaagttgttactctagaaattgtaaaatgcaagtgtaaaatttattcatgtccagcttctactcctgaccatcacaaggctattagaacactaatcccagtgattgctcacctcccatttatgttattatttttgtgtatttagttttttaaaaacctcattctttttactgtggtattaaaaacttttttttaaagatagaagcatttcttctgatttttactgttttatacagttaacttggatttaaccacatatttaccaactttttttgctctttattctaccctgcattttagaccttccaacttgtatccctttctttcttcctgaactatatgctttggaatttcctttagggagcacctgctggtcacttgctctttcagttttttgttgtttggaaatgtttttgtcttatcctcagtcttcagctcgttatagaattctctgttgagacacccgctcccagcatagaagatatgtttccactgtgaccggcttccattgttgccattgtgatggcagccggcagtctacttgttgctctttagaagtcatctgactttttctttgattgtgtttaatctctggtattgtgtggttttattaggatgagcctaggtggatattttagagtttattctgcttgagatttgatgggatcacaatgacagtgattcgtatcatttgtccccactgccaagcctcggtgatacctcatccccttttgtaggatcccttcaggagactgctttctggactctttgcctcccatttctttcctctacacctccatgatgccaaagaggataatctccctaaaacacagctaggcaacaccatgttcctgcttcaagacccttagtttgtagagatccttcatttgcaggatagaagtccattgtttttagcctagcacattctaaccctgtgcccagaacaaccactggcaaatacgggggtgctaagtacatcgacatggaatggccctagtgataggaaataaagttgatgacaggctggatttgaggtttaaggagaggaggaccagagttcgatgctcaggtgtgtggtatgattgtgtggactgcaccgtccacaccagatgatttgcaaagagaaggacttgggagaggaaaggggctaaggaggtggaaggagaggatgagtctaacgtaggctttgttgaggtgcagatttggtgagatggaggatatttttctagcaggcagttggagggactggttatgagatggcgcattttcccagccctgaggtccagttgaggatgctgttaaagaacagcactggctgggcgtggtggctcacactgtaatcccaccactttgggaggctgaggcaggtggatcgcctgaggtcaggagttcgaggccagcctggccaacatggtgaaacccgtctctactaaaaatacgaaaattagtcaggcacggtggtgggcgcctgtagttccagctacttgggaggctgagccaggagaatcactggaacccgggaggcagaggttgtagtgagccgagatcacgccactgcactccagcctgggcaacagagtgagactccatctcagaaaaaaaagaaaaaaaaaagaacaaaagagcagtaattagcagtcttgtggatctcttatgtgccaggtgcttggcaagcctttggtagttgtgactcatttaggcttcctctatgtctttaaggtagctactagtttcccagttttagaggtgaagagactaggccttagggaggctgagcattgttagctaaaaatgtttgcctgctgtatttgcccaaggcaccagtgaacttctttcttgtcagatcttgacatcacctaaaatgaatgtaaacacctcagaattccaggacccattgcagtcagaacatccaggaaagggtttgggaatctgtattgttaaaatgcacattaggaaatccttaggatcaggcagatctgggactttctggtctcagtgcttcctgtttagttccaaattcacattcttagcccctgcactgcgtgctccatggcagtagccagcgttttgatcagggcttgtggaatagttttattaactgtgatctttgtggtttacggaaagatcccattttgttagtgagcaggagatttcgaaaatagtctgaagtcctgccatgatagttgttttattagtggtttggggagaggaggaaactaacatttattaagtgtttactagtagttctctcagtaatgaacttcattataattttatggtgagaaaacggggcctctgctcaatttctccaaggccatagatctggtaaaaaggctcagccaagggttagacccagaattgcctgatagtaaaaatagctcagacttatttagtgcttactgtgttaccaggctattacatgtattaacccatctaatcttcgtagcagttctgcagaggacgtttctatcattagtcccactttacagatcagaaaccaaagcctgtggggactaagttgctcaatctcacacgcctagtaagtgggagagccaggccctgaatcccagcattctagctccagaatccacacctcttaccactgcccagtcctgatgctgtgactcgtgttcttcttctcacctttgtagtaaacagcatgaagaatgacttttaaaaatgatagcaaatttatatttgttaatgtaaattagtacaagacccaggacgttgcttctgatgtgcttggggttgactagtgtcatttacttccttttcagttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgtgagtaccgtttccctgttcccagggcgctctggtgctgtgttgatcagggaccagtgacataggtacaataccatgtaacttgttaaccggtactcctgagctgagcattcaagcctcttcacaatcttacacgggcccatctttctaatttcatcttccacttttattttttttccaagtaaacctgacatttagccctgtggataaaaacttagagtctaaagctgtatagttgtggttcacaccaagcctccaggacctgccccagcctcagtttctgtatctgtaaagtgaggatagtaattgtacttaacacataagtaagtgcatggttcagggaattgagagacatgatatgtacaagacagtggcgcagagacagtgcctagtggggtattgatggacacagggcagcttggctgggtgcggtggctcacgctgttatccctgcactctgggaatcaaggtgggaggatagcttgaggccaggagtttgggaccagcctgggcaatgtagcaagaccctctctatttttttatttgaaaaaaagaaaataaattataaaacaaaaaaatgggggagcttagcacaacacttaagggcacagccttagactgggccggacctgaagagtgtgtccctgccctgtgtcagctgaaggcatttggggcatcttacggggccactgggaggggcaaataagaagcccttggagacaggacatggtgctaagttctaagtaactggagatggtggaagaaacagtaggatcagtgttgatagatcagtcgaattagcattggcagatattgttgagttgtgtgccaatatgggtagatcttactgattagattttatgcagtgacaaaggtgatggatgagtaattgtatgatgtgattatgttgtttttttgtgaagtacaaaatcgttttcattggttatgaatgcatttgcatgtaaaggtataaaagtggaccagaagaagacgcaggacacttgtgaggtgcttgtgaggagaagcagagtgggagtgggctgtcagcagagatcacaggacccttcacttttatcctgttatgttcttttattaaaaagaaaagtcttgaagccaacgtgacattattagcctaacaacatgacattaattagtgtagtctactggttgtcacctctgatgaatgggaatgcaggcgtttggtttttattctgccttattctgcctttctctctgtatttttaattttcaaaagaaaaagataaaaaatgacatagaagtgagccaagccaagaggtatgagaaagggcgtgtacaggtacacagggagcaagtacacaggtgaagggacacaaaaaaaaggcaaaaagatgctttcattcttagtccacaggcatcctgtagctccttgcagtgagctgtgaaagggcgaagggacaccagaaagggtgtccctcctgtccccaaaggcaaacacttcatgagtgcattacatcttcttcccagccacttttatgcctttgcatgcaaatgcattcaaaagtgatgaagatcattttatacttttcaaaatgtgaagggacacgagaaaaggtaggtgtcacatttggagcactgcagtttctgcagcatgttagagttcaaagcctgatcccagagaggtgagcagtgaatgggaataagaagagggagacagaacagaaacgaatattctttcaaggtgtgcaaaggaaggaggaataaaagaaggtggcgtgttagacggagaagaagcagtttgaagtgtctggagagtagcatctgcgttctccagagcactggtccatggaggtgttccatggggaattctgggagctcagtaatgccaggaacaagttagcctgttgaactgtgtttaattctgtgtatccaaacctaattgacctactgataacctaccctgggaatccctagacaagaatatatgatgtgtgggaagagaatacattcttttcgtgtgtaggtttgcagatcatgaagaaccctatacaccatagtaatggctttttacttctgcggacagtgtggccctcttgaagtattcaaagcagagagtgagagagacagttttaggtttgagaaccatctccgtggtgaaggtagatgcgccgcagttgtaccagcagagaaggatctttggtgagagacttttgtattgaaaggggatgttatacctgttaagctagtttctcttgctctttaaaaagcatagtagcggctgggtgtggtggctcacacctgtaatcccagcactttgggaggctgaggagggtgggtcacctgaggtcaggagttcaagaccagcctggtcaacatggtgaaactccatctctactaaaaatacaaaaattagccgggtgtggtggtgcatgcctgtagtcccagctacttgggaggctgaggcaggataattgcttgaacctgggaggcagatgctgcagtgagctgagatcctgcccctgcactccagcttgggcgacagagcgagaccatgtatcaaaaaaaaaaaaaaaaaaaaaaaaagcatggttggactttaaacctacccctcaatatcctccagaaatgtgcataagaacgcttgtcttcagcctgagcaacatggtgaaacccagtctctaccaaaagtacaaaaaattagccaggtgtgctggcacacacctatggtcctagctacccaggaagctgaggcaggaggatcgcttgagcaggggaggtgggggttgcagtgagctgaggttgcaccactgcactccagcctgggcaacacagtgaacccccatctcaaaaaaataaaagaatgcttgtgttaatcctgaatctcttatttacacgacaatttagtccttttctctttttttctcctgtgagtcttgactgtaagctttcatgttggtggggaagtttcacagctcactgcaaggagccacatgatgccttggtactaagactgaaagtgtttttgcctttatttgacctttaaaattgttatgatctaatttaggaaagtcctgtagaatgtgtctaggaattgatttattcttcacactgtgtaccatttctttgcacctagatatggttatggccagggtgaacagggtagaacaatctattttgtcctatcttcatttaagaaaaatgccaaaaaacttgttactgcatgttcttgttattagggagattttaaacaggaaatgacagaaattatctaaacttaagtgaatactcgcaagacccaatattattaatttcctatcttttgaagagatggccaggaaaatccccttgtaccaaatagaaaaatatttagcttctaggaaaattatgaaacaaaggagtgattgaaattgcaagttattctaattgccatttcccagggtgtttgtccagtttatcaaatcacttcttattctaggctttggtttgggttctcttcttactgtcgttaaggggaaacaaagtccccaattctcctggctagtgaagagtttagattttgttctcaagttcagtgcaggccttgggtcgagcctttcggaatggcgctagggacctgtgttcttagaggaccttagatttttgagccaggacttgcatccacacatacgtttattcaaccagcaaagcttccctagaatctcaagtgagccaggcctctgtgctagggactggtgactcagagattgaatttttattttaccatggctctcatgagtcatacagacaaggggtcagatgattccaatataggcctccttgatagaagtcggcacaggaggcctcgggggtggtggagaaggcttgggtttgaggttttccacttttggccagtatggagcaacagggctcagtacaccttcttgcctgaaacaattcaaaaatggacaaagtataaaatactggacattcgtcagtcaaggccagtgatctttcgagagatgggcaatgagggtttctttttctcttgacacttgatgtggtatcttttctaacactactccagttctctagataacaactgggcattccataattcagtttaattctgacactatctgcctggagttagcatcaaatcctacaagttaaagggctcagtgtcacaagactgacccaacttaagacaccagttgtaagtcctgggctacctgtgtttctgaccaatggctgtacatcagtggttcccataactccctctttggatttgataattttctagaatgattcatagaactcaggaaaacactttacttacattttgacttacgtggtttttttataaaggctacaactcaggaacagccacataggagagatcacagggccagctgtgggaagtgggggtggcatggagtttccgtgccctctctacttgcaccaccgtctcaacgcctctgtgtgtttaataacccgaagctcttcaaatcctgtcgttcaagggtttcttttttatttttatttttattttttttgagacagttttgctcttgtcgcccaggctggagtgcaatggcaagatctcggctcactgcaacctctgcctcccaggttcaagcgattctcctgcctcagccgcctgagtagctgggactacaggcgtgagccaccacacccggctaatttttgtggttttagtagagatggggtttcaccatgttggccaggctggtctcgaacttctgacctcaggtgatccgcctgcctccgcctccccaagtgctgggattacaggcatgagccaccgcgcccggctaagttttaaattatttgtagagacgggggtcttcttctgtggcctaggctggtctcgaacacctaggctcaagtgatcatcctgcgtcagccttccaaaatgttgggattcaggcgtgagccactgcacccagcccagtttcaggttttatagggcctgttgattattgaatttggcacactctaagaaaaataatcccacaaaattgtgaatccaccattagaaatgatttgaaatatttatttagccaccgtgcctggccattcctgggtttctatggaggtttctttacacaggcatgattgatcagtcactggccgttgacgagtgcttccatctccagtccctctcttctcctcagatattggggagtggctgaaagttccatgttttttattgaggcttggtcattctggtgaccagcccccatcctaggggcctgccaagagttgcctcattagagcaaaagatgcttctatcacctatatgactcagggaattctaagagttttagaagttctgtaccaggaacctgggggaaagaccaagtaactttcttctgccacaagcgatagtgggagtgagcagtacagctgccccagctcagtgcctttagaaagtttctaggccatggcacaggggaaacccaggcagagctaggcagcctccctgcgttgaggagatggagatgagagttcagggagactaaggcaggtagaggttgcaggacggagtacttacaatggagtataaggtggaccagaggtgcacagagagaaaacttgagatgtccaaagtgcccctccactcaaggatcccgctgagaactgatgagcaagaaaacttcttaaggccagggagagaactagttgaaggattagagaaaacaatgccagctattcacagaactgggaatagtgcccggcccaaacatttgaggaagaactcacaccatttctacccaaactcttctgtaaaattgaagagaatatgttacaactaattctatgagacctgcatgattctgataccataaccagacaaagacattgcgaggaaagaaaaccccaaacaagactcctcatgagcgtagacgttaacgtgctaaacccaactgtggcaaatctaatctaacagtgtttacaaaggatggtacgacataaccaagtagggtttatcctgattttgcagggttgatttagtattaatatttgaaaatcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccaggctggagtgcagtggtgccatctcagctcgctacaacctccgcctcctgggtttaagcagttctcctgcctccgcctcccgagtagctgggattacaggcacgtgccaccacgcccgacgaatttttgttatttttagtagaggtggggtttcaccgtgttggccaggctggtcttgaactcctggcctcaagtgatctccctggcttggcttcccaaagtgctgggattacaggcatgagccaccgcgcctggccctctacacagagtttaaaaaaaaaaaaaaatccaacagctattcctgattaaaaaacaaaaacaaaaacaataccctcagcaaagtgagaaaagaagggaacttccttaacctgataaaggggatctctgtaaaacctacagctaacatcactcttaatggtgaaagactgaatacttttccctaatctcaggagaaagacaagaatgtctgttctcaccacttttgttctagctagtgtactgaggcgagaaaaagaaacaaaaggtagctggattagaaaggacgacacagtaaaactgtcagttcacagacaacatgatcatctgtgtagaaaatctgatggaatctacaaaaaatcttctggaactaataagtgagtttagtaaagttgtaggatacaaaatcaatatccaaataccaattgtttctctatatgctggcaatggataatcagaaatggtaatgtaaaaatagcaccatttataataacattaaaaataagaaatgcttaggaatagatctggcaaaaatgtgttagacccgtacactgaaaactacaaaacattgttgagagaagtcaaaggagatttaaataagtggaaagacatagcatgttcatgggctgggaaattcagtattgttaaggtatcaattctccccaaattgatctatagattcaaagaaatcccagttagatcccagcaaggctttttataaaaattaacaagctgattctgaaattcacatggaaatgtaaaggacctagaagagccaaaactattttgaaaaagacaaacttgaggaaccctgcctgatttcaagacttactgtatggctgtcctatcaagacagtgtggtagtcatgtcatgatggacaaacagatgaagggaaaaaaataagagagctagataacagacccacacataggtggacagctgatttttgacagaagtgcaaaggtaatttagtggaaatagtcttttccaaaatgagtgctggaataattggatatccataatcaaaaaatgaactgcaagccatactttgcaccaaatacaaaaattatctcaaaatgagtcatagacctaaatgtaaaacctgaaactataaaacttccagaagaaaacataggagaaaacctctgtgacctatgattagtccaagatttcttggctccaaaagcatgctccataagagaatgaatcgataaattgaacttcacaattaaaaatttacattaaaaaatactctttagagactgaaaagacaagcaaaatactaagagaaaatatttgcaaataatgtatttaatgaatgacttgtattcagaatatatagagaattctcaaagctcaaaaataagaaaacattcaacccggctgggcgtggtggctcacacctgtaatcccagcactctgggaggctgaagccggtggattgcttgagctcaggagtttgaggccagcctgggcaacatgacaaaactccgtctctacaaaaaaatacaaaaattagtcaggcatggtggcatgcacctgtagtttcagctacttgggaggctgatgtgggagggttgcttgagcctgggaggcagaggttggagtgagctgagattgtgccactgcacttcagcttgggtgacagagggagatcctgtctcaaaaaaagaaaaggaaaaggaaaaacatacaacccagtaagaagtgtgcaaaatatttgaacactgcaaatcggttgtacagatggcagatgagcacatgaaaagatgctcaacatcattagacatttaaaaaatgcaggccaggcatggtggctcacacctgtaatcccagcagtttgggaggccgaggtgggtggatcacgaggtcaggagattgagatcatcctgaccaacagggtgaaaccctgtgtctactaaaaatacaaaaattagccaggcttggtggcgggtgcctgtagtcccagctacttgggaggctgaggcaggagaattgcttgaacccgggaggcggaggttgcagtgagctgagatcacgccactgcactccagcctggggagagagcaacactctgtctcaaaaaaaaaaaaaaaaaaaaaaagcaaactaaaaccgcagtgagctaccactgcatgtgtattaaaatggctaaaatgtaaaaagactctgcaaggcaagtattggtgagaacatggaggaactggaactctaatatactactgttgggaatgtaaaatgggacagccatttaggaaaacagtgtggcaatttcctatgattcagccattcctctcttaggcatttattcaagagatatgaagctatatgcccgcacaaaggcttgtgcagagatagagtatctttatttgtaatggccccaaatgtgaacacctagttgtccatttgcagttgaacagatgaacagactgtgataaatccatactacttagcaataaaagtaagtgagctcttcctacatgctagaatatgaatgaatcagaatgattttgctgagtggaagaagtgaggtgaaagagtataaagcaattttgttttgttttgttttttgtttttttttttttgagacagagtcttgctctgtcgcccaggctggattgcaatggcgcaatctccgctcactgcaacctccacctcccaggttcaagcgattctcctccctcagcctcctgagtagctgggactacaggtgtgtgccaccacgcccggctaatttttttgtatttctggtagagatggggtttcactgtgttagccaggatgatattgatcccctcacctcgtgatctgcccacctcggcctcccaaagtgctgggattacaggtgtgagccactgtgcccggccatatgaaggcatttatgtgaaattctagacaatgcgtacctgactgtaatgacaggatggttcagtggttgcatggggatggcatagaggagggataggatgggtaggtgagagggattacaaagaggcacaaggaaacttggtgagtgtattagtccgttctcgcgctgctaataaagacatacccaaaactgggtaatttataaagggaagaagtttaattgactcaccgttcagcatggctggggaggcctcaggaaacttacagtcatggtggaaggggaagcaaacacatccttcttcacatggtggcaggcaggaaggagaagtgctgagcaaaaggggaaaagacccttataaaactgtcagatctcttgagaactcactcactgtcacaagaatagcatgagggtaactgcccccatgattcaattccctcccaccaggcccctcccatgacatgtttggattatgggaactacaattcaagatgagatttgggtggacacagccaaaccatattgggggtgatggaaatatgtctttgcaatccaatatgtattttacacttagtttagactggccccattttaagtgctcagtagccacatgtgctatttgtagaatgttcctcagcttaggtttgtctggagcttcctcctaattagatctaggagttttaactttgcagatataatatggaagcggtgttgtgttctctctgcatcctaccaggtcggctacggtgttgatggggtcagccaggtttctccagtgtacaattactctttttctatgtgattaataagtatattgcagggaggtacttagagacaaggtaaatatctcattcttggcccggtgcagtagctgatgcctgtaatcccagcagtttgggaggctgcagcaggtggatcactcaagctcaggagtttgagacaaacctgggcaacatggcgaaacactgtatctacataaaataaaaaaattagtcgggcctggtggcatgagcctgtaatcacaggtactcagaggctgaggtgggaggatcccttgaacccgggaggcagaggtggcagtgagccaagatcatgccagtgcactccagctgggtgacagagcaagaccctgttccaaaaaataatcccactcttcatcccatttttacctattagttttaaaatacttccctggattcattcttattttatggttgccagactgctgtgaggtacagttctatactctccagcactaacattttagaactaattacactgtattatcatgtttaatgttaatttttatgaggttttaaattatctattgttttaaggacaagttaggtaaaaatgtctgaagttttagatttaaaaatttaggtttagaaatacttcagtgagcagagtaaataatttgatgtttgggcaaaaaccaggtcgctgaaatacatgtgtcaaaactagatgagtgagtcaagtatcatggtcacgttggggtttgataaagattttctgtttttgtcaactctcttatctgccttcatcccgggtttgtttccagcgtgctgattgacatgcctgtatctgcttcgtcgtctcacgctggactcctgtacatcatcaggctacgtgcgttgatggtgaatcagcgatgttgacattttggtttagtattccatcctgtctgtagtcctatttgtaagcaccttctctttccaaggaagactcagtcataattagaagctggctccaagtacattttccttctgtttttagtgatttcatttatagatctcccctttggcaatgatgaacagttaatcagcataccactgtcagagccggtctgcctttcagttaatcaagggagataaagtctgggatcataactgaaaagtggcaaaaaatgagtatgaaaagtaacatctaacgtgtgactcgatgaatttctcaacatacagaattgacagccggcagttattaagtgcttagacaggaatctttgggttcaagaagctctgtaaccacaaggaaattgatgttgcttttgtgtctctggctcttgctggcctagatgtgtccaagtcctgcccgttcttcatgtctgcagcctgggagtccaggctggactgctccaccgcagccctttcaggccagcatggagttgctgagccaggatttctgtgcgcttcacgctcccctaagcacacacatcatgtgtttgggaatgcattttgaactggatcccagacatgagagaggttatgtgctgatgcgtggaagtactgggaatggattcagtgggattaccacagaccccgctggctggaacagggaagccatttttcaaaggcatgaattcaagtcctgtttcttccagggtctggggaaagttcttttacttttctgagtctcagctttctgtgttataagggacatcacattcatttcatggaagagtcttgaggattaagcaagggaatgtatgttcagcgcctggcacagagtgcttgtgggcacacgttcacttcatgctcaccactgcctcttccttccttttctgccccttaacttgccatctaatcccaattgctgggggtgagtggtggggggtgactatcagaagacccatggtgctggtatgatagtgtgataggaattattttatagaccacagggctgaattctcttggggttttcctagaaaattcacaaagcatggtcaccacttgtaccacacatcttcctcggttcgtggacggatacgtcttgagtgtcagctgaatgttgggctgctgtggtgaataggatgagcagatcccagccttcagggagctggcattctgcttagaaagagaaagaccgtaactcggaggcagacagtgtggtagtttggggtgctaagtgctggaaggaagcattgagtccctcggtagagcgggcctggggtgtggctttggccagggcctctgttcaaacctttctgtggagctgccatatgtggcgatgctcgggtgatgaggggcagccctgcagagatatgcgggagacgctttccaaagggaaggcagcatgagtgaaggggctgagatggggaggagcttggtgtgggggagtgggggacagaaaggcaggtggcaacataggtcaggggatggagccccagacatcttccaggctgagtgctgggacctggctccactcagctgcatgtggaggacagacagatggagaaggctagaggggacaccgggagaatgttggaggctgttgtctgcttcagactgtagtgagtggggaaagggaagggcgtgcgcctgtcagagcgactgcagtcagccgccttcataccagccacttcttagcccctgcttagcccagaatgggcaccaaattgagtcctccacggataaagtgtgaacataaacggagaccaggcagcagaacaggcagcagctgcttatttagagcttgctccagcaagagaggcagcctccacttgggtttagcagagactccaggaaggcagaggagtggggaggcttcaggtgtgcctgagtggaggctgctggccagggcaaggtggagacagctaaccagaagtggggcgtcctatgtgattggttagaagtacatatgtggctttctctggtttgttgtctcttagaaacagggataaaaattagggaagctggcaagcatggtggtacatgcctgtagtcccagctacttgggaggctgaggcgggaggaacacttgaggctaggagtttgagaccagcctgggcaacattgcgagacctcagggtctgcagaagaaacaaagttagctgagcgtagtggctcgtgcttgtagtcccagctactggggagactgaggtggggggatcacttgagcccaggagttcaaggctatagtgagctatgattgcaccactgctctccagcctagatgacagagcgagaccccatctctaaaatataaaataaaatcaattagggtagtatcagttactgatcctgccttggtccttttgggccatgattgtgggttagttttggcttctggactggttgctaggggactggcctggcttcctgcaggtctggcttagaggtggtgggctggctttctgggcaggttgatgtagattttgggttggagttctgcttttatacgtggtctggccattggctgcagcccattggctgtttgtatgttcaatctctcagaagaatgagtgtaacacggtccattcctttgagctgctcacagtccagcctgtgtgagaaatagtaactgcttagctggtgggtcagggaacagagtgacctcattaatcactgtgtctcatgacagcgggtttcctgcccacatcggaattgggagacggtgaacggtcagtggtatataacttacaggcattgtttgtttgcactatagtgtttgtaatttttaagaattaccaggttaaacagaaaacaaccgccaggagattctgtgtaaacacccaaaactcgggcactcggctggagcagagcagtgctgccttctttggtagaatgcgtgccgccagctccctgctgtgcccacagctgtctgcagctgtgcttcctgcctgcctctgtaggcatcagatttgtccattttcagttcgctcagtgcaatctgagcaggaggaaacttacccaacagggatcaggaagaactgctctggtttcaggggctggggtgaccaggaagcctctctcccgtcccctgcagagcccctgtatcagctctgcgagggctcctgcatgggtagggatggggaccagagcgccacagaaggtgtcagagctgccactcatctcaaggatagatggaccacctgttttcagtgggtgtgattagatgaaatgtgtatgaacagcatcagtagcaaaatatatagtagtttatgtttctcatgacgatttccattatgatccagaactttaccgtgataaagcagtgggcactgctttattgccagtgggagtcctgactggtagacctccagccaggggaaggtcccatagatgctgcatagatagggacagcaagtggatgtccccatcaccactcctgcagtggtgtcataggttttagtaccataaatgcatgcagctgagatgcaggtactgtgcccagtaacatgaaataagttttatgctctgtcatttgagtgaggctaaagagcagattttctgattgtaataaacttctgattgtaataaacttcttgagtttaagaagaaaagaactctgtgtacagatctcagaacaataggttttaaaaccatacgttattaaaatcctatttcttctctactgtcagagcactgagctaatctaccttgtcacacaacactcatttttctctttagattgagattcatgagggtcaaggagtcaagttatatgattgttgagcactgaagtatttttacaacattttattatggaaaaagtcaaacagaaaagtggagagactgatacagtgaagccctgtgtgccatcactcagttccgatgatgaacgcaggactgatcttgttttatttatgtttgtacctgcttacccacgttattttgaagtattctcaacatcattgcatgtatatgtaagaatttttttctgatgaatgcccacatcctttcgtgattgcatccagctaatggccagacatctgatttctggtctagactttgtcgcttcctgtcccgtcttaggtatgtccttcatctctctgacctctgagaaagagaagcagcgatcctttctggctcgcctctgcattggttgctgagggtctgctgagaggtgaggagcggcgctgcagcgtgtagtgaatgagctggtgcaccgatggagaggacggtttgtcactaagtgatctaccacagaccagccactctccttccacccggctcttcccagcattgttcactggccatgcttggaagtgcccatggcagttctcatctttgcatctgtgtgcctgaaggtccagagaatctttttccccaggcggttgggggaaagatgagagctacaggctgagaggtgaaatcctgtggcccctcacaaacctccccagccccgtgtcctgcccaccagcccttccttcttcccagcccagggtctgctctcttgggccagctccactcctgcacccccgtctcatccagggcctgccctgccctgtcctcagtgctgtgctagcaggaccgcccgtccaccctgtctgtcgggagggctgtcagagggtaagttggctcacagtggcttgggcccttggagtcttattttttgctgttatttcctctgcctaaaaataacattttatgtttttattgcctagtttagaacaaaactatttgttggtcagaggtcagggcagtagacttcccaatttcctgttgcccaagtgcacagtgaatcctaggttccagtagcctctgggaagcagggaccctgatatagcaagaagaggctcattggtaacattacattccaatgtaacttaatcatttctttcattttttgagagatggcctagctctgtcacccaggctagaatgcagtgatgcgatcatagctcattgcagtctccaactcctgggctcaagctatcctcctgcctcagcctcccaagtagctgagactatagccacatgccaccatgcctggctgatttttaaatttttttgtagagatgagctcttgatccattgctcaggcttgtcttgaactcctggcctcaaatgatcctcctgccttggccttccaaagtactgtgattacaggtgtaagccaccacacctggccttaaaatttaattttaaaagaaaaggagaaactgtatacagaattagtccaaaacaaaatctctcaagatgacttgagccaacccttctccttaggggagaagtgtcctgttttgttcagtgcttgtcacttgcctggaggcccgttttcaattgccaccactgatgggcatttcctgttaaaggaagagtggctctgttcgctccagggtctttgcctttcctcagctgctcctgctgccctgcatgctgtccctgcacgctggacctggcccagtgctcagggctgggccaaggggatgatggatgctggggtgggctgggttgaggggatgatggatgctgggctgagctgggttgaggggatgatggatgctgggctggtctgagctgaggggatgatggatgctgggctgggccaggccgggctgatccaatgcatctcctctgtgagtgcagctcctctttgggtaccacctctggtgtcctaatcaggtgcccagatgccttccatccttccctgttggcccagtctctcttggtgactctgaagcacagggcaggtgcaggagggtatagacgagatgacggtggggtctggtatagaggatgtcctcaggcttgttctgtggagcccatggggcttagtgcctgggagcttaggatctggggttgggcaagcccgggctccatttccttccaagttacggaaactatgagcaagttgttaacctctccaagcctcctgtatatacagatgatactagtgatttcatcttacggagttactgttattgtcatgatgaaatgaaccatgtgaatgcatagtgctggcacataataaggtaatcatagccacacatttgcaggccccttgattttagcctaacatgagctactttactatagcccttaagaaatccagacacaccctgcctcttccaagtagagagaacacagatagcactgtgtttagaggtttagaggttcaacttgcttgatttaaacatgttgctggttgtcctggctagggtatctctttccctctagaggagacatctgtgctagggccagggcctcgttcctctgtcctcatagctgggcctcccatatcactgactggaggttggtggtgtgcagagaaccagcctctgatccagcgctacctacagaaaacctgatgttttgatatttactgaaggttgtgtctttttcttcagttggttctggattctgaaaaggagtggtgttgttaattaactcctaagtcttcaaagtggtatttctaagactgaaagtagttgtctcagaatctcaccatacggactttattccgcactctttatcatgaccatgggctcgtagaatattgaggtcaaaaggatcctcagacatgcctttagcccagtgtatccctacagattggcaaactgtagcttctccaccagggctcctggatcaggggagagaccaggggcagagctgtggacattagctgtcctgaagacctgaggctgggaagcagcgatctggtgcaaccttagcgcttagtggacatcataaggatcttgggagcaagcaagagaccccagttctggtcaacttagaaaggaatgtgtcggggctgggcacggtggctcacgcctgtaatcccaaaacttggggagacaggtgggcagatcacttgaggtcaggagtttgagaccagaccagccaacatagtgaaatcccatctctactaaaaatacaaaaaattagccaggtgtggtggtgaaacacctgtagtcccagtgcctggggaggctgaggcaggaggatcgcttgaacctgggaggtggaggttgctgtgagctgagactgtgccactgcactccagcctgggcaatggagtgacactccatctcaaaaaaaaaaaaaaatgtgtcgggatgctattgggggagggacacataggactcattggtggccaggtgcacagttggggataggcaggaagcatggcatcacctcatggccagagcagctggccctctgtagcttctgggctggagccacctccaagcttccttttgtcccttgctcagattgggagagtgtctggctgataggggttctctgtctactcctggctgccctaatctctggtcccttcagctttctgctttctggttccctgaatatcatacctggaattattctctcaccaaaaccgcaaatgtaagagaaagacaattgtaaaaaaaaaaaaagaaaaaaggcgaaggtctcgttagggagggacatggctgctgggctggcaggtgtcaccagctgactcctgtcttggggcggcggctggacacagtaactggagtgccacgtgatgaggaaggaagtgctgccatgggaggacagagctgggaagtgcagcttatctggttggggaaggcctgtacgggaggctgccagaggatcaggaggctggggtccagccaggggtggtggtagagaagcgggagggaagagggttctggacatgtgtgaggctggaggcgagactgtgtgtggctgttagagatgagaagtgggggagaggctcacgcagggccccacagagcgggagggcaggatgggctagagcccacacctctgcttctggccccatgccaccacgccacctctgttgctgctgaaaggagtcagttgaagggtttgggggtgctgagtgtaagagaagtttcttctcaggtcatgattaagaggagctgcaagggcgcggggcctccgtgagaaacagttacagggtcagcgatggagatcgtggacatgaccctgatgcaggaagcgtgtggaaggaaagagggcgatagcggagagaacgggagcgcccaagcagtggctggtgtgtgcagtgagcgagtacagtaggaggaagtggttggtcagatgaaaatacagcaaaacattcatggtttctgaaaaatgaggctggacgccaaaccagaggtggtgtggagaggggaagggcagagagggctgctggctccctccctgcaacggggtgtctggaaagtccaatagatcagaatgcttctcatctgcccacagggcacattgttctcagtgatacccaggaggggcctcgttagtggaaaatgtgaattgtcactttcagagaggtgggacttgccccagtgtcacactgggtggacagggttcctgtcactcactccgcactgaacgaggctttttgatgtctgggcctcttgcacctgagctgcccagcgttggctccccttgggggtggaaaagtgtgtctggccaagtcactggcacaggcaggtacggaacagctcggctcccacgccagcaaagagctgccttgcatgctgtggaagaggaagacagcaccgggggcagaagagaacatttcctggaaaaacaggccatccaaggtggctgccgcagtggagggagaggagttttcagaaaggaggggcccgtgagcaggggcatggaggcaggaagtcaggccatgcctccctcctgatgcctgctctccagccgccgaggccagatgtcattgtcatatgttacgatctcaccacatccatgttccacccacttactatgactactttttaatttaaactgccttttaaaaacttaactgaaagggaagattagctcctcgctgagcatggcacattagtgtcactgccctgggctttgttctcagcttttctgggccccacagtctgatcctctgacagagctcattggcctgggttttccttgactctttcacacggccacatcctccattgtcaccagcatgatcttctgttgtttttttttttaactttatgaatcttgagttgtacgggtagcttagaaatgcctctgtctaataagaaatcaaacacagacatacagcacgagtgccctgtgatgacccttcgtttagtcccttcctggcgatggccttggtcgtcagtccagtgggtaacctgctgggccttttcctgtgggactgtttcattggttctgtttttgtttcacacatgaatgtatcatattgtccattttttcttgcagttttttttccagaatgattttctaaggcatgaatcttttgaaattatttattttaatacataaaaacagtagtgaaaacaataatacatactcttgctttaaaaagtttcacagcacaagctgggcgtggtggctcacgcctataatcccagcactttgggaagctgaggtgggcggaacacttgaggtcaggagatcgagaccagcctggccaacatggtaaaaccccatctctactaaaaatacaaaaattagctgggtgtggtggtgcatgcctgtaatctcaactcctcgggaggctaaggcaggagaactgcttgaacccgggaggtggaggttgcagtgagccaagactgtgctactgcactccagccagggcgagagcaagactctgtctcaaaaaaaaaaaaaaaaaaaaaaaagtttcacagcataaaagggacacaacgctggccatgtccttccactgcttccagtgctcagaggcttcctggtgccacaggagaaaggccctgctgtccccggccacgggctcctgtcctcaccgcagcctctctgtcctcctcagctgagcccccggcaatagtgtgggtgccccctcctcagactgatggacctggatggtggcccctgggctgtgagcatcctgctggcagggccaggggaggtgggcgacagagaagtcaaagccccggccttgtggtgcaactctgggcgagtcagttcacctctctgcgtctcagcctcttcccctgtgcccagagagctgctggagggtggattcatgacgacaaaaggtgcccaggacagggcctctccatgctgagggctcgctgcaagccacccttctcaccccgtttgttgttattcttactgttccagcccaggacccagcacaagcctggcatgtaagtgaggataacccgacattgaataaaaagagaaaggaataaagctccacctaagatgtgtggggacatacagggacagaggcctctcgcggggcactggggatgcgatagaagggctgagatgggataggatgtttgtgcggcgggagctcacgcaggctctgagcacatcattgagtaatgcgctgaaggtgctgattgggactctcatcaggaggcagcgagcaaagacaggaagcccgcggcagcctccgtggttgcagatagcatctccctggccctcctgcctcacaacgccctccatctgttgtctgtttgtcttccaagtactccaggaagaaagaagccacgtggcattggcgttcacccaagaggctgcagcctccacccatgtctggggttgctgtcccctgcgttgagatgggatggaatgattcaagcaagctacatttttttgatgaggccccctggtcacccccctttttttggtctgtttatttccaggcaatgccaccgtagataagttggaggacttcatcaacaacattaacagtgtcttggagtccttgtatattgagataaagagaggagtcacggaagatgatgggagacccatttatgcgttggtgagtgcccggcagagccctctagtggcatttttgaggagctggaacagggcccaggcagcctgtgtttgctttggtttgatttctcttttggacagttctttgcaaagaagtcactccaaatgtatagaatattaggaataaagggagaaaatggttttttatttagaataagacatagaagctatgaaaagaaactctgtaggagtgtcaaggattgcaggccatgtgggtggggccttcagtggttttcagatttactctcacaggtagggatttgggcctcatccctcctgccgccgactccccgttcacccacgtgatgtgttcaggatgccacagccagaatggcagagccaggagtgaaatacagccagggtgaaatacaggagtgggaagctgacatgccccatccctggctaggagacacctcagctggtcagaggacatctggctgctcccagccaggctcacactcagaaaggggcactctagtccagggttgcccaaactcaattccctggaaaaaaaacattacagagtcaaagaactgtggaaatgctggtcagacatggcaaagcagatttccttgctatcagacttctcagtgctttttttgcatttgaagctccattaacatgcagacaaatctcccaaatttatctgagtttggaaaatactgcacaccctttggagttctgaaacttctgagggcccagcatgttggctgagctaaagaataaagtctgtaatatacgcctggttacagatccatccctgcggcccgcagtgcctggatacaggagctcagtgactggccagagatggaggaggggagggagggagagccagcgacacgttaaccaacacgcaaagagcacagcctgactgtcgtgctgacttatttcttaggtgaatcttgctacaacttcaatttccaaaatggctacggattttgcagagaatgaactggatttgtttagaaaggctgtaagtagagtaatccccattgcccattgggtgggcttcttatgggaaagttctgtctccgtcattagcagtggcaactgcagtgttcaaggatcactggggggacatgggccaccattgctgtctgagaaaaggctttgcagggagatgtcactgtctacccatctggaactcacagctgccagggggtccccatggctgcctgagaaggaagtgctgggccaggtgtgagccccaactggatgggcaagagcagggcttcactggtagtaacaggcgttcctgcctggctgctccaagtgccatctgggaaaggcagcagcagcagcatcgcctgggagcttgttagaaaggcccggtcccagtccccactctagactgctgagtccgaatctgcatttttgccaggtgcccactgaatcatttgcacgtgcacatttgacaggtactgttctaccaggcttcagagctatttgctcagccttctgctcaaacacatggctaagagtggttctcaggcctagatgcaatgataataactgcagaggtgaaaaataattcagacatttcagccccactcacgatctgttgaatccaaatctctgagaaccaggcggtggaatcattccttttagatcttctcctggggattattagccaccaaggttgaggagcaggtgctgagctgagcacacacctgcgtgtgcaggaacctgtcttccccagcggttcctgcctgccgtgtctctctctcactgcctccgaggccagccgtgaggcaaggcgaccctctttgatttggggacattaagatgatttatttgggaggatgttatagaagtgacctctgagtcaaaagaactgagcacagtcctggctcttgatgcacattaaattgttttcccggaataccatgccagtgtacagttctgcctgtgatctgagtggttttactgtgcccctgccagacttggtattaccatttaaaagttatttttgccattttaatagatgagcatgatacctgctctttcttccagctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgaggtactgtctcatggtttttccagcctggttcactttttcaagtgaataacagttttttctccaaaatcgtacttgtagccaactgatgtctgaggagcccggccttctcggatcccttatctgctttcatgcattccagcagtgaccccgtggggaggacttgggcctcactcctcctgcctcccactccccgttcacccagatgatgtgttcaggatgccacagccagaatggcagagccaggagccgcgcccagggacttgggccccaggatcaaggctctagcccacagactgcaaggcagggcagttccgtggctgagagtgtggctctaacatctaacccgggtctgaaccctgagccaggtgacctcatgttccttgtaagaggggagtcgttgtttccccttcggggctgggtgtgtcaggagcgggaatgggacctcacagtaatgtgctcggtgctaggctggctggctcgcgggggaggcggcagaggaattggtgacattaccactgttgtttttgtcagcagtgagttcctcagggccagtgcttagaagaggcatagacctgcttcaggaaaggagctgtgacatctgggacaggccccactgcagctccagtttctagatgttgcccccacccccacgtctagtcctgctgaatggagcagaacaaatgtttcagttctttttccacaaaaggcacccctgttttcaacagctcagtgtttgccgagttgaccacagctgtgcctcccaggtgcttgtgcccatgtgtgttgaggacgcactcacgccgggtccccgcttcctcacttggtggtcggactcgtggccagaggctgctgcttgtggctgcagcgattctccgcttccttttcaggaaggctcgcgtctgggttggggaagtctgtgttctgagttactgatttctatttagggtgggcctgtcccaggaacctgacccgaattcagttcctggggtacctgatgggaagacagggtggagaggtcatggggtgagggcagggctgggagctcctggtgagtgcaggatctgctgggcgcgttcccgtatgtcatgtcttggaggctgtctgctgccctgcagtggctccatagcttagtttttagctgacagctcaggggtctggatgacgtcggacaccctgagagtggcagggccgagttcaggccccggtttggggactgcagctcccatcaatggctttgtcacagttgttcttgccctccaggctgtatttggcactagggaatgttctagggctactcaggttataactgaccattctcgcttgtggtgcagcccctcttcaggccaattttttttttttttttaagatggagttttgctcttgttgcccaggctggagtgcaatggtgcaatcttggctcaccgcaacctcaacctcccggattcaagcgattctcctgcctcagcctcccaagtagctggaatcacaagcatgcgccatcacacccggctaatttttctatttttagtagagacggggttcctccatgttgaccaggctggtctcgaactcctgacctcaggtgatccgcctgcctcagcctcccaaagtgctgggatgacaggcgtgagccagcgtgcccggccacaggccaagttttttaagggtaggggttatgacctcttcatggctggtccccattgcagaatgtagtgcctggcacctcaactgctcaataaatgcttgctgaatggatgactggacaggtggatgaggttgcagaggaacagcatttaaaacttacaaaaaatgttacaggaaatatctgctcattacaggaggattagaacatgttgagatgcataaagaaacccactgaagtcacctgttatcccagaccctagagccgagtgccccaacatcccagtacacaacactttgcaccctgctttgcacccaagagcaccatgcctagcacatgctgccaccattgtgcatggcttgcagggcgtgcccccagctttatggtttgacttgccctttgtctgcccttggtgtctggagagggcggtggtggataggagaggccccgccctggagtctgtggcggtgagctgtggctgcaggcgcttgtactctgtgcctttctcagttcggtggcagtgctggcaccaccttctgcagggcgcctctgagctcgagggagggtggacagaggatccgggagctgccacctgcaggagcgctgcagaagtagcagggggccctcagcactggcgctgggcagtagccctagagaggcttcttgttgactgcctggcctgctggggccctcaggaggacgaaggaacgaagctaatgtggcaggggctgtgtggtgagactcctccaggttcctccgctgcctgtggtgagcagcttctcgttgcggagactgtttcctcatctgcaggatggggacattgccagctccaggtgttttctgtgagggtccagtgctctctgacctacatggcctggtaagggttgccttgaggtctgcggcactctggaggaatcactgagaaccggggcgggtgctcacttacccaggacaggtcttcctagggcagcacctcgatcagagagaccacatgtcagtgtctgatccttggcctctcagacacagggcttcccacagaaatagccaggggcccactgacaaggcccttccaggtgggtatatcaccccaaggacacgtcactcctggacagccagtcctgtgtgagactggcccggcatggaggtgctgaggcagctgtccgtccaggagaaggcccaggggtggtaggtggttggggtcagcggggaggcctctgagagcaagcgcggctcatgggagctgggcgtctgctgatcggcgcacctccatacaccccaggactgctccctacacgaggtcctgacttccaagtgttgtggcgaggcgcctgggagatcacctgggctgtcgtcgtctttgagggctagggcatccctcctgcccctcccctgatgggccctcagaggactgagtgggtcatgaatggtgagccttgggtgcagtttcaggcacatagcaggtgttcagtaaatgcagcttggctgggtgcagtggctcaaacctgtaattccagcattttgggaggccaaggcgggtagatcacttgaagtcaggagtttgagaccagcctggccgatatggtgaaaccctgtctctactaaaaatataaaaaagttagctgggtgtggtggcgggcatctgtaatcccaggtactcgggaagctgaggcagaagaatcgcttgaaccctggaagcagaggttgcagtgagctgagatcgtgccattgcatgatctagcctgggcaacaagagcgaaactctgtctcaaataaataaataaaaaataaatgcagctcctgcctcagtctgagcttgaacttgcttagtgtcaggcattcctttgggatcagtgcaaggtctacttcatcttcccgtgggtgtttatcacaggcctgccaagtgctgggccccacagcaggtgctgcggacacaggagtgagcacagccagagctggtggccgctcccatggggccatggtctggagggggagcccgagatcagtgagacggtcatctcactgcagtcctggtacagatggaaaggaaacatggctttatgacagctgtcccagaggaaccggccctcagctgctgaggaagtgacacttgagctgaaggctgtgtgggagttgcctggagcctggggtgggaggatcatcagcccggcagtggccctgtggccagcaggtgcactcaagaagctaaggccagggccatctgagcacaaagattgcgaggcgagcagacggagggcagcccgggagatacgcgtattaggggcttggctcttggacctaagggtggtgggaagccctggggtgggggtgagttgggagtgacagggccaggcttgttcggtagcgagtgcgttgctggaggagagtgggctcagagagcagcaggagcaggggagggtggaagagggtggaggccggggaggtgggttgccatgatggatctgtaggggagggtggaagagggcggtggccggggatgtggggtaccatgatgcatctggaggggagggcggaagagggcggtggttgggggtgtggggtgccatgatggatctggaggggagggtggaagagggtgagggctggagagtggagtaccatgatggatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgccgtgatggatctggaggggaggctggaagagggcggtggccagggaggtggggtgccatgatggatttgggagctttgggggaaggtaacagccataggactgaggaccgaggacagcctgggggctggtcacatcctcccattgcccacagcacttggatgacacaaagcccctgtgcaccagcaacagctgcggtgcagggcacaagcacctggtgccccggcctccctccactgttcccgcagcggctgtccatgccccaaccccacgcttctgccctgccttccttcctgtgctcacccagctcctctactggtgttccagagcgaacgcactgtgagcccagattacgcaagcacacccctccacattgcactgtggggatgaaggtgggaatggggtggggggctctacctgtcagaaacgggagtgggctgggtgcggtgactcacgcctgcaatcccagcactttggaaggccgaggtgggcggatcacctgaggtcgggagttcaagaccagcctggctaacatggtgaaaccctgtctctactaaaaatacaaaattagccaggcgtggtggcgcatgcctgtaatcccagctactcaggaggctgaggcaggagaattgcttgaacccgggatgcggaagttgcattgagccaagattgtgccattgcattccaccctgggcaacaagagcaaaactccatctcaaaaaaaaaaaaaaaaaaaaaagaaaagaaacgggagtgacagctcttgcttgtaaaaattaaaaattagaaaataacagaaaaggcagttgagcactcgggtgacttgcaggcgtcagtgacgtcatctcctggtgtggttcatatccgatgcatgagctgactgtggagaaactggaatcagcctgcatgggtccatgtcctgggtcccgtgtcatttgcctgccttgggtctccctcagtgctgcctttctcctgtgacctggcagtagggtcggcctggggagctgcattgttcttgtgcttccgggctctcccagggatttcaggatgcatgatgggtggaccgcaccctggcatgggaaccaggaggcctggcttccattggaggctccactgcccacagtgtgatggggcctgtctgccctctccagactccttccagctccatctgtaaagtgatgtggctggaagtgatctctgagggtccctactgcagttggaggcagaagtgctgggaggcagaagtgctgggaggcaccagggatgctgctttttgggagtgggatgggtggcggatggcagcagtgggtgtttgggtttgcaccctggggagactgacccccttgtgggcctcagcgtcctcatctgcaggagggctgtgactgcctccctcgaggctgccgtgcagacagagaagtcacgtctgaaggcacagcagatgctgagaaaaggcgggtgtcagggagccacgcctccatgtctttagggtctttgcctcagtttcccttgccgaggctctgccagggggatgtggctgatgcccgttggctggggttggtgaaaagctgcgtagacccttgtgtcttcctgagcactgggctgtgggatcacagagggaagagaggtggtgaatggggagagggcctggctgagggtggccacctcctgtgtgtccctgcagaaggaaggggagttcaccctgcacggccgggccatcctggagatggagcaatacatccgggagacgtaccccgacgcggtgaagatctgcaatatctgtcacagcctcctcatccaggtacccacagggcagggcacgggagctcatcactgggccctcggctcccggggctctgtacaggtacttcccggaatcctggctctgggcccagccctcctgcactgctggcgcatcctcccacaagagctggcggaggccatctcccaggacgtgtcaggacgcctccctgctgtgccccgcagggacgcactgccgccctcctccctggttctgctgttggggtccaagggccctcgcttactttatttttctcaggaaggctgagtgttctgtgcaacctgcatcatcttggtagttttgtagtgagtgtctcttgtcgattgctgctttctggagtggtcttaacactggtttgcagggctttgcaaccgctgaaccagcgtggacattgatgtgtctttcagtttctatcgttttgcagctgtagctgtttgtaattgcaattgctcttacgggcctcgtacacctgtatccttgggcacctggtgattatttccttgggcggagtttctgggacaaagtgcactttttttttgaaagcttttgattcacattagcaaataagcttctgaaaagctgtggctgtccacacgccacctgcaggatctgagtgcaggagtttgggagccctcggcttctgtcactgcgttcatgtgttcagaattgtttagtaaaacccaccgcaacaagcagcaagcaaacaaaagactccactgcactaaggcgtttgggattattttcaatattaatctggggcccagaagataacacgatgccacctgctgcccatttcccttgtggcttccccggaggtttgcagaacatggaggtgtgcaccagctccgccgtcattggcctttcctgtttcagggtcaaagctgcgaaacctgtgggatcaggatgcacttaccctgcgtggccaagtacttccagtcgaatgctgaaccgcgctgcccccactgcaacgactactggccccacgagatcccaagtgcgtgggccctgaggagctcatgggaggggctgggccagcaggacgtggggcctggtgccagggaagcccttggagacagggccctgaagggctccagggtgtgtgggggtccgtgttagcagcttgaatcctagaagaagccactgcaggaagtaaaggctgagctacgtgcaccgctccagaggactttctagaacccagctgaaattccaacgtgtatgagcattttgtctagacaaggctctctctctggcagccctctcaggagggggacgtgaaagctatgtccacagctccctcagtttgttcctctctgaactggggctaactctgccttcctcacgggctggggagggttagcagtgaaggatggtgtagacctaggacagtccttggcacaggagacgtagctgctggctccagctggtgcccctgtgctgccagcccctccattcactgtgtctttcctgccttttctgtctacagaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcagcccctgtctgtgttctcgagcccgtgtgtgaggctccgtgttggggccttgcctttcctggagttcggtcgtcactcagaccccctgggtttgggctccagcaggtgaagccagcaagagcccccagcaatgactcagaacagctcactgtccttgcccagggcagccttgcctccagtcccagcggtggccagctgtcccagcaggactgggctggcccaaacctggatgtgtgagccttggcctccccagctccccagtctggactctcccctggcccaaggtgccactggcctgaatgggctgaggctgggcgtttgggcgggatgcgtgctctccctccctggacgctctgctccctgtgggtgcccggcagccctgccatccagctgtcccagccgggactgggagtcagcctcagtgcttcctctccctgaccctcctgcatcccattgtcaccagatcctgtccagcccagctgccaatagccctctagccctgccactgctgcctcaggctgagctccagccccggcccacactctgcctctgtgctccctgcagaagacccctggatgcccccactgctgcagcagggctgtgacccctggtgaggctcctgctcatctgccaccgcctccccccacccactgctcagggtgcagcgcttccttcgtcagctccggagcctctacacagagcgccctgggcctgcgcgccctcccctctggtgtctggctttgtttcctggctagcacccgctcgccctttggcactggtcagcccctcgctccctgcacttcctccatcctcacacttgttaagtccccatcttcatccctctcttgaaccccagcatcagtcaggatgcttcagtcatgacagaaaagccaactcagactggctgaaacaaggacggacttggccacaggggtcttgaggagatgcctggtctagaggctccagcaaggtcaccacacagccatatttctgtgtctactgtgctttcactgggctggctgcatgcttggggcctacgaggtggtttcctagaaatccagctgccttcttcatggtagcaaaatagctgccatgcctctgggcctcgcgcatcatgcctgggatcaggaggaagagggtggctctcacttagtggctcccacatccttgcaagcatcctcatggcccacagctcccacgtggacacctgtgaggtggggatgggattatccagctggcattggaaaattagacccacctcggagagaggggtgggactgtccctctcaggccacgtggctgagggagcaggggcctttccctaagcatatcgaaggtgcgatcacatcttcagtagcctcaggggcagcggggagtgaacttggacactgaattggtggctggcctcccccgctgcaggcaggaccaccccactttgttcacctccataaacccagggtggagcaggcatccaaggctcagtgaaccaatgacccctgctggtgggaggctcaccctcccagaaccaggtctgggctcctcagccctcaagcccaccttcccatagtgaggcagccggggacccagcccagcccttcgtcagtgggcagagacacgcccattggtaagcccagtacgttcagccactgccagccccggccggcctcacctaaagaggggttttttggaaacgtatgaggtggcttgcagaaatgacaggaaggcaggaccagtctagaatgggagaccttggaataagggtcatggatgtcaagacaattctgtcactgcgggcgctgctgccacagggggtcggctccagcctgtctgagctcctcccgacacgccctcaagatgccggtccagggaggagctgatgtacagaccttccaggaccgcatccctggggcagaggtcattctccagaatgcagtcagcgtgccgttctggaagacgggaagatggacgccagaaggcaaaaagccaactagcaaataatgcctgcaggaggggccggggcagctccggactgtcccagttgtcctgtggttctggctgttcattctttgagctcgagtcagtcctggctggggactcaggaagcctctgggcacttggccactggggacaccagccctcctgctgcttgtctctcttgcctccaacccctgcatgataacaccgacatgaacgtcccacaacgcacactagcactcactcaaaaccctcatgaggagttccagatgctgcgtgtcctcacccacagggcaggacatttccccttttcccattcctcatctgacaagggacatctgcttgaagccacctggccaggataccacacgttaatgaacgtggcctcccgtgcccagctttctgtcacgctacactacagatgggccgtggggcttgccagctggagcggctaggcactgggagctggggccacagtccacctgtccttcagctggggaaggggtttgagttacacaggcgggccaggagtcacagcccactgtggccgggccgccacccctcctcactaatggcgaacctagtcatgagggcgtccctgttttatgcctcgctactttcaggggtgttgacatctggtgtaaattcttcctgtgaaagattaggtaattcactattaaccatggcagggaataaacaatgtccttgcaaacagctgcccacggagccaagtggactcagcttccagatagctcttgtgtttgtcactccccagcacgcccatggcccctcggcagcccactcccaggatgagtatcacggcctctccctgccaacagccagctttcgagaatgcagattctgctgtgtctgctcaaaggctgagaaccccaggacctacacgataaagtcagattccttggcctgggtagagggcatcaggagctggagttcagctgcccacagccactttcccatcccccttctagttaccccagggtagctacctcctggccaaccagaatctttcctggggctgcttgatttttggctaaaagacaagcagctgagccagtggcaggatgctggcaggatggcagctcaaccctcagggctcttttccccaggcctatcttagaagcggggaagaaagaagccaaggctggcatgtggctcacacctgtaaccccagcactttgggaggccaaggtgggaggattgcttaagcccagaagttcaagaccagcctgggcaacatagcaagatcccatctctatttagtttaaaaaacaaaaaacagagggctggggaaaatcttaatggccaaaacataaaacaaacctgcgtgcacacaaacgagacacaattacagaaagcatagagcctggctctccccctggcctcaaatcccccaggtttgagagtcattacttctgggggatggtgactagaaggtggtgggagggaggcttctaggagctggtgatggtttggtggtttcttcacttgggagcctgctcctgggtgagtgcgggtgaaaagtcatccagcaagaccttcgcacttctctgcaggcaggtaggttatccttgagccatggggatgacagaaagctcccactgctcagcaggggtcccggctcctgcgcaggtctctacggactctctcctgtgacctgggcaatgcccagctctctccagtattcaggctgtggcgtccagcaggccgttatgggaaggaagggcaaaaggatcagagtaattgggatcagtgacagcggctaaggttcatgcagcagcaggggctcggcaccgccttctcggccctcggcagtgaggactggccttgccctcttttccatatgggcacagcgaagtgggggatcctggccaagtcacccagcaggtgcacagcgcggccgggtttgaatcaggtagccaacctcagagcccatgtttcacccctgcctgtgtgacccacccgtttcccaaaaacattcggctttctgatgccagagtccccatgcaggctgtctgtctgcaatgtccttctgggctctccccaccttcctctgccatgcacccctggcctggagtgtgctccttcctgggcagcccctgctctgtgcctgtccagtgctggagctcagccccccagggctgccactgggcagtgaaggctcttcaggacacaggttcagtcctgcttgtctctatagattccaggacccaggaaattagtgaacagatgaatgctgtctgcatgtcaggccctttcagctcctatcctggctacgaccaccagaagctgaccgagaagctcaaatccagagcccgcacgtaatgccagtatttcaccgggatgaacaggatctctccaggagacaggatgcaggacaggaatggggccttggcaaacttggggaacttttccaggtcgggattctccacgtcaacctgaagaaagcaaaggacgtcatcatctccaggggcagtggggagaacctgcaacgtcaccccagacccccagtgcccacctggctcgtgttatggagaaggtgcgtgtcatgagggtacagagcccctgactcctgcggggaatacagccggatgtacttcctccccatcacctggggagagagaccctgacagtcagctggtggcctcactccactgctgccccaagcccactctggcctctgtgcccttccacatgctgctccctgggcccagcctgcccttccccaccacacacatgcttatggttccacgtgtatgtttttctttcttttttattttttagagacagggtctcactcggtcatccaggctggagtgcagtggtacgatcatggctcactgcagtctcgacctcctggcctccagagatcctcctgccccagcctccccagtagttgggactacaggtatgccccaccacacccagctgatttttgtatttttatttttggtagagattaggttttaatatgttgcccaggctggtcttgaactcctggcctcaagtgatcctcctgactcggtctcccaaagtgctgggattataggtgtgaactaccaaacttggcctaaggtatgtttttcttccaaatacattttgaaaaataacttcatttttggagcccacaattattaggcgcttgtctgtgccaggcactgcttaagtgctttatgtgtgttaactggtttaatcctctctgaggtggtttatcttcactctcattttgcaggtgaggaaactgaagcacagagagattaaatgagctgcccaagctcacacagctgaggtgtggcagggctgctgtctgcgccaggcacgctggctcccgaagcccagctcttagcccactcctgggctgcctctctggactggtctgctggggtaggagaacgttctcctttactaaacctctctttgcctgcgaaaaccagggtggtcttacagcagtagacagaggtgcctccccttgcagcaaatccatctgctcctctgactgggcctcaggaaaaaaacctcccagtgactgagaaaactcctcccccaacctgccacctcctatttggaagctggtctggatcgcatgggtagcaggcggggaggggcagaggcaccgggcacccacaccagcactcgctccctctcccgagggctcccctgtgagggatcttgggaggagcacatgcaggaggagccgcttctggaagcaccgactgcagaggccttcctgggcctggggccgtttgtgggtttgctttatatttttgtcctcatccccttcagtgcttcttgtttctttttaagagcccggtgtttaaaggcagagaatgtggccggccaggtgtctgggccaggaggagttagaaggccactattccagctgcagctccaacctgcactaggaagttttgctggggatcctgatgtagtggggagatggttccctggggaccaaaccaggcattgatggtgatttcctcctcctccccatcgcccaggctgcagtagtcggggatgctgatgtcctgcttcaactccgggatctgtgggcggcagagcagacatgagatgtggggatccggctggggacaccgcagcccggaggccaacgaagagtcagaaacacatacctatatccattatgtgtgtgtgtgtttgagacagggtctggctctgtttctcaggctggagtgcagtggcgtgatctcagctcactgcagcctctgcctcctgggctcaagtgatccccccacctcagcctccttactagctgggactacaagcatgcaccacacccggctaatttttttttaatttttatttttgtagagacagggtttcgccatgttgcataggctgctctcaaaatcctagacttaattgatccacccgcctcggcctcccaaagtactgggattacaggcgtgagccaccgcacccggcccttgccgtcctagttttaaaagccagggtaggcacagaggatttgttgccatacctggcagaaacaggctgggcagagaagagaaactgcctgacgagaaaggcaggtgtgggcctgggtctgtgctctgagctttatatgatgcagtaagggtggcgcggctccccatggcctctgacagagttatatgccacacatcaagcgatcttggatgttcacggtggggcagggccgcagtggcctggcctcctttatttatttattgtaattttttttttcaaagacagtcttgttctgtcacccagtccggagtgcagtggtaccatcatggctcactgtagcctcaacctgcagagcttaagcgatcctcctgcctcagcctcccaaattgctgggaccacaggagcatgccaccgtgcctggctaattttatttttgtagagatgaggtcttgctatgttgtccaggctggtcctgcttggtctcccaaagtgctgggactacaggtatgagccactgcacatggccctggcctcctttacacaaagccagggtctcagagtgaaaacacactcactctaagtccacttcctgtccagacccttagcaggcacctcagttacctccggggttgaacccaccagagcaggccaccagcccacaccccccaggccaccgagaaccccagggttcttcacgggaccctggatggacctggcggcatttttcaagcttgagaggcatgaaaacagggttgccagagggacacagggctttttaagagtcactgctccgcagcctgaaggcacctgcaggtggacactaccattccttcgggagcagtgacggtaacttcaggctgctggctcagaaaccagtgtgtaccaggaaaagctggaatgttctccctgcagggagcttggtcccagacactgctattcagacctttaagaacctgtctcaaatcagctgtgcagaaacgcagccgcgcctgctgcttaggactgaagtacaagttcgcaagctgaggtccctcccagggctgtgaggggttcctcccaaaggtaacccgacgctgctgcttttgaccagaactggccctgtggaatctgagcagaaactatgattggtccctgatgacatcatcaggatttctgaaaggtgattggctgaccagatcatgtcatcagaatcactggccgaggatgcagagacccgaagggaatcagtgctcccgagatgtgactaataactgaggcaggcttaaactgatggccaaaatcttctagaacacggggtccctgggagaaaagtcaataagaggttctgggacaagaatttggtaggagtccctgagcgtcctgtaggtagagaaggttctagaacactgtccttgccacacggcatgataacacctgggcatgggctgctgggacttctccagggtcctctccacagcatggtagacactcagctctgggacccaaggtaaacacccaggcggccctccattacccgaaacatctttcaagtcctggctcatcttgaaagtcactgtgaacttggccttctactcctaaatataactcctcctgtcctacaaagtatgaaacagctgctccaggacagggagccaaggttaaccatggcttccagggtccccagcccacactgaggccatgcccccaggatgaccagggtcaggagaaaggtgggtctcgggatcacacagtagggacctgatcaattagaatccccctttccttcacttagcaagtgacatggacaggacgcaggatgcacaggtcctaatagggaggcctggggaagagaaaccgccagcgtcctttaatgtcggcatgaaggctcctggcacagcccctactggccctgggtcccccatcgagacagagaagcagtcctggcttcagcagtagatacagcagctgatcagcatcccagggccccactgcaaaggctacagaggtgcggccccagcccacccctggctgtagccctgaccctgactgactcgagtcttccacgttcgggacacgcacctggccctatccttgaatcctgccaagggctgccttcctgggcactcctggcagacaccacaccagccaggtccctcctgggcgccccagctccatctatttagtgttttggggtcctgaatctgggcatcttccccgatcttccctccctcccccacacatccacccacgtccagggctcggtggttcacaccggtcttgaactgctccacctgccagcatcacctctccttgcaccacagcaatagcccagccagccacccgctccgacagctgctcccttcatctctgaatagcagcccctacaatcctcggggcactggcgaccccccagtgtttcctgtcactttaggaaaatggctcctcatcacccacgtcctgtcaccttcctagcctcacctgctgcctccctcctactcacgctcactgctccagccgcactgagcccaggaggggaggagaggggaaggtgagacggtgaggggcagaggtgcgtggcctcagacttacctggtcaaagagctggtgctgagcaaggtacccgacgtcccttggctaatccaccggggaaaaccagaggcaacacagaaagcccagttagtcatgacagatgccctcctgctgctgctgtccagctggccccagctgcagcacccgtcacccttccactccatcctgagtggtcctctccaacccttagaggccctggggcagcttcaaagaacctctccagcaccggggtacccagtttgtaaagcactgatctcatccatctgattggcaaacattttcataaaatggcaacaaacagtgcaggcaaagatgtaagaaaatggacacttgtgttaattgctggtgaaagtataagtgatctaacttttgggaaaaataaattgtcctatcctgtcctgtcgtaattttgacagggcctggttctattgtccaagctggaatgcagtggcctgatcttggctcactgcaacctctgcctcctgggctcaagcaatttgccccacctcagcctcttgagtagctgggattacaggcacgtaccactatacccagctaatttttatattttttatagagacagggtttcactatgtttcccaggctggtcttgaactcctggtttcaagtgatccgcctgcctcagcctcccaaagtgctgggattacaggtgtgagccaccatgcctggctgctattaaaaatttaaatacacatactctagacttagctgtccaacttttggaacaggctaaaacccactgaattatactcccctgcccattaaaaaggacctgacatgaatccctcatgtctgctggctaagcagcctgccttcctcgctgcggtcgtccctccgaccacagacttacagactggctcctccaaaacctcccattacaacacatggggggttatttgcctaaatgtactatgctctctgccttgcaagtactaggggaaagcagtccccatgatgtacctcattcacgatgt

SEQ ID NO: 1007 - DNA, 982 bp, Homo sapiens
tttcagttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcag

SEQ ID NO: 1008 - protein, 271 aa, Homo sapiens
SVRSHMQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 1009 - DNA, 45637 bp, Mus musculus
  misc_feature (1)...(45637): n = A,T,C or G
ccaactcatatgacactggcttatttcattctgtgggttagtttttcctaaccctatgaggaatatccaagagaaacagctctcaagctgtgggtggcaccattccctgggccaggagcctggactgcataaagagaaaaggaggaataatccatttagctcgctgtctaaggaggaataatccatttagctcgctgtctaagagagctcagttcgtcacagtgggggatggggtgaggtgggggaggaggtatgaagaagcagagcggttctcatcagggcattcaggaagcagagagtaactgctagcgcatgggtcctcgcagctcacaggcagggctggtgtccctttagttagtcctttgtgaagacccctcacagacgcgcccagacatgtgcgttcctaatctgacaggcagctcttgatccaatcaaaccaataatcaagaagcagagcagcctgcatgctgccttccaggcaaggaagccagaagtggggcctctggacagaaatcccaaagaggaagtgtggccaggtggttctggcacactgtggggggaggggtgtgggggctgaactctgtattgcaggttctggccagaagaatgtggacactgggccccatggcaatccactgaggctctgaggaaagtaactggattccagcgagcagtttgaatatatgatgatggacatgtaagaaggttccaagaactgagagtgacagggctgagaatacgctggaacattcctgagaagaatgtctatatactccaagacaaggagaagggagaagacacagcatgagagaagagactgaagacacgcatgccactgaagggacagtgaagggcatcatcaaagatgaccaagacagatgctggttataggctgtgtggaaccaggcagcccttccatgtgggagatccaccatgtatgtcccttttcagaaaacctggtaccaccttcccatcttctcaaaagattgcaagacagaaggtggggtggggagctgccctgctcacagctcagctttagggtcttcatacatccttccctggggaccaacccatctcagctccgtgacagtcaagacggaaaatccaaccaagtggcctagggaaataacccaaaagtccaagtgaaggtgtggactgcagacctggctgcatccccagaagaagtgtatttatcatttactccatgtggagctgcagtccggcagggctcagctgggacagctgtctcttctctgctaggtgttgggttaaacaacagccacattcactttgctgatggttcagcaactaggtcggacctcagtgggctcagttatctccttttcacttgatgtcagcaggggtgactcagggctgccagtgggagtcatttgaagacttgcccaagtctcagtgctctctgggcagttccatacttcagtccctactgtacataggctctctaatgtgctcctccctgtgtagtggctctagagtggactgacagctcacatgtcactcaaggatctcaaaacataaggaaggagcgctaggtatggtgacacaacctgggactcaggaagaagaggcaggaagtctgcaaatctaagaccagacctgactgtagagtgaggggcagccacaaagcgtgtgtgtgtgtgtgtgtgtgtgtgtgtgtgtgtgtgtgtgtgtgcgtgcgtgtgtgtgtgtgtgtgcgtgtgcgtgcatgtgtgtgtgtgtgtgtgtgtgcgtgtgtgtgtgtgtgtgtgttgggggagatgctggagaagctaattcttatgttcagctcaggtttagaaggcacagcatcttttctagcatattttatccattgaagagagtcaatggctctagccatggtgaagaagggggggaaataagactctttctgagagaagccatgaaggatggggaatgtttgaacagtgaaatgtgtggaccgtggctctctctgaccgttgacaacatgaatggacagtagagcattagattagagggagagtgatgaggagagtgagtgtgctgtaagcacctccttctgaaaggaggaatgcagttcagtagacggagtgcttgtctaatatgcacagtaccttggatttggttcctaggactccataaattataggtggtactgcatagctgtaatcccagaatgtctgtaaccccagcactcagtggctggggcagaagggccggaaggaagaccatccttgtctactgcactggtcacttttctttcttttggggggagaggggagagggcacgtttaagacagggcttctctgtgtatccttgactgtcctagaattcactctgtagatcaggctgccctcaaactcagagatccctctgcctcttcctcttgagccctgggattaaaggcgtgcaccaccattgtctggccagttacttttcttgatgctgccacagaatatctgacaatcaacttatggaaggaatagtttatttttacataaagctccaggggacttgtgcccgtcaggtggcttggcaggtaaagacacttgccatcaaacctggaatctgagttcagtccctagcactcccgtggtagaaggagagaaccctctgttgaaagctgttctctgaccttcacccaagtgctgtgatacatacacacgcatgcatatataccaaacaaaccaaaccgcaagcaaacaaacaaatacacagtaataaagaggtcttgggtacaatgcagcagtaggaccttgagggagccagtccacagtcaggaagcagagagcatcaaggcctggctgtcaccttgcttcctgctttttatgaagcttggaacttcacgccagagaatgctgtccacattgaggatggacaccatcaagagaacccttcacagacacagaggtttgtccctatccagttgacaaccagtatcaatgacctcagttacgcactgaactcctgcccagcctgatctctatgaggcctcttgccaaacaacaacaaaccagggagacaggtctcccagcacaaagggggcgtggaacccacctctgttgtagttcaagtgtgaaatgttcccacagtctcttgtgtggaaggtaagcacagcccagttgcaccaacagttagttatttctggatgctcggtattatcccggttataatactgtataaaacagtcacctttttggttgacactagccctgtgatgccagcagtcactttacgggcagttggtattagcacagtggcagcggcagatggctttggaagggtatacaagcctacttacaccgggagttcccatggacatgtctccatccctagttaccccactataagcatagttcacacacacttcctttctggacagttaagacgattctaactactccagaggtcaccttttgaatggactatatcaatcattcactgtggcatttgcctgatcagtgactgatactaactcaaccacacatgcattattgttgttgtgtcggaagtggtggtgtgcaccttaaatcccagcatttaaggaggcagaggcaggaggatctctgtgagtttgaggccagtctagtctacggagtgagatctataccagtcaggactacatagcaaaattctgtcttaaacaaacaaacaaacaaacaacaacccaagttgttgtttataggcaaaaaatatatataagaacaaatttaaaagaaaccaggagtacctacatttatttcaaataaagtagacttcagataggaatattaacacagatttaaaaaagaatataagtacatattttaaaggaacacaagaatgagagtcaattctatacaaaaatataagtgaaaatccttgcatttacttgcattaaaaaaattccactgtgacaatcttttttagctgattatttatactagtcacattttaaattatcattgaaaaaatgtcatggtgttcatgtctataatctcaccagtagaaaagctaaggcaggaggattgccatgattcaagcccagtataaagtacaccagcccaggctgactacagtgagagatcctgagtagaagcaaccgaaacaaaaccgaaacaaaacaaaacaaaacaaaacaaaacaaaacaaaacaaaccaaaccaaaccaaaccaaaccaaacaaaaacaaaaacaaaaacaacaacaataacaaacatgtatgcaatcgagttagtgttggtactccctccaacagagtcaacatgtgagaggcacaaaccaatgggagttcaaggagaaggagaaatcttcagtgattcattggaggctgacaccgccaacagtgactgacagcacagcaggaagaaaatctgcaagactccattacattgtaacattgtattcaacagcactgtcaatcactgtcttagggtttactgctgtaaacagacaccatgaccaaggtaattcttataaaggacaacatttaattggggctggcttacaggatcagaggttcagtccattatcatcaaggcagggccatgtcagcgtccatgggactggaggagctgaaaaatctacacgtagatccaaaggcagacaggaaaagactggctcccacatgtctacgaggagggtctcaaagtccacactcacagagacacacattctccaacaaagccacacctactctaacaaggccacacctcctaatagtgccacttcctgggtcacacatatttaaaccaccgtaatcacccacatccaatggccttataaatgttctataaagaacaccttagccccttcctcccctcctgactcttctcttccggttgaggtggtggcgggccttgcctcctactcagctctgtttttcctctcctcgattttccccccacccgcacccccacctccccgggcctagagccgctggacttctttctcccttctctatggcggcctccgagcccccgcgtgcgctcctttccctgccatgaaagaggaatacaacgtgatggtgctgggcaccggcctgacagaatgtatcctgtcggggataatgtcaataaatggaaagaaggttctttatatgggtcagaattcatactatggaggagaaagtgcatctataacaccgctggaagatttatataaaagatgtaaattaccagaacaacggccagcatcaatggggagaggaagagactggaatgttaacctaattcccaagttccttatggccaatggtcagttggtgaagatgctgcttttcacagaggtcactcgttatatggacttcagagtgattgaaggaagctttgtctacaagggaggaaaaatctacaaggttccttccactgaagcagaagccctggcgtgtagcttaatgggactgttggagaaacgctgcttcgggaagttcctggtttatgttgtcaactttgatgaaaaagatcctagaactttcgaaggtgttgatcctaagaagacctccatgagagatgtgtataagaagtttgatttgggccaagatgttatagactttactggccattctcttgcgctgtacagaacaggtggctacttagatcagccgtgttgtgaaaccattaacagaattaaacgttgcagcgagtctttggcaagatatggtaaaagcccatacctctatccgcttaatggtcttggagaattgctgcaaggatttgcaaggttaagtgcgatatatggaggtacctacatgttgaataaaccagttgaagaaatcattgtgcaaaatggaaaagtggttagtgtaaaatctgaaggagagattgctcgctgtaaatagctcatctgtgatcccagctatgtaaaagatcgggttgaaaaagtgggccaggtagtcagagtgatctgtatccttagccaccctatcaagaacaccaatgatgctaaatcctgccagatcgtcattccacagaagcaagtcaaccgcaagtcagatatctatgtcttcatgatctcctttgcacataatgtgacagcaaagggcaagtatattgccattgtaagtacaaccttggagaccaaggaaccagagaaagaaatcagactggctttggagctcttggaaccaattgaacaggaatttgtcagcatcagtgacctctttgtgcctaaagatttggggacagatagatcttcatttcccatgcctatgatgctacctcacactttgagacaacctgtgatgacattaaagatatctacaagaggatgacaggatctgagtttgactttgaagaaatgaagcacaagaagaatgacatttatggagaagactaacagcagtacagattatgtaataactaggacaaacttaaaatttagcaaataatgtatattgtatgaaatcaatattgtaagccctgcttttatgatcgaaatggagatagaagagtgctataccagtgaatgctccttcacttttctaatatcacgtattaacttgttttcgtggaattcagaattggttggttctattccgtttaaccagactgcatttttttttctagtgaaggagctattctaaaaaaatattgatatcaatacagagaacttggtacagtacttgtatcttttaatcagtgtggcctttgcgattgtgtgaccttgcccaagagctgaatctatacaatttgtgccatcctgaaattgggagtctaaattgagtgtcctttggtttctgaagaggttcaatgttttctctgttttgttatgtcaagtattacagcaaggccaatagaagagccacatgttttatttctgagggtatataaccttttagccaaacttcagacttagggagttggaggaagccagtatgtggtattttaacctacaacaattgctgagaagggggaaggaaccttaagtaaagcaggtaaaaatatagaagcatcctttatcccagatatggcttcttcaatggaccaactgcaatgcagtattgatttgacagagccttaatttcagtgatgtctactccaaaaagctccaaatgatttctgtactgcagaaataaagccaaactctggaaaccaaaaacacgcatgtggtggacatacttcatacatgcaggcaaaacatttacacatgtaaaaataaatttttttcaaattctaaaaactcaacgacagcaaactccgagaagtggtggctgtttgaggcagaggtgcaagatacaagaacagcacggcaagaccttgtcccgaagaattaagtgggggaggtgctactgcaggctgcaagtaagataaaccaacagcaatttagaaagaaggagcatcgagtataggaaaaaagtggataaaatccaaaactcaacagtggcaaatgccagagcagatgaagtacaatcaaacagatgtgttgtctaactgcttaataaataaatgcataaataactatataagtaaatacataaatgaatacatcaacccatgtttgtagccacctcccagggctgctctcagcctaggtcagcaaagcttcttcctgcagcaggcagcagctaacacagactcataactgctccaagtgtgagcataaatgactgtccagggctcagccctaagcaggtcatctctgtccccacccccaagcctggcagaacactggggaagaggatctggaaagaccttaagagccggaggttgggtgctgtgaaacgctgtgttctggacaggacatggccgctgcactcagggattacagcaggcatggttgagctttacagggatggacccttcatacattccacagcagagggaagcagaggcctgggagacctgaggggccatcggcagttaaaggccaccagaggacacttgttgtggatgaccttgaacttcatctgcctccgttttccctccatcttcgatcctgtaccggtattacatgaatgtgtcaccccactgagatcatgtagtgctggagattggactccgggtctcacacacactagtcaggaattctggtagtagtctgaactacttcccctccctcatcttggttaagacagggacataggcctcactgattagttggagttggctagctggcaggtcccaggggtctctgcttgctcactactggagttacaagtatatgctactatgcctggcttgtgtgggggatgtgtgtgtgtgtgtgtgtgtgtgtgtgtatgtgtgtgtggtatatgagcatgtccgtgtatgcactgggtgtcctggtgtaccactctccaccttattcccttgggaaagagtatctcactgagcttgggctagactggcaacgagaaagcccctgcagtcctcctgtgtccttttcccagagtgcagaattacaggcaaacccaactttttcctcagatgttggggtccaggttggtgtaacaagggctcttatctactgtgtagtcttccaagctccactctcagctttttaacatggggactggggttcaaactcgggtctactgaggggacccaacagagctttccccacagcactaattattctatcacactacatctgtttcaaaaatagtctactcttaaacactgaggtaagctcaaaggcagctccatccgctgtgctggaatgcgctccaagcttggaaggaggcaagctcgggaagcccttaaactggaagaagagcctggattatctggggctcccagcccactcttgggccaaacagagtggtcacttaggaagtctgggactgtggagggaatataagcttcctgctattgtctgtcttcttggccagtatccttggctctgtcctgacatcaacttagatacatagaaaggttttttgaaagaggagtgctaagaattcccatcattgtgcccctgaacattttcaaatgccttccctgaccacatgtgtgctggccttcctgctgctttccggtctgtcagcactgtctagattctgatttcacaaccaggcacgcaggctccagcccagctgctttctcggcctagttctgctgagcttctctgagcacctgagccaagcagggctggtcccaagcaccatcacaggccagcctgtttctgtcacatatcgatgtatctcacatagtcccctctcccctgggcaagggtcatacaatccagtcacatgaagacaagtggccagccaggagggatcaaaagatggcttgcagactcagaagacagcaagatgtggtggcttgtatctgcaatcctacttgggaggctgagacaggattactgtgacttcaagttcagactgtgctacaatatgacagccaaagctgtatagcaagatcctgtcacaagaagcaaaaaactaagccaacccaatccataatgctcaaaacaggatggcaagcccatgggatggcttagctagcaaaggcaaggctggtcacagttgcgctgctgtgggcgagagaacaacttcgtgatgtcagttctttcttttcacttttgcgtggtttctagggatagatcttgcactctcaggcttgcgggccatctcatcaacccttaagcaagtttcctaacagatccatgcctcagcttcttcatctgaaaagggatagttgcgcatgactccctcttggtagtagcagcaaggttcctgcctgaacctagcaggagacactcgctcttaattgatgagttgttttgctttctggcacagacgctgagtaaacattgggaaaatgagcaacagccgcaaacacaagccaagctggtctgtagggaaagggcaaagattcgagtcccgcagtcgtgggacttaaaagctggagctctggacagctgcggacgcgtggggtggggcatgcaaataagccagcgatcaggcaaagtccggaggactgcgggtgaaaatgagctgggtgaggggcggggcatgtaaatgaccgtgcacggggtggggcgtcgcatgtaaataagggacaccaggcggcgtaggaagcggggcgaggtccttctcgcaggaaagccccgcgcggcgcgtggagcctgaactcgcaggtaggaacgggcggtggggaagcctggggaccgggcagtggtggctacagaaccgatctggcctgaaaccagagcccgcggaacctggggtgggcatggggctgctgggctcctcgctcagccagggtcggctgccttcgggcgcgggtcaagcaagtagacaactcacgcgctagaactcagggagcctcggcggtccggtccccacaaagacgtcctagggatctttgtgtagaagcccggactaccaggctcctcccaggttccggttcagtaacccagaaacctgactattgtggcaaactggacgttgtataagccagctagtctgtgattccgtctgcccccaagccagcactcctgggtcctgcccttctccagccctttgggaggtgtgaggctcaatgtggccttccttctacaggtggtcttttgagagtctgggggcatttgctgggacatttgtcccatcctaaagtcttatggggaaactgagacttgagaatatgtttggccagaagagagtaatgggattccacagtcctggtaaggcctctaggaatcagccagggaagtcatgaccgcttaaggggacattgaggcagagaggggaggtgaccactgtgtgtgtgttccccagctcgtctgtgctctgcttgctgttttaggctgtgctctctgactgagggatagacacacaagacagggagtgtattgggcaagcagggcacctcttccttgggcagtacagctcctgagtcagtttggggtgtgggagaacactttggcaggtcgagaatcagagacaagagaaggcatgctgaactgtgggtacagcatgggcaaaaactagaaggtgggacggctccgtgtgccacctcgctgacataagaggggctagatatgtggaaagggagacagcgctgcaggagcccctgaattccttgctttgaggctcagggaagtcgtaggaaggattcgtagtcctggccctgctcctggatcttcagggtaaggatggggaaacccaagtgagtcgcccaaatgatcacacactggtaattgggcaaggttgtgaccatctgagggtttgcagtatttgggctgtgctggggtcttaatacagtgccatcccagactggggagggccaggtggccagggagactgtccctgaggcaggcacaatgactgccacaatcggggatgaaagaagagaatgcttgcattcacccacgccacaccctacttttctgcctttgggggctggggctgggacctagctggggtacacactcacacttggcatgtgtacaaaggagcttgccacggtccccatggcacaggaggcccacatggcaagtgaggcgtggaggttgaaagccagagctcctgaccaagcaaaggcttgatttgttccttgtgtgttccttcatcagagactgacagaggcaggggcaccaccgtgagtgtgcctgccgtgacaggacactgttgggtattcctcgggttgagcctctgagaccagcctggatggagaccagcctagctgtgtatggctggattcccagcttcatgaggcttgcctgggtgggcacagactcacagtgacccagattcagacacccagcatggatcagagtccgttgttccagttctcagaaccagaggcagggaatggggctagaactgaagatgggaggcaggggggcagatctgcgttcggatctgtttggatctcaagaaaaatcactccacatccccacacctcccgtttgtcagaggtatctgggatgaaaatgttcatgaaatggcttttctaaaccattgctcatggacaggcaaggcagttgattgtctcctcccacttaggatggcattgctttgccaagctgcccctagcgcttcttggctctgagggacgaggagtgccaggtgctgtatcaggccaaagatgaggtgtttgacaaagtccttgtagttcagactccctgagaggagaagactctcacaccagattcacagccatgctccgctgtcccgaagagtagacaggggtcatgctgtagaccacccttgctgctgactgaagggtgatgccaacccagatgggtcatgagtagcatcccgtacagtgaggtaagatagtgtgtctaaccttctggggtctcacaggcactactggtcagcgacaggaccaggcaggggaggaacaaaggtcagcaggagcctcttggggtgatgacacagggctccccccgcccagcctgcgttcagtctcttgagcacagtctttctaagaagcgctgatgtcaagcagttctaagtgctgccaccagtgactcacactgccgttggggcccactgcctcttggagatggcgaagcttaaagttgggggcccagctgagggacttcagtttcatgaggttcgtgggaaggtggggggctctgggactgaggccctccagtccccagaagtagttatagaatgaagggcaataatcatgtgtgttgggcgccaaccaataggccggggtcaaaaccctgagtgacacagcagtaaagagccccccctccccctcaggaagtcctgaggaggaggtgactccaaggacttagccttggagttgagaccccaagtagagagagcagatacaaaggctctgggcagagaacaggttccttgtgttttacccacatcaaggaaacagtgggattggttgggactgagggaccagggagggacaggagtagaagtcaggggtgggggtgggggctgacacctgtattatcttagtttgtttaagccctgggaggcaagggctgtaagacactcaagttttctggatgaagtgacatagaagttcagtcacttatttagggtcacatgtcaaacctcccatcttcaccactggttataaagaatgaaattcggtcacaaggtgagctaccacaaggtcacctctttacttgactgtgctctgcccagtaatcttgggaaaactgccaggactccatgcaatcagtttgcaggttattgttaggtgaaccccttccttgcagtttcagagagtaaggaaggtctgaagggaggggaggaaggtcacgtacataagggcccaagcgttggttgggttgagctcctgtccccaaggaagaaaacagactagtgtagagaccagccacgtgacactctgacaccactcacccacacgcttcatttctgcccaagctccccgactgaagaggagagtttaaaagcaccagagtgtcttggttggatccgggaagcattgttcacaggtccattttggagaacttgggctgcctgaggtttcctggagtggccagaggggtgtctgcctttttaaaagaggaagtgaggccttgggaggaggagagcaagggccacggctctcaaccacagagccccagtctcttgcccaattgcctctgggaaaacaaggtcctactgtgtgctcactctggggatgatctctgagactggctttccagggacctcaagctcctggctttagttcagccccctgggaggtaccgactgtccctccactctagtcctcgagttcaggctgttctgctacagtcattctaggcgctccctctacctttggcggcttctgagttcagtctgtcttcagacttgacttgatttggggtcctgttagaaccgagggagactttcgcctccttgtatcattctggagtgcatcgtatctcatgccgttcgtagtcgtagtttgtgagagcagtggttgagctgaagcctgccgtctctctcttcagtgtgtcttcccatctgaaatgtctaggttgaggttacagttgttttcagtcgttcttgttttccagtgtacttttggctaactaagtctgagctggccatcgatctgtcactgccagagatgtgctcatttcttgtgtctgctgcaggagcttttggaagtggtgtgtggttttgaagggttttgaggtgggtggaattttctgttatctctgttgctggattctaactctggctgttcaggctgttgtggtaggcacgtgtggcttctgtctcagtggtagaaaatttattgccctttcaaaaagagtttaacaattggtttggtttggtcttcctggatgtttgttctgatgtatttgaaggatgtgtgtgtgtgtatgcaaacatgcatgtgcaaatccaccttgtatgcacagtcaggcttatcccccagagtttagtctctctacctggcctgacttggggatcctctgtctctgctttcctggtgttgggattataggagggttactccatccacccagccttcacatgggtcctggggcccaaactttagtcctcatgtttgcatctcaagcactttaactaccgagctatctcaagcaccaatgaaatatgcagttgaagttcaccacatatacctgtaatcctagaacttggtaggctgaggcaggaggggcctgagttcaaggccaatgtggatgacgtagcaaataagcctgtgtttttaaaacgtgtgttttctattgagagcgaagccctagaaaactcagctgttggtgtgagccctctaactcaccagctgctttctgtttgtgtgggctctgccccacccccacacagacaccccgactcaacgctctcctttggtgtctctgggtcttgtcctagattttgaagccgagtagtgagacgcacagccagcaggcacaacagaccttggctgtcacctcccctccctctatgtgaatccgcctgagttcctccctgtcacacttgaactgccctattctctgccagtcacacttgcttttcccctggtgacttcgtgtcagtttgcttccagcagactagcactgcattctgctcaggaaccaggattctgagcatgttgctttgctggtcatacagtgggctacggcttgccctgcctgcctgtggtagggatgtagctctgtggtagagcacttatctccagtgtgtgcttatgggcctgggttgggtccctagcatgacaggaaagtaaatgcgatactgaagaagtcaggcattgcaggcatcatagatgtgtccctcctcaggtgtaagctccttggctggtattgcaggcagtgaggctcacacaggccaaggcccgatagtgggaaagcacctggccgggatgaatgttatgagatagcatatgactccagtctggctgcctcctcctgtgtggatatgagacatggaccctgagggaccttccgtggagaattagcacagaactagcaaagctcatcgagtgggagggaaagggctggtgaaactgtggaaggtagactgatgtgggagtggactcgcccagggcggtggagcagcagtggtgaggaggtctgagctggggaaggagagtgggaagtgaaggagacagtgtaggtgacccagcgagccggtctgcccaaggtgtacgtggggacctgataggggaatataggctgacaaggacagaatataggctcctcatctgcccagcgtggaagatggtagtgagggctgtagacattctagaatcttctctggctccttgatgagcaggtgaggaagcatctccaacccacctcccatcccatcaccatggtacccagtattgggccgtggtagtagtcataggaacaaagaggatggactttccccggtggggccagttctggagtggggacccccttgtgccgttcttttcctctttctggggtctcctagcatctcaggtctgctccttcccactggataccagctaatgatggcagccacatggggaccacaagcttaatctaattatttattagttatttctttattgtcgggcataaagtcaggcacaggctaggcaaggttgtttacagatggagagagcaggcaatctcttaggtcagcctggggttctcaggcatggtggggtgactgtggagtgtaagaggcctgtgtaaatgcttgagggacctaggcaacactaaagggacttagggaccccacaggccaagcaccttgctctgtgggctttgtaggctgaccctggagaatcatgtgttattcttcactttgcccatttctatgagataactctaaccatggggtttaggctggccttgaactcctgtctcaggctggcctcgtggctagcttcagggcatccccaccccaacagcctttttgtcagctccctgcaaacaaaaccctggctagtaatgcagcctgcacctccatagcaggccaccccatctccccaggacatggtcctgactgctcaccctgagattcatgccccatcccaggctgtgtgccgtggaattggagatcccgtgcttctaagcccatgtttcacagtgggaaggaagcttgcgcccctgagacttattcctgttgtcatggcaactatccttgtgtatccttgtgggtttttttgtttgtttgtttgttttttgtttttttttatcttagacttttctgagtggatagaagcaagcctttctcactactctgtgaaccctgtcccagaccatggtcagtttccttgttttcttggaactgcccactgaaacaaggaaatctgttcccacttcccagagaaggaaattgcattctgagaggaggacctcagcctgcaggtcttgggctgtcgaggtggagctgcactttttctgagagtcgtgacctatatcttaggtactctggggtccctgcccacttgggaggccctcactgccaaggctcacaacaatacagggtcgagacagcaggaagaatgtagacgagtgccccttgccctcactacatttgtctgtagctggcacccagtgttgactgcggagggtgtcagggaggggcagaaagtcccagtcaccactagacaagtttcctgttgaaggctatgaagacaatggaagagtctgaaccttggttcaaccactccttgaacctctctgccaggcatcagaccaagaattacacaatccaaggcctgggttcagatctcagccacagcagtcaccaacttactgtgcatccttagtcaggttcagaacctctctgggccaggttgctccatctctaaagtggggctgatacacctatattgacaatcttctccattggtgtcagagttcaggggggtccctaagagggagggaagctgtccccacctctcgagaggtgggagaactgggtacgtgcagaagcgatggtgctggcttctgcagatctctggcaggagtctggtggagtccagtccacactagatagtatttaatcagtgctcaggagccttgcatcctgtttctggaacagtaagtaattaccacagcgatgcttgatcacagctggctggcctctgcccaaagccttgctgtaggccagagacagaaagttctaggagaggatggggcatcatgcatcaacgtgtctccatggaaacccttcattcccactccagatgtccagacagggtgatacagcggtgatgcagtggtcgtcctggctgctgtgggctgccgtgcaacagggccagtgtggcacagaggtaccatcggagttcacgaggaaaagggctctgcagggataatcagccagagtaggtgctgagaggagctggacctagatgctctcttgggcttccagaattttccataggctgggcttcagggatcccatggaactacctgaaggcctccctgagggcactgccgccttgtgtgttctcaagtgtcaagtaacacttgcatttggtaactttgtctccacaatggttttccttttcaggggcttggagccctggcccacaaagggagcccaggatacccctgtcccttctgaagaggctctaggcatcacacagcctcctgggctttagcctctctctcaagcaagctcaactgtctccaagccactagaacatcgcccctggggccttggaatagtgtccacagttcatgccattcctgtggctcttcagtggcaaggtgcctgaggacactcatctctgcaccagacatcaggtctgcagagccctgctctttctccagtaccaacagggcctgcttcttccacttctttagagtcctcagtggctccctattgcccccagacagccccagtctctccagactggtagatggtgctgccacctggacttgccaacctctctgttattgccaaccacacccgcatctcagcccagccaagcactcagctgcagacaggaagcatgccaggccctccctactgcctagtgggtcagtgcccttccctcctggcctccttgagagttttcaggctgcatcacgggcgtggaattgcgctgccttcacagagagctgacttggctcacagcaatctgcctgcttctgcttctgaggctggggccgaagccctgtgccaccacagccggcctttgtgttagcgattcccgatggggagggcctcaatcctttgtcccccattctctctttactctagtgtgagcttggagccttttgctggccgtgtgcagtggcctgctacctggcctgacattcatccctggctcctagatcctacacagcatcagccggctatagcatcatccccaaaatctcatgttgacttcaaactctccagtatcttcttgtctccctcgggcacttgttaaaagaatcaaggcttgtagccagctggtggtgcgtgcctgtagctcatcaagagtaagacagaggatcccaattttaagccttgcctgggttacaaaatgaacttcaaagccagactcggtcatgtagtaaggccctgtctcaaaataatacatattcacatacacatgactgggccttagctgagagtgcttgcttagcatgcaccggaccttgggctcagtcccctgtactagagaaagaaagagcaagaaaggatgtgaacagaggtatttacagctgtgggaggtggcacacagtaggtgctttgaagtacttgtgacaagaaagagtacacagaaaggcaggtgacatctatgggcttctctctccactataggagtaggctgtgccagcccctccctggcctgccctgcctccctatctgagctggggctgttgacgtggccaccgtttctgggaaccccagtggctgctgcctaagagcaatgtgtccttggctcccagccagcccagcccagctgtcttgaagacggaaggaagttgcaggcctacttagactggaatctagggtccatcgattcagaagcgaccacaccccgttgacccttgacctttctccctctgcacgtacagcttgtcatatttccatttgccctgtgtttagagtgcatttcaagaagcagcacggtggtcaagcccacagattgtgggtcccatcctagcaatgggaccacagcaggcatccttccaattttgtgcttcagcatccttgtctgtggaaaggcacctgcctcgtagggcatctgcgagttaagccagggtagcagttgccgtcatgtacagctgtgtaggcagaggctcagccaaaggtccgtgcttagattgttgaatttgttcttggctaattttcaccgctcaccctgtaacagatggttactgaacacccactccataatataccaggccgtgttctgggcactagggacaaagtaatgacgagggcagacacgaacctggcttctttaggctaacgctcatgagaacagacccttaactctggtgacaaatgcatgatttaaatgaccagtgccttcttcagggaggcattaagggtctcactgtgttatgctggctgtccttgaatgtagaatccccctgcctccacccccgagatgctgggattacaggcatttaccgccatgcctggccacaggttatcccttacacttccatttcttaaaaaaccaggagcatcctaaaggggttccacgtcttccttctgtcccaacttttttgttaagccattcgtacacttctttttctcaaagcagtggcacgcgggcttgtagggtctttgtgtattaacgctattagccatttgtatgttggttgcttcttctggtcttgtttttattctttccctttgcatggctggggatggaacttagggccctaagttccagcatgagttttaccatcgagccatgtcctcagccccattctttgttcttttcctagtctctctctctctccaccaccagtgctggagccagagacatttttgtttagctcctgagtcagggtggaggctgtgcccagctgaggcaggggtgattgctctggtaacagggccaggagaaccctcagcacatgatgagggccagatgtggctcactggagtgttttggggctgtcaatgagaagggagatggcgtcctggaggcttgtgggtcctcgggagggtgagtggagtcccagaggcgacatcacaggggacttggaatttgttttttctttctctctcaatttaattttatttccaaataattgaggatttagtgcagttttaaaaacaatagagaagtagagaggactccctcagctctagggaggagatttccacccagctttcccccaccacactgctgcccccacctccctgtaccagacatggattgagtccttataactatgtagcaagtgcttttcccactgagcatctcctcagctcctccctgtgttgctttcttacacatttgtagagagttacaggcagggtactggccctggtactggttctcaggtcactcctggcatctccatttccttagagacttgctcatatctaggcttcaggcatgtgggacacaatagagaccaaggacatccctcagcacgggaccccttgtgactccttcaccagcagtcttgggcctcctgcctaccctcatggcccaagcacccaattctaacatatgattttaagagcagtgtgtacagagtcttttaacattcccctgttgcaggtgcctggacatgattctgttagctaggctgctctgaggagctggaggtacgtggccccgggtggagctggtgtggtctgggctgttgagggaagtgatggtacctggcctcattcctcttgtaggaatgactccagccacagagtgtggagggtggcccagtccacatcagcagcccaagacatcttgcagctccagaatgagttttcaaaactgagcctattaaagacccttgatggatgtcattccctataggagggggtctttactactgtgtccacacctgggggtcagaggacccctaaaatggaatggaaaacaaagtgtctgccttgctcacgagggcttggcttgtacccatgctcacatgagtctgtgacccttctgacagtaaggatttgggcttctggaagtcaggggctccaccatgagaacaaattcaaatcccagggccacctatacagctgtgcaacctccggcaagtcactcaacctccctgtgcctttgtcccttcatctgaaaatgagggaactgactgtacctccatgataaagctgggttaagtggtgggaagggacagagggagagatgatcagaagaaaacttagcatggcgttaatagcagtgctagtgaggattgccagagggcagaggtcctccgggacatcaggccaccagagtgttctccaagagatgcacaggttccacttgggcgatgtcaccccctggtcctggggctcggattctgttaataggaccatgaagaccactgttcctaaacaattgctctgccatcagccacctcttcctccctccctccctccctcccccctccctcccttcttcttctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccaggcttcagtgcgtcacacagggctgttgacatttgaagttgacaggtacaagggttattttcatggctcattttatttcattgttaggttctggctggacttctcgaagctgaggagaagcagagggacctggcttctgattttggatctgcgtgcttgctggttctggcgcctgctggtcttgttcctgtaacctaggactcggggcttgcacatgctttttttttgaagttgctggagagggagcccaggaccttgtgcaggtgagccaggtatcctgacactgcaggattgttcatggcatgagacactggtggctggaactggatgcgtgtatgactgggtgtccaccttgggcattacttcctctctgcagctctgccgggcccagcctgacagacaggtccacgaagcagaaggaggcagaactccagaggctgaagaacccagctgtagactcacagctgctcggaggcaaaatgggtctgggactgacccatttagatacagcctccagataatgaggggagcgggggactgaggactgacccattgcaggggggtcactgaggactgacccattgctgcagggggggggtactggggtctgacccattgctgcaggggtcactggggattgtcccactgctgcgggtggggcactggggactgacccattgctttgggaaggcacttgggactgacccactgctgttcatagagtagcacacagctccccatttgcagggcttctctctctcccatcctccctcccaatttcttttctttgctttgatcctcttcctcccgaatgctgggggttggaacccaggacctggaacataccaggcaagcctactgaatttgtgtgttcatttaagcttccagaacctctaagatggggctgtcagtggatggccacttagcagacagggaaactgaggccctgggtacagcttgctcaggttcacagctggtatgggagggagccaggatttgaacttgagaaagttatgaatgtatgccacagctctcctgggacaggcgaatagaggtatgctcgcgtgctctgtgtgcagagggcacagagacatgggggagggaggccatgacacaaatgaaatggaccccgctgacccaggatcagcatctgcccactcttctttctgcaggcaccttttgtgtccccaatggggcggctttgcaccaagttcctgacctctgtgggctgtctgattttgctgttggtgactggatctggtaagtcactcattcattcatcaaccactaatgacatgtcaaggtcctgcagtcctcacggaatagaacaaagctcttgtggggattgggggggaggggggaggaagcagccgatgacaaatcaccatgactaagttattttcattgacactaattcaaattggaaattggggctgtccgggaattgagtagaaaataatttgagttatatgccaaaggttatcaaaagatggtgggaaaacgcagctcaggactgagtaagggaggcttgggggaggggtggagagggagagggcattgcactttaaagcagggtgcacagggacactggtgtcaacttagaggaaggcaggggagggcacacagtgtctgtggtgtgtctttggtgaggcccccagggagggcctgcctggcatgggttgggaggacgtgtcgcagggtcattgagtcagaagaccttgcagagtctgatcagaggaattgagtgaaggccagggtcgctcagtgatctggaaagagagtttctagatcaatctagaaggtcagcatgaagacacgtgggaattgacctgaaggtttctcatccatgtggccaggtgtggcttacacctgtcagcctagcacttgggagactgaggcaggaggattgtgagtttgagcccagcctgggctacaagttactgtaaaaaaacaaaacaaaaaaaaaaaacaaaaaaaaaaaaaaaccaaatggacacacaaattctaccccaagcccagacaagggtggattattctgtatgacgggaaaacccagggtagctgttgaaggagagggttcaggaggttagaattttgtttgctgtatgaaaacttcctgcatggtggaccacacccgctggcatgtgtattgtgactttgtctggacagtggccatgtagggcttgggtcaaaaagctcttgagggtcccacactcactggctgttacacacacacacacacacacacacacacacacacatactcacacacacaccacatctgaattcctggcagggagctgatgggtaagtgtctgtcccctcctccttcccttccctctttcctgctcttccattggctaagcctcttgggtaccaaagggtcagagcctgagcctgagccgtacagattgcagagtcaatctcttgcctcagtggagaagggaggtagggaaggagatgtgggagtggggggcgggatggggggtggggcgcggttgacaacactgtaggacactgccccttcctccctgtgctttaacgtggtgcttctgagggagagtggcacctaggtaggtgtgtgcgtgtgcaggcatgtgtgtcatgatcctgatgcactagcctccctctgaccttagtggtgggagcccctgaccatgccaccactgatctggccgttctgtctctgcagggagcatcaaggtcctgggtgagcccacctgcttctctgactacatccgcacttccacgtgtgagtggttcctggatagcgctgtggactgcagttctcagctctgcctacactacaggctgatgttcttcgagttctctgagtaagtggggtagggaggcagcaccccaaggtctgtccaggcctttgctattccaggtgaacgccagtctatgttgtgctgtatgcttgtggcagcttactgagtggtgtctgaggcggagccaggtctgggataatgtatccagcgtgatactacagttgagcagaacttggagcttggtggtgcagatggtgaggtaggaggatcatgagttcaaggcccacctgggcaatttagtgagattctgtctcaaaactaaaaagtgaaaggcctgcgggtgcagctcagtggtagagtgtttgtctgatggatgaccctgcgttctgttaccagccctccaacccctccccacccccactcccaaccccacccccaggatacggaggacactctgagactctggatcactgtccctgtgtcctatggtttcaatgttggactggatcagcatttctctaacttttgcacctaagttagccagggctagagctacatcctgtctcaaagaaatcacaaatacagttggcaagatggctcagacaataaaggcatgtatctgagggcttgagtttaatcctcaagatccacgtgttagacagagagaaccatgcgaccatttgactggtgacccctgagcatgctcaaccatgggacaagactaagtggaatttgtggtgaaggtgccaggttggcgtccagggattgctctggggcattccctggcatctaggtgctctgtgagtactgtgcctagggcaaaaccaagtctgcagatccagtgctcaggagcatccagagatgcacaacactgccctaatgcctgtggggtggtcctccatcctcctattgcctcaagacaagtgagcgggacttttgcacattggcacagaccaggcactgacaaattgtggacctcacgtcaactagccactacttgttttgtgtgtgtgtgtgtgtgtgtgtgtgtgtgtgtgtgtgtgtgtgtgtttgtgtgtgtgtgtgtgtgttttgttttgttttgttaagataaggtctctctacgtagccctggttgtcttgaaacatgctatgtagaccagactgggctcacactcacagagatctgcctacctctgcctgtgctggaataaaagatgtgcccaaccacagcaggcagactactgcttttatgaataacattttattagcatacgccattgcattcatttatgtcttgtctatggctgctttggagctacatccgcagtttgttgtagacagaaactatatttttgtcaaaagccttcagcttcctatctggcattttatagaaatggagctttggcccttggtgtggtctgtgagttgtgggtggcctgtctaagtggtcctttggcaaaattatatcctgatgtgtacagggcaggagcctgtgggggaagtgtgctagggcttatcacagtcccctgtaaaccaagggatgctggaacaccatgaattactttatgctccatcctggggtgaactaagtcatgggtctgagaaccacagccagaatagcagtgtccagaatgaagtaggcaaggtctgtggccagcgagatgctaaccaagtcatttcctctcgtggtcctgattgctttggtcttcctgtcaggtcgggggtaacctgggaagttgtgggggtcccaggggagtcggtaactatgggtggtcgttctgtaacagagtttctatgtctgcagaaacctcacatgcatcccgaggaacagtgccagcactgtgtgtgtgtgccacatggaaatgaataggccggtccaatcagacagataccagatggaactgtgggctgagcacagacagctgtggcagggctccttcagccccagtggtaatggtaagacttgcctgggtgctccagtgcgggaggtggggtacacattgactgcaggtcagctgctggtttgtcatatgcccttactctacctggagtccctgcaccggtctctaccacaaacttgctccacatagctttgttttgttttgtgtttttgtttgtttgtttgtttgtttgtattattgaggacggaacccaggactccccagatgctaggcaaatgctctaccactgagccaaatctccatgcaagtgtagtgataacaggagttgaaagcaagaatttgttgctctgtgaccaagggcaaatcgcattcctcatctgaacatcagtttccaaaagaaactgattattcttattttgtagatcagagaaggcaagcagtttgcctcaagtcacacagcttctcagtgccagaggcagaattgaagaccacatatctgagacaagagctcatggttttcggtctgtggttagaactgctgctcaggccactgggcacctacaagatactagaattaacccttgaatgagtttaaagtcatcgtcacattgaccttaacgtacactctgctatcgtggtctcatgtgtatgattgcctcagaagtgatgagcccggtgagtcggcacactcctggaatcccagcattcaggagtctaggaaggagggtcaggagttcaaggaggtgaagttgttaatagggacatcaaagcaaaacagatctcagggatcaagcctctcacccaggtgcccttcctccccagtgaagcccctagctccagacaacctcacactccacaccaatgtgtccgacgaatggctgctgacctggaataacctgtacccatcgaacaacttactgtacaaagacctcatctccatggtcaacatctccagagaggacaaccctgcagaagtgagtgggcgccacggatccctgcccttgcctgggcacaggctgggaaggatgctccgtctttggagtagggtgcttgggagggggtatagtgaactagagagctcactctcggccaggctctgccccaggcatgtccgtccccttcctggccctgaatttgcagtgtgtagctgtgttggccagtgttctgtagcttagacaaagtgccgagaaaaatcagcggtaggaggaaacgtctacttgaatgcctggtttcctagagatcagtctgtggtctcatggccccattactctgggtatagtgttgaggccaagcgtcgtagcagaagcatggtggagcagagctgctcagctcatggtggccaggaagcagacacagacagatagacagacagacaggcacacacgagcatatgtccactttcgtaatattccctgagaacattctcctgactccctgtccacacactaggttccgccatttcacagtagctccactctaggaagcaagcctttaccacatggacctgagggaacagtctgagtccagaccacagcatcaggaagaagactcatccctgccatcttaactcagaaagggggcttttgggccacacctgcttcccagccagagacacatgagattatgtgtggcagagtagtcacttcactcttggtcacatttgctattgtgtgttgttcatggcgacccgtcgtaagtgcatagataggagtagaattgagctgggtttagtggcccatgcctgcaatcacagctctcaagagattgaggcagggggatgggaagttcttgactagcctgggttacatagaccctttcaaacaacaacaataacaaacaaaatccttctaccttccttccccccccaaaaaataatttctacacagcaggtgtcatcagatagacgaagtcaggtgccgatagtggctgcctggtccctgctttagaaacaggcagaggtcatttcctgctatgcttgtcttcctcccctccttcctagcattccctctgctgggatgaccgggaaccagagtgacccctctgaggtcacttactcaatctcacacagcgtagtcttactttatgatatgttcaaacccagcttaacccacttgtccagataatagttgctaccagtcattggagaagtcaggggagggctgacaacctccatctcattctccccttagcagtggcagggatgtgggaatgatcccatttccagcactgagggagtacccagggcagcagccaggctgggaaccgacacacgtgtctgccagctctgtattcatatgtccctgtcttccttcagttcatagtctataatgtgacctacaaggaacccaggctgagcttcccgatcaacatcctgatgtcaggggtctactatacggcgcgtgtgagggtcagatcccagatactcactggcacctggagtgagtggagtcctagcatcacgtggtacaaccgtgagtatcagggtcgtaggctgtgaggatctctacagccgtgtatattctctgttcagaaattccctctggctgaccgtggcgttttccgttctaggatgcctctaactatacatccctgtggctgtggtgtggtgatccgagggctgcactaacacacagatttctgtggttgtcactgttcagggccacagaatgactgagtcttctttctatacagtatgcagtagctggatagtcaggactggggaaggttgtgtgaggttgactcggtggtaccgctgaggaggaaaagggcttgtccagagcaggcgtgatgtacagcgcacattgtttttttcagcaagtaatgaaaatctgtgactgagtgaccttgggggctgcggtggtgaggagagctcacgggaatcctggagcagtgtagctggcgtgtcaaaagcagaaacgcaggagatgggtcagtgcgccgaggcccggagtttaaatccccagagcccacgtaaaagccttgcgcagtagcacgcatgcgtaatcctgatggagcaattaggagaagccggtggccggctagcctgtgcagactgtgaaaacagagcatctgaagctgtgtgaaaggctagctcgcctgtgctcctcagatcctgacatacgccatctcgagcaaaagattaacaatcgattaaaacccacacatgaaaacaaagaaaccagttagctccagataaaagcaaatgccaggaaggaaaggaggcagagggcaggggtggaggagcaggtgggagaggatgacgtcagagaaatctcagtggccgtgaacaaggaagatattccagggcttgttctgaatgtgtgatcttttaaaccatgtggccctcttagcctgtgagaaaagtccatttctagccctgctgaacagagaagcccaggggagcaaccaactggccttcggtcactcagcaaggacctagtagaggctggctttgaacttgagccctccagggcacttgacctctgagctttgggaaaacaagcgaggcagcttcacgctgttgtgatctggacttggatcagggccagtgaggacagggacagggatgggtgtgataaggacttggtgtgtaagagggagagttggggagacaggtgggagggctatctgtagccaggtaaccaagggtcccaggggaacccccagtgtggacgcggactgcacatgacacagggcggcctccccattcatgactgtttttctccttgcagacttccagctgcccctgatacagcgccttccactgggggtcaccatctcctgcctctgcatcccgttgttttgcctgttctgttacttcagcattaccaagtgagttcctgctttggctggtgtctctggctggcccttcagcagtgctctcagaggtcacagtcattgtgctggctgagaaaaggctggaagtctgcctcgaagggcagggcagggcagcctgtggctggaggcttctccacagtggctgtgctctggaataaagagagctaggttgggggacagtaatggtggctgctctggagagaaggagctggcttggggctagggaggggttgtttggggcatagagaagatgggagctctgtccctctcaatgcccatggtatggtcccggcactgggcatgtggtaggagcagaggaatttgagcagatgctgtgaatatagtagggtttgagtgagacccggaagtggcgcttgctggcaggtagctggtcagctacctgggctcctctgtgggctcagagtgaccatgagaacaagacctccagaggagtctgggcagagccggtagagggggaagattcacttctggtgagttctaccttggagtctcagacccagagccatgttcttttagaagtgagattagaagtcacttcgaattagggctgtgcaggtacccggtacccgccgcctggctaagtgcagggagtgccagagcctctcctctccgtggcttgccactcataacctcgtcagtcacccggggctaggcactgctgttctgatgcagagtttctctgtgtcctgttgcccttcccttctcccacgtgatgcccctgcaccccgcagcccgcagttctcaaaggcacatggcacgttcttccatagagtcttagccatgcccccaccctaaacgttctgccccttcacttttctgggctgttccctgcaacccccaactctgcttctctctcctaccttcctctcttatacattgtggtcttcttgtttgtctttttaattgttttgaaacccagggtcttacacatgccaccctatctctgagctccactctagcctcctgcttacttttgcttggagacagggtcttgccaagttacctaggctggtctccaactctcctcagctcaggaaggtctggcactttgactcttcctgccctgtctcctgagtggcagggatgatttccggtcaccatccctggctgtggtttttgctcatcagcacttatggtggtgaatgagtgtcatgtgatcatgcctgcatttgcttcttgtttctcttgaaggcgacccacaggggcttctccactggctgtttttctggcttagtccctgtggccctagtaccttgatgctcagaaaatactatgggaagacggaagagtgaaagtcataggggccagttagcccaggaagaaaggaaatgcccgcttccacacggcccctgacctctcaagcctgttaaagccagcatggtcaaaagggacttttgagggagcgggatccttgctgtatagcttgaggctttggtagtgtggataggtcaagcagccctgccagcatcaggctctccctgggcacctctcccaattcagaatggtagtggtgatggacagttaggaccaagattgttccatatccaaaatgggatcagtgtggccttcgtgccctgggaggagtgacggccaggacacttggaagagcaccttggccactgtacattcggagaccaacctacttcctttccaccctcaggattaagaagatatggtgggaccagattcccaccccagcacgcagtcccttggtggccatcatcattcaggatgcacaggtaagagggtacaggcgttgcatagtgtgactcccagccatgggtagggtgggtgggtgcgaggagcaaacggccaggggtaagcagggtggtgcacgggtggtaacaaagcccatgcccacatctgtgtgggcttggtattattcctgccatgttctgctagtcacagtgaagtcctgtgtccagatcagagagtccaagatggcaccggcaagctggagcatctgagggcatttgctatctctgatgccctttcactggtgtggggggcagggagggcagaggctgagactcccagagctctgtggggcctgtgtggatctcagctctctaggcatggttgctgtctgtgaaaacactgagccttctgtgactgggttgtgctggcaccccccacccccactgattggctgtctattttaggtgcccctctgggataagcagacccgaagccaggagtcaaccaagtacccgtatgtatctgaacttgaacttgggtcatagtttttgtgggtttgtgtgagaatgtgatagttactcggctggtggcaatcaattccccttccttgccccccccccccacacacaattgccttctctcttcctggccccaaggggggagaagggggcaatcatgggtggctgagtctccattctgcagcaagaacaggctaagtgttgattttaagagtcagaaccacatctataacaccccaatatcaatacagggtgattccgtgtgggattctaaaggatgaatagttttttaaatgtggcaaaacttaaccctcagctttacctctgcaggcactggaaaacttgtctagacaagctgctgccttgcttgctgaagcacagagtaaagaagaagacagacttcccgaaggctgccccaaccaagtctctccagagtcctggaaaggcaggctggtgtcccatggaggtcagcaggaccgtcctctggccagagaatgttagtgtcagtgtggtgcgctgtatggagctgtttgaggccccagtacagaatgtggaggaggaagaagatgagatagtcaaagaggacctgagcatgtcacctgagaacagcggaggctgcggcttccaggagagccaggcagacatcatggctcggctcactgagaacctgttttccgacttgttggaggctgagaatgggggccttggccagtcagccttggcagagtcatgctcccctctgccttcaggaagtgggcaggcttctgtatcctgggcctgcctccccatggggcccagtgaggaggccacatgccaggtcacagagcagccttcacacccaggccctctttcaggcagcccagcccagagtgcacctactctggcttgcacgcaggtcccacttgtccttgcagacaatcctgcctaccggagttttagtgactgctgtagcccggccccaaatcctggagagctggctccagagcagcagcaggctgatcatctggaagaagaggagcctccaagcccggctgacccccattcttcagggccaccaatgcagccagtggagagctgggagcagatccttcacatgagtgtcctgcagcatggggcagctgctggctccaccccagcccctgccggtggctaccaggagtttgtgcaggcagtgaagcagggtgccgcccaggatcctggggtgcctggtgtcaggccttctggagaccccggttacaaggccttctcgagcctgctcagcagcaatggcatccgcggggacacagcagcagcggggactgacgatgggcatggaggctacaagcccttccagaatcctgttcctaaccagtcccctagctccgtgcccttatttactttcggactagacacggagctgtcacccagtcctctgaactcagacccacccaaaagccccccagaatgccttggtctggagctggggctcaaaggaggtgactgggtgaaggcccctcctcctgcagatcaggtgcccaagccctttggggatgacctgggctttggtattgtgtactcgtccctcacttgccacttgtgtggccacctgaagcaacaccacagccaggaggaaggtggccagagccccatcgttgctagccctggctgtggctgctgctacgatgacagatcaccatccctggggagcctctcgggggccttggaaagctgtcctgagggaataccaccagaagccaacctcatgtcagcacccaagacaccctcaaacttgtcaggggagggcaagggccctggtcactctcctgttcccagccagacgaccgaggtgcctgtgggcgccctgggcattgctgtttcttaggtgagtgagtgtgctgttgttgctgaggtctgtgctgaggccagggttcctccaagccagggaagtacttcctgggagacagcccagctggcaggtttcccagaaatccagagaatggtgaattgaagatgtaaacttggcctgaccctggacgctcggagcctggctgtctcctcttccactggcctgggctctcctccctcccaagggatacaggggctcactgtgcttggtcccacagcagtgctgacgttcctaagtcctgggctttcctagctgatgttgtcctacctactcagtcccattttgtccaccgaatagacctgtcactcaaggctctcagcggtcctgccatagctgctggacgctcccagctggaagctgggcctagaaactcacagatggcctggcagtggcatgggaggccctaaaaattagtggaaattttgagagaggacaggtattgccccacagaggccattcattgaacagccaggactgggactagaggcagagcctgctgtcctccgctcagttgtagaaagcaacaaggacacaaacttgattgcccaaagtcactgccagttacccacatatgaccagaagccagggctcctgggatgtggaagataaacaaacacagttgccgggtggcagggcccagcgggcacgataactggcagtcaaggcgatacctcgagggaactgtggggctggtcctggttggtggtcaggtggtagggatagcagatggcagactttggtgagtgagtgagtctgactgtgttctggaagatgggaccgggctcagcactgtctgctcacgtccccactgttgcaacacctagtctgtttgcaaggaggacaggacaggtcacatggagctttatgtcaataaagtctttatcttgtcaggtttcctttactatacacacgccgagcccacagtgcacgaaagctgaaatgtgcaggcagggggttggggaagtggggagacaaggccccagcagttggtttaagggaatgacttgggaatggggcagagctgtggctactccatctctcatccttaccctcctgctaccacagcttgtgcccatgtgtgcctgctcaggggaggggtcctcctctttccctctcctttaggcagagtgctagaggtgttggatgctccttagcacgcagagggcgtgacactggctgctaagtgttgttgaatgtgtcaaggcattgacatcagtaggccccacatcttaggcaggggatttggggtgtggcaacctgccaggccagcagagaacttgaatatgatgttcagaaggaaagacagagacaggtcacttagggaggcttgaaggaggccacttttgagatgagcccgtggtatctgcaaaaaagcctggaagaactcagaacatgcagcagatggctcatgtctgaagtttgaggcacagggatctggtgtggtcacagcatcagagagaagggtcctggcatgatggggactggtgtgcagttggatactggtattctgccttagttctgcctcttgagaggtggtccagtagaagccagcctcagactttcacatctcagaacagtcttttcaaagacaaggtctcagtgtggctcagacgggcctctagcatcactcggtctcctgagtgctgggatcacaggtgtgtgctactacacccagcttcccagagcagtcttaccacagcccctaagcaggggaggagaggaaacggagccatccaagatctacctcctgtgggcatccctcctgcctggctgaaggagaagtctgggtttaaaatccccattgctcagatttgtatcctggagggaagtgactcccacaggaatgaactgactgtcccaggaaattcttcccgctgtgcctttagaacttcctctgtaaagtacctcccttcagctggtggtgcctgtctttaacagtggctgacagccagggagtttgaggctagcctaggctttgacagtgagatcctgttcaataaacgcagcttcccagtccggcacttgaccttcaagctctgacctctggattagcccaggatttcttcactggtcctccaccttccacccccttccactgcttatacccgctcccatcatttccaacccaggaagctgctaagatctatgtggtagccctggctccattaccaccctctccccatctcctgggtgactgagggaactaaggtacaagcccgaggaacttgggattccctgccctgctgttaccttgcctcctgtctgccatcattaacataggaggtgccagcctgtgccgtcctggctcccatactcactacctaaggctacctgttgggaattccaaccctcaccagtcccatctcttcattctattaaaattacttatcaagcaacttctctcagagagacaattattaaattttctcagatcgtgagcacaaatcaaaattttatttcgaatttgcagaataagaatcaggactcatggagaaatgtatgtgctagttatatttcgcaactggtgaaagacccagagaatcagcctataggacagacctgttttggctcatagttcagtgtattccttccaccatggtggggatagcatggtggcctcagtggctctctgctggggaaagaacttgcactggggtttgtccgtaccctagtgaaaggaactggaggtggccatcgccttcaaggcccactggtgtcactcttctgctagaaaggcccagtgtccaaaaggttccaccatgtcctggaacaatgtcaccacctgggaaccaggtgttcaaaacacgagctgtgggtgcacattttatagccaaaccataggacactggctcaaagctcaatccgaggaaggagctttgtaagcaagtgactgtgtacaacggctctgccccacagagccgtgtgctgagatagaagctgccgagactgcttcctgtgctctcaccctgtaccacgcacaagtgagttataaagaaaagaggcttttttcagttcataattctgaggtcaggaggtggaatctagagatggccttgctgatggagccctcaggggagtcagggcaccccataggagaacatgtgtgtgtgctcatgtatgtgtgtggtgtgtgtgtgtgctcatgtatatgtgtgatatgtgtatgcctgtgtatgtatgtggtgtgagtgtgtgttcatgtatgtgtgtggtgtatgtgtgcttgtgtgtgtgtgtgtgtatgtgcaagcacactcgtgtatgcatgtggtgagtatgtgtgtgctcatgtatgtgtgtggtgtgagtgtgtgttcatgtatgtgtgtgtgtacaagcatgctcatgtatgcatatggtaagtgtgtgtgtgctcatgtatatgtgtgatgtgtgtgtgcttgtatatgtgtgtggtgtgtgtgtgttcatgtatgtgtgtggtgtgagtgtgtgcttctattatgtgtggggtttgtgtgtggcatgagtatatgtgtgtgtgctcgagtatgtgtgtggtgtttgtatatgtgtgtgttcatgtatgtgtgtatatgcatgtgtacttgtatatgtgtgtggtgtgagcgtgagtctggtttctgtgtatagtccttatgattccagggcctgctctaatgagtttacctaaccctgatcccctcccaaaggcctctctaaataccacagtgactaatttcctcctcttaatccctctccacaagcattcacatccagtcaagtttcccagggggacacaccagattcaaaccacacaggaaatgcttcccagtacttagccaggttccttggaatgcagctggtttgactgaggagttgaaattttcacttaaaatgaacaattttatttaagtttattggcatctaagctttgtttctgtgtgtttttgtcaacagcctccactaagagaggacagggaaagatctagaaaaatgaaaaaagaaaggacccaagggttggtgtgatgtctgtagagggttcctgcgcgtggcgggcgcagccaccaaggtgttgtgagctgggattttcccagcagcccccgctgtgctggatgccctggaagccacgatgatgctttaacttggtggaagaaaacgctgtttgcgcttattctggttccggcctcgtgggctgccgcggagcgcgcgtagcctgttcaactttcctgacataaatttcccacttaagtcattaagtcaaaaccaaaaaaaaaaatcccagaccacagggcacggttctgttcaccgcgggtgcactgcgcgctgtgggttcacagcgccggtgacgtcgcggatttgcggtgataccacactgagctcaagagacgtcagtgtccgtgggaccgtggacatggcgtgacaccactctggggtgaaacgcgggaaaaatgaaggcaggagcaagtgatgcccagcaactcctgtgtccagagggaggggaagggaagggccgtgcctcagtccctgctgccccctggtggcccgcactgtctcagcaccagcctgcgttcctggaactccccaactgcggcccaagtaggtgcagcccagcttctgcttgtctctgacaatgctcctgctctggagaacagcacagacattcaggataccctaaacccaactgtctggcaccgggccagtctgcaacttatctgagctcacatatgcatctgtaattgacacctgtctcacgagcccgtggtgagaattaaatacatcaccacttcagtgagcccctggagtggctcttgcacacaaaactctttaaaagcatctgctaagcttattcttgatgtccgactgagtgcgtctgggcagtgcgggagttgagcagtaaattatgctcaaggaaaatggcacccttaatcccaaagacagcacaagtccaggataaaatgtgccccgctgtcaccaccctgtgtctgcacatgtccccatctcgccataggctatgtgcagagtgactcttggctgtttttcctttacagtgctggggtcatgagcagaggtcctcacagcaggcaagaactccactgcagaaccaccccaatccctctgccattacatagcaccaacttctcataggtccaggtcctctgtcccagctccttccatgcagacccagatccaggccctcatatagagcaccactctgtaatgttatgactttgtggtctgggcacacatctgtattgcacactgtcctttgtgtctgtcccttgggcctctgatgagttctggctactctgacttaccctccttgctacagttctgccatgatttccagctgaccaccgaggcccaagtcactctacatggttttttgtcctttgctaccatgggaccacaggccacactgacagtcctccctaatcaggaaaagcagcaggagaaagtcctttgccgttttctttccactctgcgtgtaatgtatggtgctttgtcgtccacactgtggtcatgaagagacagtatcgagatggaagataaaggcaaatgaggtgcggcagagagggaaaagtcctcgaacgcatcatctaatcgtcaaaccctgcctcctgagtctaaagccatgtgcttttgtttaaacagaaattcctttgcaaaggtaacccaatcttcagtgttgtagcggatggaacaaggaactctgaagctaccttcaactaggcatgccctagttcctggaacctgtgcacatgtttatactttcagggaagcaatgaatgttacagtcagaataaaaattacagtaccaacccaggggcctccttcttccctgcagccacagggtggggaggggggagggaaggggatgtggtccacttcagtctcttcctcctcctttggatttctccttcctctttcttcttttacgcccccatcctcttcctcttctttcccctcttcctcctctcttcctttctcttctgccacctcttcgcccactaagttaattacaatcctttccaaatctggtcctacagagacaggcaccgtgacttgtaaatgaatgacggatggactgatgtctcccactgtctcttctcagtgcccttgtgtaaaccccagagccacccacagcatctgttgggcatcttcacagccagtgttcagccatgtcagcagcccagctggcacaaggctcatggcacatggacaaccacaattatgggcactatggacccttcctccttctcttccagtgggtcttctcctccaaggtgggctgcagtgctgagacttctgactatggccacactgccacagaatcgtggagcccagaaccatggagcctgacacatagtagctgctcaccaaaactgtcttgaagcagaactgggcctctggtggagtgagtgcagaactcaccgtggctctctggctctctctccttgagccctctctcagttctcctctgctgatcatccacagggtggtacagcagcccacagcagggagtgtgggtttctgtttcagttgtctgcacttccctccgatttatggtaaagataccatttttccatcttggggagatgaagtttcttttgaaaataaagttaattaaataaaacactcaaaacttttttttttttaggcctagagactaataacaggaaaagtataacaagggggttaggaaacagctctttgggcaaagtgcttgctaaacaagccagagaacctgacttcagatcctcagggcccatgtagaactccagatggcaccacgcacctgtgaccccagtatgagggaagcagcaacaggaagatcccggggccaccgacagctgggtttggagccagtaagctccaggttcaataagagatcctgcctccaaaggtcaggtgcagagccattgaaaaagacaatattgacctctggccttcacaggaatatacaggggcacccacacatgtgagtacacacaagaacacccatgatcgcgtgcacacacacagggaaaggagagggatggagagagagcacgcacacagatacggcatgcagctgtgcacacaggaagcaatccacagccaggtctccccacaccaagaccccactccctcactgctcaccacttcctactctgtgacctgtgaactcttacagccttagctagtgtgaccctgccacattatgcagggttagaccctggcctccctggtgggcctccctctgtccagcctccccacgtctccagtggcccctgcttcacaggaccctaccctagcacatcacagtctgtcctcttgatagagtggcctccttggggaccagcttgtaactcccagttcacaggcttctgtgggcctgatgaaacccccccccccccaacgctcctgcatgtgtctcatgctcagccaatcagagaattcccttctctacctggtacagtggtagctttgtacagggagtcatgtggttaaagttgaccattgagagcattcccagaactagtactggacttactgggtgctttctttgggctccacaggcttgtaggtgacaaacctagtcttctgacactcctacaaccaccactttctgttcctatcgaagctcaactgtctatgcgaatgaaagaagtcccagaacgcaagccttctactttgaaggaattcatccccttgacccacacatgcataaaaccaaccttttaaaacaagccagtaaacgtacttaattttatcttggttcagggtcttaccatggagccaggttgtgctggaagcatgctcttgctcctgcctcccaaatcctgggattgcagatgtgcatcagaattcaccttgaaaagccagttctgaacccagggaggtggctcagttgagaaggtgcttgcttgcttgccatgcgtaaggactgcatgattcattcattttacccatgtaaaaatccagggtgggggtggggagtgacaggcagatgcgtgtgcctatgcatgtgtctgtgtgcacgtgctcaatagttagccttcctagccaaatggatgagttccaggttcagtaagagactctgtcaatcaatcaatcaatcaatcaatcaatcaatcaatcaagtggagaataactgatgaagacatctactatcaatccttggtctttgacctgtgcacacacatttgaacaccagcatatacctacacatgtacacacacacacacacacacacacacacacagagtagttatgttctttgtagccacaggactgattgaagcagagattagtcttctggggaagggacacaaaagcctcaagttccctacgtagccaaggacaaccttgaacttgatcctggtgctccatctcctgagtgctttgagtatagacagtgtggccttggtgggtttatgaggtcctggggacctactactacctgtagtagtttggagacaaaaaggctatttggcttatacctccacatcacagttcatcaccaagggaagccagggcaggaactcagggcaggaatctggaggcaggaactgaagccaaagtcatggaggagactcttcctggcttgctcctcatggcttgcttagactgctttctctttcaactcagaaccacccacccaggggtggtaccacctacagtgggctgagctctcccacatcaaccactaatcaagaacttgctacacaacatacctatagggcagcctgatggaggtgattcctcagctgagggtccgtcttcccaagtaattcctgtcacattaacaaaacaaacaaacaaacaaagaaacaacccagagcctcatgaaattatcattcattaagattgaattcatgtaacagaaaatgtaccattttaaccattaaaaatatagattccagggtggtcacatggctcagtcagtaaagtgctgactgaaggggtctgaagacctgaggtcttgtcccctacacccatgcaaaaatatctggatacagtggcaggcccctttaacccagctctggggatgcagagacagggggcttcctggtactcacttggccggccagtttaattgaactgggaagctccgggttcagtggatataaggtggagagggacaaagaaaacatcaacattaaccttaggcttccacatgcacacacgcgcgcgcacacacacacacacacacacacacacacacacacgcacgcacacatgcacgtgcacacagacacatgcataggcacacgcatgcacacacatacatgcacacacacacacatgcacgtgcacacagacacatgcataggcacacgcatgcacacacatacatgcacacatacacacacacatgcacgtgcacacagacacatgcataggcacacacacgcatgcatgcatgcatgcacacacacacgcacgcacacacatgcacacgcacacatgcacacgcgcttgcacacatgcatgcacacacaatgcacgcatgcatacgcacgcatatacacacacgcatgcacacatgcatgcacacacacgcatgcacacatgcatacgcacgcatgtacacacacgcatgcacacacacgcatgcacacacacgcatgcacacacgtgcatgcacacacgcatgcacacgcatgcatgcacacacacacatgcacgtgcacacagacacatgcatagtcacacacatgcacacacacgcatgcacacgcacgcatgcacacacacacgccatctagcaggatttagtatacttaccctgaacttcccatcgctgtagaactctgggacaactcctcctcggcagctcctccagatgcaccactgcccacccacacccagcacccaaagcatcgccctctcagcctcagcctccatggtttttccatctgaggctttgaaaacagaatttttctctccatgctcacatccatcttttatcatttattaattatttgcttctttgcttgagaaggggtctcgctgtgttgtccaggctactctgaggccctctctttttaatataccatttgtatgaactctttgagactatcacgcatgcatacccacagtacattttgatcctattcatcctcaacttctccccctgactcccctcagatttacccctcacccaaacccactgtttgttgattggctgattgatttacattgttggtaagccatccttattagacaacacttggattgtgtgtgaaggactgtgatggggaggagcagaagggactttagtggaaccgatcacgttccacattaacaattaattaaatgcagagctaaattgacagttgcatgccatgggtgtgggtaccccgtaaaaccatctacaggttgaatctgcttcagacacttcaaggcaaaggagtgggcagacaaaacagagcaggtatgtgcgcattggctttctcatgagactaacgacatttgacgtgagtgggtccttgcaaagcctgatgagcggctctggctcctttaaggactccacagaggctgctgggcagcccagggggaatggggcttgcttccaagcctggcaacctgggacccaaatggtggaaggtgagaaccaacccccacaagttgttctctggcttccacacacacacacacacacacacatacacacacacacacacacacacactcacacacacacacacactcacacactctcacacacacactcacactcacacacactcacacacacactcacactcacacacactcacacacacactcacacactcacacacacacacacacacacacacacacacacacatacacacacctaactggaaatggttcatgtgggacacatgcttcttcctgggactgtgacaatggtcttgtggcctttcagctcaaatgtcaccaccatcaggagg

SEQ ID NO: 1010 - DNA, 3696 bp, Mus musculus
cgcaggaaagccccgcgcggcgcgtggagcctgaactcgcaggttctggctggacttctcgaagctgaggagaagcagagggacctggcttctgattttggatctgcgtgcttgctggttctggcgcctgctggtcttgttcctgtaacctaggactcggggcttgcacatgctttttttttgaagttgctggagagggagcccaggaccttgtgcaggcaccttttgtgtccccaatggggcggctttgcaccaagttcctgacctctgtgggctgtctgattttgctgttggtgactggatctgggagcatcaaggtcctgggtgagcccacctgcttctctgactacatccgcacttccacgtgtgagtggttcctggatagcgctgtggactgcagttctcagctctgcctacactacaggctgatgttcttcgagttctctgaaaacctcacatgcatcccgaggaacagtgccagcactgtgtgtgtgtgccacatggaaatgaataggccggtccaatcagacagataccagatggaactgtgggctgagcacagacagctgtggcagggctccttcagccccagtggtaatgtgaagcccctagctccagacaacctcacactccacaccaatgtgtccgacgaatggctgctgacctggaataacctgtacccatcgaacaacttactgtacaaagacctcatctccatggtcaacatctccagagaggacaaccctgcagaattcatagtctataatgtgacctacaaggaacccaggctgagcttcccgatcaacatcctgatgtcaggggtctactatacggcgcgtgtgagggtcagatcccagatactcactggcacctggagtgagtggagtcctagcatcacgtggtacaacccaagtaatgaaaatctgtgactgagtgaccttgggggctgcggtggtgaggagagctcacgggaatcctggagcagtgtagctggcgtgtcaaaagcagaaacgcaggagatggacttccagctgcccctgatacagcgccttccactgggggtcaccatctcctgcctctgcatcccgttgttttgcctgttctgttacttcagcattaccaagattaagaagatatggtgggaccagattcccaccccagcacgcagtcccttggtggccatcatcattcaggatgcacaggtgcccctctgggataagcagacccgaagccaggagtcaaccaagtacccgcactggaaaacttgtctagacaagctgctgccttgcttgctgaagcacagagtaaagaagaagacagacttcccgaaggctgccccaaccaagtctctccagagtcctggaaaggcaggctggtgtcccatggaggtcagcaggaccgtcctctggccagagaatgttagtgtcagtgtggtgcgctgtatggagctgtttgaggccccagtacagaatgtggaggaggaagaagatgagatagtcaaagaggacctgagcatgtcacctgagaacagcggaggctgcggcttccaggagagccaggcagacatcatggctcggctcactgagaacctgttttccgacttgttggaggctgagaatgggggccttggccagtcagccttggcagagtcatgctcccctctgccttcaggaagtgggcaggcttctgtatcctgggcctgcctccccatggggcccagtgaggaggccacatgccaggtcacagagcagccttcacacccaggccctctttcaggcagcccagcccagagtgcacctactctggcttgcacgcaggtcccacttgtccttgcagacaatcctgcctaccggagttttagtgactgctgtagcccggccccaaatcctggagagctggctccagagcagcagcaggctgatcatctggaagaagaggagcctccaagcccggctgacccccattcttcagggccaccaatgcagccagtggagagctgggagcagatccttcacatgagtgtcctgcagcatggggcagctgctggctccaccccagcccctgccggtggctaccaggagtttgtgcaggcagtgaagcagggtgccgcccaggatcctggggtgcctggtgtcaggccttctggagaccccggttacaaggccttctcgagcctgctcagcagcaatggcatccgcggggacacagcagcagcggggactgacgatgggcatggaggctacaagcccttccagaatcctgttcctaaccagtcccctagctccgtgcccttatttactttcggactagacacggagctgtcacccagtcctctgaactcagacccacccaaaagccccccagaatgccttggtctggagctggggctcaaaggaggtgactgggtgaaggcccctcctcctgcagatcaggtgcccaagccctttggggatgacctgggctttggtattgtgtactcgtccctcacttgccacttgtgtggccacctgaagcaacaccacagccaggaggaaggtggccagagccccatcgttgctagccctggctgtggctgctgctacgatgacagatcaccatccctggggagcctctcgggggccttggaaagctgtcctgagggaataccaccagaagccaacctcatgtcagcacccaagacaccctcaaacttgtcaggggagggcaagggccctggtcactctcctgttcccagccagacgaccgaggtgcctgtgggcgccctgggcattgctgtttcttaggtgagtgagtgtgctgttgttgctgaggtctgtgctgaggccagggttcctccaagccagggaagtacttcctgggagacagcccagctggcaggtttcccagaaatccagagaatggtgaattgaagatgtaaacttggcctgaccctggacgctcggagcctggctgtctcctcttccactggcctgggctctcctccctcccaagggatacaggggctcactgtgcttggtcccacagcagtgctgacgttcctaagtcctgggctttcctagctgatgttgtcctacctactcagtcccattttgtccaccgaatagacctgtcactcaaggctctcagcggtcctgccatagctgctggacgctcccagctggaagctgggcctagaaactcacagatggcctggcagtggcatgggaggccctaaaaattagtggaaattttgagagaggacaggtattgccccacagaggccattcattgaacagccaggactgggactagaggcagagcctgctgtcctccgctcagttgtagaaagcaacaaggacacaaacttgattgcccaaagtcactgccagttacccacatatgaccagaagccagggctcctgggatgtggaagataaacaaacacagttgccgggtggcagggcccagcgggcacgataactggcagtcaaggcgatacctcgagggaactgtggggctggtcctggttggtggtcaggtggtagggatagcagatggcagactttggtgagtgagtgagtctgactgtgttctggaagatgggaccgggctcagcactgtctgctcacgtccccactgttgcaacacctagtctgtttgcaaggaggacaggacaggtcacatggagctttatgtcaataaagtctttatcttgtc

SEQ ID NO: 1011 - protein, 617 aa, Mus musculus
LSDLGGCGGEESSRESWSSVAGVSKAETQEMDFQLPLIQRLPLGVTISCLCIPLFCLFCYFSITKIKKIWWDQIPTPARSPLVAIIIQDAQVPLWDKQTRSQESTKYPHWKTCLDKLLPCLLKHRVKKKTDFPKAAPTKSLQSPGKAGWCPMEVSRTVLWPENVSVSVVRCMELFEAPVQNVEEEEDEIVKEDLSMSPENSGGCGFQESQADIMARLTENLFSDLLEAENGGLGQSALAESCSPLPSGSGQASVSWACLPMGPSEEATCQVTEQPSHPGPLSGSPAQSAPTLACTQVPLVLADNPAYRSFSDCCSPAPNPGELAPEQQQADHLEEEEPPSPADPHSSGPPMQPVESWEQILHMSVLQHGAAAGSTPAPAGGYQEFVQAVKQGAAQDPGVPGVRPSGDPGYKAFSSLLSSNGIRGDTAAAGTDDGHGGYKPFQNPVPNQSPSSVPLFTFGLDTELSPSPLNSDPPKSPPECLGLELGLKGGDWVKAPPPADQVPKPFGDDLGFGIVYSSLTCHLCGHLKQHHSQEEGGQSPIVASPGCGCCYDDRSPSLGSLSGALESCPEGIPPEANLMSAPKTPSNLSGEGKGPGHSPVPSQTTEVPVGALGIAVS

SEQ ID NO: 1012 - DNA, 70779 bp, Homo sapiens
  misc_feature (1)...(70779): n = A,T,C or G
tctgaccaagctctgtggcactgtgtccagagaaaccggtgtactagttgacttaggttcgggccacatgctccaatcctaggctgggcacggagccccatctcgacatatgaatggagaggggcggttcggaggtagcccccaggggcaaagcagggcttttgccgagcaacaacgggacaaatctacatgggagacaagctacccaaatccactataaacaatctctgcggcttcagccaactagctgaaaaggaagaactctgggagctgacaggttgtcgtcctgcaaacaggtgaggctgttcttggaccatagaaaaccttctaggggagccccattgttccaagaactagtcccttaactgtctggggcttcagctcctcctctgccacttcctgggcagtcatgggtgactcactaaacctctccaggtctcagccacattgataacttcattgtccatccatccatccatccatccatccatccatccatccatccatccacctgttcattcattcactaaacatttataagcatttaagtatgccatgcactctgtagattctgaggataaacacagttgttcacagctatatcacagtatctagcacagtgcctggcacatagtaagtgctcaagaaacactgattcaaggaataaatgaacaagataaagtcactgcactcaaagagctgactgtctaatagagaaaacagacacttagaattacaatatactggacacctatccaatgtgcttcgggtaaacaggaaggagcttgtctggaaggctgaagaaggctccactcaggaagtcacaggccttcaaggagagggggatttcagcaggctgagaaaaagaggcagcacacagccagcccagggaatcatgtcaacaatggcacagaactggaggagaagaaattaatttttttttttcgagacagagtctcactctgtcacctaggctggagtgcagtggtatagtcttggctcactgcaacctctgcctcccaggctcaagcgattctcctgccttagcctcctgagtagccgggattacaggcacccgctactacacccagataactttttgtatttttagtagagacagggattcactgcactggccaggctggtctcgaactcctgacctcatgatatgcccgccttggcctcccaaagtgttgggattacaggcatgagccaccgcgcctggccaaaattaatattattaatcactttccatggaccagacattttatttttgcctttacactcttagaaaggactagaatttatccaccatgaaatcttggcatgcctagactccttctgcctcttgctctcccctcctctgggtctcagctctcacttaaattattgtgatgctccccgccccccaaacccatcagtcaatagttgtgtctccctctggttcaccatccgaatggctgccagagggattgtttcaaatttcaaggctgagcctctcgttcctttgtttggaatccttcaatggctccacatctcctgaaggctgtgtttaagaccttttgtaatatgaccatgaattgcattgcatgccccacccctggcactccctaaggtatacttgtacacctccaaactttgctcccactgctctttctgccttgggtgcccatctccccttctgcctccaatttgggggctatttttactctccagaggacatttggcaatgtctggagacattttggatgtcacaactaaggggatgcttctgcaatctgctgggtaaagattaaaaattctgctaaacatcctacaatgcacagaaagtcccccacagcaaagaattatctggctcgaaatgtcagtagtgctgaggttgagaaatcctgctttgacttttcaggaatggggagcttcagaaggattctcaacagagagtgagagatttagctttggaaactctggcagctgtctgtgatggccaagaggaaggcaggactgcagaccagtgtaaatcatgacctttcttcctcttttcttcctcctcctggaaatcagtgaggtaagctggcaagagtctattgctcttcagccagaaacactaagctctgtgggcactcctcccagatggcaaatgatatctatcgcaacaagcaaagtgaatatgtcacatctcttaggtttctgggagaggtttgtttctcctgagaaagtgtgctcactcacactcaacagctatgggatcttgagagagttactttcctgtctgtgcctgttctcttgtctgtgaaatggagctaataacagtacctacttcttggagttttgtgaggattaattaatatattacaagagcctacaacagggcctggtacgtagtaagtgtggttatatgtgttagctcttaacatcatcacatcttcctccccaccatcaccatcatcatcatcaccactaccaccatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaactgattctaaagttcaaacagaaaggcaaaaagcctggaatagccaacacaatactgaagaacaacaaccaagttgaaggactgacattacctgactttaaaactataaaataaagctacagtaatcaagacagtatggtgcaggtgaaagaagagacaaaaagaataatggaacagaatacagatccccaaaatatactgacacaaatacagtcaactggtctgtgacaaagaggcaaaggcaatccagtgggaaaaggatagtcttttcaacaaatgttcctgaaacaactggatgtctacatgcaaaataataataataaatttagacacagaccttacacctttcacaaaaaataactcaacataaatcgtggacctaaatgtaaaatacaaaattataaaatttctagaagatatcataggataaaatcttggatctcagtgtccttaggtttggcaatgagtttttggatatgacactaaaagtataatccaggaatgagaaaaaaaattggtggtttggagtttatgaaaattgaaaactatattaaatttgaaaatctttgcaaaacacatgtctgataaaggacctgtatccaaaatacacaaagaattttaaaactcgacaataagaaaacaagtaacccaactaaaaaatgggcacaacatatcaacagacaacaaataagatatacagatggcaaaaagcatatgaaaatatgttcaacatcatatgtcattaggaaattgcaaatttcctaatttgcaaacattgacatatgcatcttaagtcactaggaaattgcaaacaatgatgagataccactatacacttactagagtggctaaaatcctcaaactgacaatatcaaaagctgacaagaatacagagcaatggaaactctcacttgttgatagaaaggcaaaatgttacagctagcttcgaagacactggcagtttattgccaaactttcttacttttaccatatgatccagcaattgtgctccttggtatttactcaattgtgttgcaagcttatgtccacccaaaaacttgcacatgagtgttgatagcagctttattcataattgccaaaaattggaagcaacaaagatgtctttcaataggtagaatggataaactgtggtacatccatacaatagggcactattcagccacaaaaggaaatgaggtgtgaagcctggaaaagacattgaggaacctgaaaagcatattgctaagtaaaagaagtcagtattaagagactacatactttctgatttcaattacgtgacattctgaaaaaggcaaaactatggagacagtaaaaaaatcagtggtttccagaatccaggaagaataggtagagaattggggatttttagggaagtaaaactattctttatttttttctttttttttttagagacagggtctcattctgttgcccaggctggagtgcagtggcatgatcatagttcactgcagcctcgaactcctgggctcaagggatcctcctgcctcagcctctgagtagctgggactacagtgcaccaccatgcctggcctgttttttgttgttgttgtttgtttgtgttttttggtagagaccgggtcttgctatgttgcccaggctgggaaactattctttttgttgctacatgtgtggatccatggcattatacattgttaagacccagaacttggctgggtgcattggctcatgcctgtaatcccaacactttgggaggccgaggctggtggatcacttgaggtcaggagttcaaaaccagcttggccagtatggggaaactccgtctctactaaaaatacaaaaattagccaggcgtgcacctgtagtcccagctacttggaaggctgaggagtgagaatcgcttgaacctgggaggcacaggttgcagtgagttgagatcacgccactgtaccccagcctgggtgacagaacaagactctgtctcaaagaaaaaaaaaagactcagaactgtgctgcagaggttaggcacagtggctcatgcttgtaatcccagcactttaggaggctgagatggaaggataacttcagcttaggagtctgagaccagcttgggcaatgtagcaagactgtctctaaaagtataaaaaaaaaaaagcctagtgtggtggcatgttcttgtagcccaagctactcagaaggcagaagcaggaggatcccctgagtccaggagttccaggctgctccagcctgggcaacagagtgagaccttgtttccaaacaagcaaacaaacacaaaacaaaacaaaacaaaacaaaaccccgagaaacagtgaaacaatgtatgctatggactttagtttataataatgtatcagcattataaggaaggcactacacactaatgcaagatgttgataaaagaggaaattttgcatgggggagagggatgtatgggaactctcagtactatcggctcaatttttccataatctacaatggttctaaaaaataaactctattagttttaaagaccgaaaggcttggaaacaagtaagcgtgttaggatataatgaggattgagcttatactgaggcaagacttgggaacccctagatgggggaacagaggttttactatcttggtgcctttggacctgctcccaggactgacggagcagtcacagataaagtctgggcatcttgggcaggaacttgaacagtgggactgtatgcaagaagacatttattatctctcttgcacccgagaacaatgccctgttttctttaactttgtaatttgacataatttcagactggcgggaaagttgggagaagagtacaaagaattcccgaagtctcttcccccagatttcctgaatgtcttagcctctgaccacagctgtgctttctttgcctgtcttctcaatgccacgttcatctccatttcacaaccaagcaacagaccaaggcaacaggcttcgactttgcttctttctcattttcatcctgataagaacagcaattgacattttgaatgcctaatccacgccaggcactattctaggcactgcgatacgtaccttgccatttcaccatttcatagccctatgaggtgggtctattattatccccattttacagatggggaaactgaagcacagggaggatgatctactttgcccaaagtcacatagtcaatacgtagcagagttggtatgccaatgccggcagtctagaggcaagcgaggaaaccgacgaaggatgacttgactgggaaaacaggatgggagcccagtttgggagtccaggaggggatatagcccaagccatacattcccaaaggacttcaaaggtagacttttgctgtcgtctcccgatgacatggggcacaaactcagaaacacagacaggacaaaggcagcttgcagggctgaactgcctgggatgaagcatcaaccgtgtgggtgtgcggatgtgtgagtaatgagtgtgagggagtatgagtgtggacgggagtggaagtcacacctaatccagaggattcctattcctcctgaaacccaagcttccaggaaagcccttcctgtggccttctctccctagtcctcttagcgtctgcctgggctgcccccagtacggggtttattacactcaattgcttacatctgttcacttcaattgcttacgtctgctcacttgtcagtgccccaaccaggtcctcagggctaggaagcaggggctggatctatttcttgctctccctagcccccagctcacgacttggcatatggaggcatccacaaacagatgccgaaggatgggagtttttccacactcccacgccacctccaggtatttgctcatgctgtcccttccacctgcatgtttttctgcattgattcaggcactggtcagaggtcacctcctccaggaagccatccctgaccccagggaactgacttatctttactgtcacttctgggggtgggttggtggctgtcttgctcacttggttgtaaggtctcagagggcagggattgtgtctgtttcatgtcttcaggtctgcgtcatcagcgcttgtcacaaggttagacacacagtaggaccaagacagaccaagtacatgaaagaatgattgacatatgggccaggcgtggtggctcacacctgtaatcccagcacttcgggaggcagaggcaggcagatcacctgaggtcaggagtttgataccagcctggccaacatagtgaaacctcatgtctactaaaaatacaaaaatgagccggacgtggtggtgcacgcttgtaattccagctactcaggaggctgaggcaggagaattgcttgaactcaggaagtggaggttgcagtgagctgagatcacccactgcactccagcctaggcaatggaatgagaccccatcttcaaaaaaaaaaaaagaatgattgacgtgcagtggcccctgccctgggaagccaaccctcaccctccaccacagcacttgatcccattgggcagtccttggcttccaccctcaaactgagagctccttgagggcagcagggggtcaaattactctctgggttctcagcactgcccagtgtgagtccaaatatctcccacctcccctgtctccgctctttcctcactcagggctccacagccatgccggccttcagcaattcctcctgcaggctgagctggttcccacagggcctttgcactagctcttccctctccctacacaagtcttcccccataggctcttcagagtctcagctcaaatggcctctactcaaaaagcctcttccagaccacctgccccactggtctaagaggtccctactttcttcttgggccctcctgacctgaaatactttgttgagtgttttccccccagtcatctggctgcatccgggttcttatggtgtccagacgttaatggtctatggggcctgtgttcgaatcccagctccacccctgctcctgcttacctgcagagtgattctgagtttctttcttttcttttttaaaattttataaatgtcaatttttgtagataggggtctcgctaacagggttgcccaggctggtctcgaactatggggttcaagtgatcctcccgcctcagcttcccaaagtgctgggattacaggcatgagccactttgcccaacccattttgaatttcttaaggactctgtgcctcagtttcctgatttgtaaaaccggtgatagtatcactcccttatagggtagttgccaggattgaacgagttaacatttgcagtgcccgacagattgtactagttactgattgaagggctgttttactatccaaatgtggctggagtaggagttgggtaaacatttattgaagaatgtgcaaccactctcacttggaagccgggctgttaggaaggggaggaggattccagtcgcccagccctccccccaccaaacgcaactgccccggcgcaaaagaggccgcggaggccaggcaggagcaggtcctggaggcctggtcggcgtgggcgttttattccgagaccaaggggatccactgcagagttctccgctgggcgtgacctcgggctgcagcgtgggaggaagcgcgcggcaagacacccagcgaggtgctggggtcgcccccaggagaggacggcggctcggactgtccggcggcggcggcggggacagcgacaggggcgcgaggtggccgggacccgggccgggcgcgccgggcggggcggcgcatgcaaatctgccgggcgccggggcggggagcaggaagccggggcgggctgggtctccgcgcccaggaaagccccgcgcggcgcgggccagggaagggccacccaggggtcccccacttcccgcttgggcgcccggacggcgaatggagcaggggcgcgcaggtaggatccggggcccgcgcgcggatcgggttgcgaaggtatcgcccgggcacgccggctgagggcgttcgggaagggctcggccgccggcggggaccacggggaccaccccgactccgagcggggcccgagcccgcgactctcggtgcgcgcggagcagcgcccggttccgtccttgccgccgaacggcagcggaggcgcgaggcccggggtacgtggacacccagcgctccccaaagccggtgctggcagtgagacctccgccgggacggcctgcgggggtggggggcttggggttaggctgtcggaggccacgcagcccctcttctccgggcagtggcgcccagccctgcgctcaggaagtcagtgaggacttcggagagagaaagggtggggaaagttctgagaactgtaaatttgagtagtaggtcagtgaatcggggcggtctccgcctccgaatatcagatggacccaataatcgcgatcattgactgggacttgttttactgaaaggatgccaagtgaaacctcccactaacttctctgtggccggtgctgtgcgtcatggacattgtacagatgaggtcaccaagaccccagccgctttagtaacttgccctaaggtgccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcactatgttgtccaggctggcctcaagtgatcctcccacctcggcctcccaaaatgctgggattacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcaggtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaagggcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctgggcctctggatctgaatctggagggagacgctggggaggcagcagggaggaaaacctgcagtcactcaccccagttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatcctgttcctacaaaaaaaatttaaaaacttagccaggcgtggtagcaggtgcctctagccccagctatttgggaggctgaggtgggaggatggcttgagcccaggtggtcaaggctgcagtgaactatgattgtgccactgcactgtagcctgggtgacagagcgagactctgtctcaaaataaacaaatacataaatacatgagaagagagaaccttttctacctcccccatctccctgccctcttccacccaccccatctgggacgatggaggagagcgtttgggattagatgccccacctctcgactgccctcactggtacctgggagtgaggccaggacagaagccgcctaagtactgttcttcctcacatttgtaaaagtgaactttcttgagggttgatgacatgttttataagctacttcacacaatgtccaacacccagtgggtccacaatcaatgtatatgtctgttgttacctgtcaaaacgtatagctggggagtgacagtatggacttgagccagatcacccagtgcaaatgctggctttgctgcttactgtgtaactgacttcccagagcctcagtttctgcatttatgagattatagtgactatgccattgtagtgatgactaaatgagttaatatatgtcaagcatacaaaacagtacctggtatgtagtacaaactatgtatttgttaaatgaataccttttttttttttttttagagccatggtctctctctatttcccaggctggagcacagtggcacaatcatagctcactgtagcatccaatacctgggttcaagtaatccttccacctcagcctcctgagtagctgggactacaggtgtgtgccaccacggctggctaattgtttttatatttttagagacaggatcttgctatgttgcctaggctagtcttgaactgctggtctcaagcagtcctcctgcctcagcctcctaaagtgttggatttatagatgcgagcaaacgtgcctggcctaaatgaataaatctttactgttgcctcctttgagctttattggttgggatttagtccactcattttgcaggtgagaactgagacccggagatgaatgcagtagccttgcctcaggtccacatctgagggacagactccatcctacttttcttcccatgtattctttcctgcttgtaccagttcactggggtgaccaagaaagacatttctgagttttcctcctggctggcacagtggagacatgcccagccacgtttagctagacttaccatggctgggctagaagagaggccaggagcttgtctggaggttgcacagacctgcccttggtgaatgtggatcggagcgccccggcagaggcttgaggtgctacagaggctgggggatccactgtcagaccgggtgcatcaccactgttttatgatatccagcaaattgctctgcgtctctgagcttaaggcagagagaagggcctgagcttgaagaggggatcccaggtttaaatcggagctggctacttcccagctctccactgtgtaatctggaggaagttgtttaacctctctgagcctccctttgttttgtcatgggtatttgcagggagagcattcatgagatagtttgtatagacattttgcccttggaaggcgctcagtgattgctgtttttctctgcattttggaccgagtcccttctgcgtatccagcacctggcttcctcctgcatttcttcctcaggaatttattgagcacctatatgtgccagagcatcggaccaagtcctttgctctcctggggtttagattctagttgagcatacaggcaatgtacaaccaatacatatgttcagatcggcagctttatctgttattctgaaatccacgatttctgaaaaccgaaagtttttcataactcattttgaagctaaacttgaggctttttagagtcttcatcctcttcggtgtgatgctcagatgtctttctgcagagatattagtgcaattgatctttgggtgctttcccgccctgcatgatgggcatgtcggtgggtattttatacaaggtgacctttctacagcctgagtcatcctgaattctgaactatgtctggcccccaggattttacaggagagaacatggacctgcaatatcctatcaggtggagactgtgctaggaaggaaagcaaagctgggtgcaagtggaatcagggagggcttccctgaggaggtgacatttgagagggaaatgaggaagagagggccaggtggagggactcacagaggacggaagactccacttcctgactggcctgtgcttacccctcattctgcatgcacagttctgtctaaatgcgtccgttcttgcctttccaagaagtgctgatgtctcttacgtttcaagtctagctctgactgactcattctctctttaggtgcccccacaggcctcctcacctcttctcgtttgcttaagaaatctgaggtctgcgctaaagccagcctgggtgctgtaacctctcggccgaggatggtgcccagctgggcttgcatctggagttggaggaagtgggtcccgggaggggaagaggagccgtggggccttccaagggtttggtggaattgagttcctggtggggaggggctgtgttctgggtcttagagcctctcgcctgcaaagcaaagttgaacgtaacacgcgctcacatatctcgagtgccagcccggggctaggtgcttaacgcttgcttagccaaagtgccaggggctggggacacgggaatgagtgacccagaaatgagggccctcatggagctgaaagcattctgggcttggtgactttgaggaagtggcttttgaactgagacctgaaataccaaggcatgtggatatctggggaaagagtgatcctggcagtgggaacagagagtgcaaaggcccagaggcatgaatgagcttggtgtgtttgacccacagcaaggaagctggtgtggttggatggaaccaaacaagaaagaggtctaggagcagaggtcagggagggagctggggccagatacctgcattgtctcatttaacttgtgtaataaccctaccagataggagctactctcatgcaaatgttacagatgaagtaacagaggcacagagaggttcagtgacttgtccagggtcacacacctgaaggtggcagagcagggctgtgaacctagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcaggaggtgagtggcaggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacaggcctgtgctatcacacccagctaatttttgtatttttagtagagacagggtttcactgtgttggccaggctggtgtcgaactcctggcctcaggtgatccacctgcctcagtctcccaaagtgctgggattacaggcatgagccactgcacgcggccctgggtgcgtgcttcttatgagactctaatgcctgatgatctgtcactgtctcccatcgcccttggatgggaccatctaattgcaggaaaataagctcagggctcccactgattctgcattatggtgagttgtataattatttcattatatgttaccatataataataatagaaataaagtacgtaatacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacagacccagaagcctgtgcatttaaccacggttctgagctatccagcccaaagaggagagtttaaaaggattacatttcttcgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttctttttttttttttgagatggagtctcactctgctgcccaggctggagtgcagtggcgcaatctcggctcactgcaatctctgcctcccgggttcaagtgattctcctgcctcaacctcccgagtagctgggatttcaggcacacaccaccacgcctggctaatttttgtatttttattagcaatggggtttcaccatgctggccagactggtctcaaactcctgacctagggtgatccgcccacctcagcctcccaaagtgctggtattacaggtgtgagccaccgtgcccagcccaaattagctttctaggagcttccactttctgagtctgtttctgcctcttggaggtagtgaccatctccctccaaactcggatacttctcttattcagactacacaactgtagttatttcaggtattctccctgactcaggaaattataagtttggcctgccttggcacatgagtcaactggttggagtcccacgcaaagactgtttgtttggtcaaagaggaaggagactattacctccttggatctagagcttatacttctgttgatgcaacctggaatcatactgtgtagcagccatatcccacttggagtgcatattgggcttgtcagctaaaatctccatgtttctcttctatatgagctgctgttaatccaagtttcttctattctgagagtccttgtctaaagctaagaggttccagtttttcatgctctctaataaatctacttcaggctaacatgctatcattttttctttgagtactgctttggtttctttccacaacttgttacacaatgttattcactgcccagtttagaatttcccttttggttcccattttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcaagctagctattatattatctatatttgttatgtcactatgtggttttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgtagagatgggatttcgctatgtttcccgggccagtctcaaactcctaggttcaagcagtctgcccacctcagcctcccaaagtgctgggattacaggcatgagccaccgcagctggctgaattgttcctttaatcagtataaaagagccaacttccagcctgggcagcatagtgagaccccatctctaccaaaaactaaaaattagctgggtgtggtggcgtgcacctgtagttccagctacttgggagggcgaggtgggagaatcacttgagaccaggaattcaaggccgcagtgagctatgattgctccactgcactccagtctaggtgacagagtgagacattctcaaaaaaacaaaaacaaaaaaaccatccaccttctctcttctaatacttactcaagacatcattgtcatgaattctattttattgatgtcagtactcctgtactaataagccagatgagttaaaaacaacagcagccttgcaaccagccatgaagcaagtgatcttattctcatttcacagatgaggagactgaggctctgagtggactccagcctgccacggtctcccaccgagtcaggttggagcctgcacttaggcccagagttatgcttctgtgtctcagatgcttgggggtccctgcccacaaaggtggcccccatgtctgtgtgtccccacccatccaggaatggtatggggtgagacaacaggaagagctccatgggtagtccccacccactgccttccatatgccagtctgcaagcagaaaatgaacgggaagctcttacctgtgcccatgtgttgtcctggctttgggtttgcccagggggcaaagtcctggtcattgttgagacaagttcactgctgctgagggccgagcaaatggtgacaaaggccagattctaaattcctacctggttacttcctgctccgtcaccatcacctcgggcaaattctgaacctccctcagcctcattcctccatctgtgcttgcagggagaatattttactgtatcttccatagtgagctttccaggagaagcaaaaaagagtggtgtataaaaaagcaagtttatgactgcttctgtgccaggcactgtgctgtgcactccagagccaaaggcctgggttcaaatcccagcccactcactagctgtgcatccttaggcaggttcctgaccctctctgggcctcggcttctccatctctgcaatggagatgatattaattgtatctgcaatgctccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacgatgttgtccctggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccgtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatggggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaatacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacaatagtattagtttgttctcatgctgctctaaggacatgcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattttcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttatttagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagaagtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcacccgccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcgtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcacccccggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggctgaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaacctgggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtgcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgcccggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacactcggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgcccttatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctatatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgattatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcgcttgaacccgggaggtggaggttgcagtgagctgagattgcaccgctgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggaaccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccgcacccatgggtatttcttcagcttccacagtcatcccgacactagctgggaagctccagcagccctggtcctggccccagctctgtgggcgctggccctcaactttgcctgcactgtgcttttgtgctattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctccgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagggttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcgtcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcactgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtgtccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacattccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagtgagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccgcagtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgccctaggcaagtccctttgcttcctggccccccacccctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgcctcggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcggggaggtcatttcctgccacccatgtttccccaccctgaatccaccttcctcacattcccattggagggacactctctggacatatgggacctggggtcccacagggctgcattccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccgctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcgtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactataggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggctcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctccccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcgtgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttggccaggctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacgaaaactcagaaaggttaaacaacttgcctaagtaacatacagctaattagtcgaggagcctgacgcatgttgctctagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacacacaagcccacaatttccatggcttaacactataggaatatatttcttgctcatgtaacaagctaacgtgaatgttgctggtttgtaggtggtttccctccctgtagaaatctggggagtgaggttctttccatcttgtggtgccatcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggagtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcacataaatactgtaatttcaaagtagataagcataaataatactttatgatactgaaattgtgatgtgatatgagaatagctgtgagttttgttttgctggggacaggatcactgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggccccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtgaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggtggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgtatttactgagcagctactacacaccttgagagtagagctgagaacatatcgacaaggaccccacttttttctttttttcttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtggaggccagagatcttctggggtgctttttgcaagggggaccaggataaggctctccaaggagggaaaatttgaggggggccctgactggggagaatgagctggccagggataagcaagatggagtcatcccacatccccttacaacactgggtgcctgggcaactgggggcatttgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaattttattttattttttgggacagagtggagtctcaaaaaccaagctagagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccgccatgcctggcctcatataagcatttctgtctccatttatcatccatctttccctcttgaaggtcagtttcaccaaggcaggcatctttgtctcgttcactgttgtagcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctcgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagaggcagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaatgaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcgtgatcttggctcactgcaacctctgcctcctgggttcaagcaattttcttgcctcagcctcccaagtagctgggattacaggcatgtgccaccacgccaggctaattttgtatttttaatagagatggggtttcttcatgttggtcaggctggtctggaactcctaatatcagatgatccacccacctcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgaggctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagccccctgagtttcactggtgtgtcaggtacatggtgataccccttgggagtgctgttatagttaacaaccagagcagccgtgcctgttgttaaaatcttgacctaattgtatacttgtcggcaaatagccactatcctgaacactcccctccttttttttaatatacaggatctcactctgtggcccaggctggtgtgcagtggtgcgatcatagctcactgcaccttcaaactcctgagctcaagtgatcctcccatcttagcctcccgagtagctgatactacagatgtgcattaccacgcctggctattttaaaaggtttttgcctgtaattccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcagacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacctccagacactgctgtgagtgctgtgtctctgttaactcctggaattcacccatccagaggaaccaggatgcaagaggttaagaaacttgccgtctgggtttgggttccccatacaaggattcaaatagttgatttaggaagtaatcccgggaaaccctgctaaggtagtggggaactgaggcagggaaggacacaaaccaagaaagtgttacctgaaaggggtccagatgcagaccccaaaagagggttcttgaatctcatgcaagaaagaattcagagcgagtccatagagtcagtgaaagcaagttaatgaggaaagtaaaggaataaaagaatggctactccgtagacagagcagccctgagggttgctggctgcctatttttatggttattgattaattatattccaaacaaggggtggattattatgcctcccttttagaccatatagggtaacttcctgatgttgccatggcatttgtaaactgtcatggcgctgttgggagtgtagcagtgaggacaaccagaggtcactcttgttgccatcttggttttggtgggttagagccatcttctttactgcaacctgttttatcagcaaggtctttatgacttgtatcggtgacgacctcctgtctcattctatgactaagaatgccctaacctcccaggaatgcagcccagtaagtctcagcctcattttacccagcccctcttcaaagctccagtttaaataaacctctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgttgagagactctggcacaccaagaagacaggaacaggacaccaacagtggctgatgatacactgccaaggtcacacagctagttagcaacagatctatagtggaatccagacagtgtctccatcacccaggctctctgtagtgatctgcgcttcacatccgaggcaggcagagggatggtgtgggccttagatgggaaggctgggaacctgaagctcctatgtctgtatcacttttgcttctctgagtagctgccctgatttcacacttgaggggcttggccattttagattccttcctgctctaggagcctacatactacactggaaatgatggggagctctctacctcacatgcagcctgatgtttgttagaaacacctccttgcgccaggcatgatggctcatggctgtaatcccagcaatttgggaggctgaggcgggtgtatcacttgaggtgaggagttcaagaccagcctggccaatatggtgaaaccctatctctaccaaaaaataaaaaattagccgggtgtggtggtgggtgcctgtaatctcagctacttgggaggctgagttggtagaattgcttcaacctgggacgcggaggttgcagtgagctgagattgtgccattgcactccagcttggatgacagagtgagaccctgtctcaggaaaaaaaaaaaaaaacaaaaaaaaccttgttctaagccaaaatcaatccctttagctgcccaaatcacacagtttacagatggagaaacagttttagagaggaaaagggacttgcccaaagtcacccagagaatggcagagcctgaactagccttctggacttcttgcctccaaaagctctttataataaaatataattttaaataaaaatagttatctgtttagggccaagcaatatgctaagtgccgtccagccactgtgtcatttacgtctccaaacagctctagttgggaggctcaatgattatcccaattttacagataaggaaacaggtccagagaggttgaggattagcctagaaccacacagctaggaaatcctggagccaggatttgaacccgggtctgacctaagagctcccagccgccgtgatatatcagcttatgtcatcctgacacctacgcagatgtcggctcgaatccactttgcctgagcattgtctcagagaaatctaatttaaaaattaggcagcaaatagaaaatatatttgactgctagagatgcaatgggactgggagcccaacaaaggatcttaggcaaaagaaatccaagttgttggcctcagcaactattactgaactggctgggctttgggaagctacagagggatgagaagacctggtggatcaggtgggcccaactcaggctggcccccaccctgcaggaagtaggaaaagtccagggtcataggcccagtgagatgccggctgcgggagtttcagcctccggggctggaccagagggcaggaggggacgcccctgggtagcagcgccagagtgggctgagtggcctgggcccctgcgggggagctttcagagatgttgatttgggggtactccctcagccctgcctttacacagaatttgtgggggatgaggggagggggaaaggggggaggaaggcagtgagtgcatctgaattttttttttttttttacaaaaagtggcttattgcatttttctgattactctatcagcacgtgcagaccttttcctattcagagaaagcctgaagatataaagaggaaagtgaagaaaaaccaccggaaatcccatccccgccccagcatctggcactgtgtgggcgatcacgaaatgagcgcttgtttttgaaggcgtagtatctccgtgaacatccggttgaacaacctttctgactttatttttcccacgaaagttattaattaaaaaacaaaaagcaaaacaccgaaaaaacaaaaaacccagcaagtgtttgagctcccaccacgagggaggcctgacgtcactggatcctcccggcagccgatgaggctgcatgggacttgcccacgatgtgctgttaccgagtggcatagccaggcttcaaaccagagtcctagctaaccgccctgtatataccatgggctcatcatcttccctggttccagctcagaacagagactcagaggaacaagggctctgcgctcaccctgcctggttaggtccagcctttccaattccaagctgtgtgaccatgggaaaagtgtttgcccactctgggcctaaatttcctccttggtaaaaggcacacaagagcagtactctgcacgccacagtggtggggtgagcagcagatgacgtggtgggtggaggccaggtgacaccaggctgctctcaagcttaacttgcctgtgatggtggcgggaccgtgtcagttcttccaccaaatcccacctgtttccacgacgtttattgacaagtcaggggcaccgccccgggtggagggggtgtgaagaggaagtcagctccctggtccctgctgccctctggtgaccacatcagcatcagcacctgctccatcccagcagctccaggtccaggccgtgcccagaaaacttggcctgggagattccccacccgccctgccccgatcccacctctcttccatctctgcattttccagaaattcccccagcaccagacaaaagagcctaatgtccattagatatgctgtgtggcgccaggccagcgtgtaacctctctgtgcttgattcgttatctgtaaaatgggaatcattataatatctgcctcatgtagctattgtgagaattaaatatgttagtacctgtgaggtccttagaactatgcctgcggctgggcacagtggctcacgcctgtaatcccagcactatgggaggccaaggtgggcagattgcctgaggtaggcgtttgagaccagcctggccaacatggtgaaaccctgtctctattaaaaatacaaaaatcagccagacatggtggcgggtgcctgtaatcccagctactcgggaggatgaggcaggagaattgcctgaacccaggaggcagaggttgcagcaagcggagattgtgccactgcactccagcctgggcaacaagtgggactctgtctcaaaaaaaaagaactatgcctgcaaatagttaatgccttaaaagtatttgctaacattcttcttcttcttcttttttttttttttttgagacagggtctttctctgtcacccaggctggagcgcagtggcccaatcccggctcactgcagccttgaacacctgggctcatgtgattctcccacttcagcctctcaagtagctgtgaccacaggtgcacacaccactaagcctggctaatttgttttttaattttttgtagagacagggaatcactatgttgcctaggctagtcccagactcctagggttcaagcaatccatccacctcggcctcccaaagtgctaggattacagatgtgagccaccatgcctagtctgctaacattatccttaatattacactgaatatgtctgtggattttgtgggaggtgagggtataaaacataattagaggaaataatgacattctaaatttaatttgactttattacaaaaagggcagaatggagcaacagtaatccaggacaaaaaattgtcccaatcccatcattcaacccacttgtgtttgtatctgtttgtgccacttctgtgtgttgtttacatgcagagtcagtgtttgcgtatttgcggttttatatcattcatttctcatcatacatacatatatttatattcctgacatttttctagggaatatctttatattcctgacatttttctctttttcccttatgttcttccataccgggacttataggaccttgcccagactcaacttccctcttccccatggacccaagttgctgagcttccaacaggtgtttacagcaaaggagaatgagacagagagaagcagagatgcagagagaaagacagacagagaagactaaactgattgatcccaactccattatgatatctgactccaaccacagaatgaccctgatccagccacagactgacttctgatcctggccacagtccacctcctgtcctcagccacagaacagctctgactcaagccaggaactgagtcccgacccatgttactgacttactcatgatcctggttgcaggctggccccagccacatgctgacccctgaccctcaccacagatggatctttgatcccagctataggctgatctctgattctggctgccctgaaccaccactcctatatactgatgacccaccttagcgtgatcccacccaggaactggcatttcctgggacaggctcttggccacctgctgctctgccctgggcacaccaggccctacgcatcctcccccttccaccaccatccatgatttcctgatttctagcagcaaatttagcttgagttggtcaacatagctgggctgcctgaccttcctctctgccatggaaccacagagcaagtcagcagttctccttcctaatcaaaaagcagcatggaggagaaggctcctttgccaccttcctttctgctttggatggtgcttttgcaatcatgaggagacaagcctggagatgaaaggaggcattctgaatatggtggagtggaagaagaagaaggcctgcctggggctttgattacatcaccaagtgatcaaaccaaccttaaattcttaaataaactgtaagtgtgcttttctttaaaccactgtgagttttcttttgcagtcataaagcaaccttaaaaattgtagtaggtacaataatgaaccccccaagatgtccatgtcccaatccctggaacctgtgaacatgttacattacatggcaagggggggattaaggttacagatggaagcagggttgctaatcaactgaacctgagatgtagagggagattatccttaattatccagacaggcccaatataatcccaaggatcttcataagtgagagatgcaggagaagccaagtcagagagagatttcaaaatattatgctgctggctttgaagatggagggaagggccatgggctaaggaatgcaggtgaccacttgaaactggaaaagtcaaggaacagacttccctagagtttctggaatgaacacagccttgttaacaccctgattttgagctcagtgagaccagtttcagacttctgacctctggaattgcaagatcataaatttcagttttaggccactaaacttgtggaaatttgtcagagaagcaatgggaaatgaacgtgcaggtgcattcacgcatccaactttaggctctggactcttcctcaagctccttccccaatccccatcctctccctctttattggcactcaatcttcacttccagaggatcctgccaaattcctgcccattccatatcggcatccaccctttcttgttagagtggacgtagggcaggctggctccacagctgtgcgccaggcagcagcccgtacccccctgctcggaggacccctactcttcagtgtcatgctctgaagtcccagttttgaaattcttggccaggcgcagtggcccacacctgtaatcccagcactttgggaggccaaggtgggcggatcactcgaagtcaagagtttgagaccagcctggccaatatggtgaaaccccgtctctactaaaaatacaaaaattagccaggcatggtggtgcatgcctgtaatcccagctactcagggaggctgaggcaggagaatcacttgaacccgggaggtggaggttgcagtgagccaagactgtgccactgcactccagcctgagcaacagagcgagactttgtttcaaaaaaaaataaaaaaagaaaaagaaattcttaaaaattttatctctgaagttgtgttttatagggaggtttaatgggaccaaggagcacccattgagggcttggagcctcagctcacacagggtcccacctcctgcctgcttccctgggacatctgccacctgcctgcttccctggtacaggctcctggccacctgctgctctgtccccagcacaccaggccctactcatcctccccattccaccaccatccatgaccattgctgccttctgcccttgaaggaggcctgggcacaggtgcaaaggatcatcaaggtcagtagctcacctcacgggaccttggggtggagcatggtgacagccattcctaccccagaggtatctgctgggcagccagaagccacaactcagcccacttctaatccaggaaccaagagtgaccatcttgatttctcagcccttttgttttttctttttgagacggagtctcgctcttgtcccctaggctggagtgcagtggctcaatctcggctcactgcaacctctgcctcccgagtacaagcaattctcctgcctcagcctcccaagtagctgggattgcaggcatgagccaccatgcccagctaattttttatttttagtagagacggggtttcaccatgttggccaggctggtctcaaactgctggactcaagtgatccgcccgccttggcctcccaaagtgctgggattacaagcgtgaaccaccgcgcctggccaaattatcagccctttttgaataagaagacctgcatttttattttgcacagtgcccctccaatgatgcagccattcctgatgcggggtcattccctctctcccaggctgagctctcttctccctctggaccctaaaacaccatcactcccctgtgtcttcacctgcctccctctgctggcctttcctcattgccacacatatctactcaagtctttccatcttcaaacagcccaagcttccctccaccccggctcctatttctctctcgccttctctcccccagccacagtgcttgtgctcaaaagctgtctcctctcttgggcttcacttccttcctctgcacccactcctctaccctctctgtgcagagtcggcctgactctgctactaaactactttcactgaagccagctccaccacccaagccaagtctcagtttcaatccctactactctgtggcactagcatctccctcactcctgaaactcggcccctcttggttctctgacactggctgtttgttcctgtccagtctctttttctttttttctgaggcagagtcttgctctatcacccaggctggagtgcagtggcgcagtctcagctcactacaacctccatctcccaggttcaaacgattctcctgcctcagcctcccaagtagctgggattacaggcacccaccaccaccacacctggataatttttttgtatttttagtagagacggggtttcaccatgttggccatgctggtcttgagctcttgatcttgtgattcgcctgcctcggtctcccaaagtgctgggattacaggcatgagccaccgcacctggctccagtctctttttccaaggtcttctcctctgccctctcttacacgttaggggtccgcagggcccatctggggccctccccatctcctctcctctttccacagagttaattacaaccttcactaaatctgtactggagtcgcatggatcaggaactgtgtggtccacagcccagcactgtgcttggcacatagagcatactcaataaacatttactaagtgaatgaatgaatgaatgaatgatgtcttctaaatatatctccccagctgagatctcttgcctgaactccagagttatacattcaactgcagttgggtatgtctcagtttccacatctcccacccaaacattttgcatgtcctagctagtagccattcctatctcgtgtgacatatgttattatatattgtatatattattaagtcttttatttcttatttctcaccaggtctcccatatctcccccaaagaaagtagactcatggtgggcagagatttcagtttggttggctcattgccttatcccagggcctagaacagtgcctggcacatagtaggtgctcaataaatacttcttggctgggcaccatggctcacgcctgtcatcccagcactttgggaggccaaggcaggtggactgcttgagcccaggagtttgagaccagcctgggcaacatggcaaaactccatctctacaaaaaatacaaaaagtagccaggcatggcggtgcataactgtagtctcatctactggggaggcttaggtgagaggatcgcttgagcccaggaggtcgaggttggagtgagccacgatcacgccactgcactccagcctgggcgacagagaccctgtctctaaataaatacacaaaaataagtaaataaataaatacttcttgaacagatgaatggatctccacagagacatccccacatctcagattcagtatatccaaacgagctctttctcatcctcgccaaacctcctccttctggttcctggttttgattgctaaagcaagagagcgggtgctcctcaattgactacctccttcctccctgcagaacttccggtactgtgagtctgtccctgggaccctgctctccagctcctctgttcagccatgtcagcctccctattgtaacccctgggtttatgccggtagtgtctttatcaaacactcccccatgccaggaccaggaccatctttgtgactgcgtccttccctgctccctggggtccctaagatgattttaggtggcatgtgggcatagtgagctgagaaaacaattcctttttcagttctctttctcttctccagattagcctaccacaggctgcagcatctagctggaagttaatcactcggttttggtttcaatgggcttgtttttacagttcccttctatttacagtaaaggatcctgatctttcatgtgtgatggtgacaatgtttcatttgacaataaagtgatttaaacaaagcgaggaggccaatatgaagaaaatgta

SEQ ID NO: 1013 - DNA, 3597 bp, Homo sapiens
ggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtgtccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacatggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctgtgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctc

SEQ ID NO: 1014 - protein, 825 aa, Homo sapiens [sequence omitted]

SEQ ID NO: 1015 - DNA, 165221 bp, Mus musculus
  misc_feature (1)...(165221): n = A,T,C or G
acattttccctatgtgattacttacaaacttctggaagtttggatgccccaagtcaaagcccatggtcgattttaaaacactgcttatgctggctcttaaacaccataagtctgccacatactttaacttaattattcacttgtcaataaaccagataggtacaactcaagcccaactgccgatacaatggtttagactccaaagataacaagataattggagccatgagtctgaaaacataataaacaccttcaaaattatgagttagtccaatgatagcctcacttgggactttgaagggactagttttgaatggctgtttggcccaaatgtagaatggtgtgtcttacccatggcctgccattcccattctaactgggtggtcatttaccttcaaagtttttgtccagatcttgaaggccttcattcaactcttgagcactcgtaccacggaagagcccataggtaataacaatggtaccgttggagatagcatctgtaaagaaaatcctgctggtgatccatgcctgagtcgcaagaatggagcagatgacaacaactgagcccaggcttgtgagaaagccagacaggaacatcaacgttttctgtgtggttggcattttctcaggaagaaagctccccgcgataaaacaacagcaaccttagaatatttgggggccttatcatttgggatccagtatttagaaaggacgtctagcacttggttgtaaatgtaaaacctgcgtcttcctgggaagttttatgcttactgaacgttgacctgtgaacaaagccataaagacgtgcagaagctgaactttggtcttgcagaaacggttgttatggttgcagccaaccagcatgaagaagggctaggcaatcctttcaggtcttcctcaatcacatgactagtttatagcctttatcatgctgtggaagccaggttaatctacagtgtaacttgaattctcaaatcatgagaatagagacttagaccccaaagggatagcatagggatccccaaagcaaacctcaaggctttgtcaaggtcctgtgaagtggaaagagaaaggctcactcttccttctgggttatatacctccttattctcagatcatattagggaggagtgcccatcaaattctctcttccaaatggcattctatttgaatctgatttaaatgataatctttatcagtttttagtactttgttaaaagtggttctaaacattcctgcttagatctgtgtcctagttactttcctattgctgtgacactatgaccgaggcaacttacaaaacgaagcatttaactggaagcttgttttggtttcagtttcagaagcttagtccatgttcattgttcattgtgacagtgagtatggcaggcctgggacatggcattggaggaatagctaagagcttatatcctgacctgcaggcaggaggcaaagtgaaaacccagggctgggcccagcataggcctttgaaacctcaaagtccatcccccatgtgacacacctcctccaacaagaccacacctcttaatccttcctaaacaatccatcaagtgccaaccaaacatttaaataagtgagcctatggggggggggcatcctcattctaaccaccatactctctaactcctgccttatggccttgcagctagcttggcctagcagttagtccttggtggtacttacccactcatttcttgagattacagacagtcacaaactattctttcatttttctttttcttgtgttctttgattacagaacaatattgaacatgtatatcagaaccctgtcctcttagataacctacttacctgtgggatgagggctctcctcttgtaaatgtagaaaagggactgaagacacagaaatcactagactcagtcaattcacttctgggggaaagagacacatatagataattatagaataataatgttgaaagacaaggcaggcatcaagctgaagtcagaacaggggacataccacacttctgtcaccacatagatagatagatagatagatagatagatagatagatgacagacagaaagacaaatgatagattatagaaagacacaggatagatagatagatagatagatagatagatagatagatagatagatagatgacagacagacaaatgatagatagattatagaaagacacaggatagatagatagatagatagatagatagatagatagatagatgacagacagaaagacaaatgatagatagattatagaaagacacaggatagatagatagatagatagatagatagatagatagatgatagatagatagatagatagagcaaaaaaatcaagtcaccacattaggctctctttatctctgtctctctgtctctttatctgtctctttgtgtttatgtgtgtgtctctctctgtctctctctgcctctctgtctctctttgtctctatctctgtctttctctgtctctctgtctctctctctgtctctctctgtctctctgtctctctctgtctctctctgtctctctctgtctctctctctctgtctctctctctctctctctctctccctccctccctcttctcttcccctgggggaacttcttaaactgttgctaaagggaagcagaagcagaaggacttttgtatccagctgaaaaaacccaaacaaggtttgtggcttctggagcatttggagcatatggaacaggattccagtcacagacaagcatggctcaagaagcaattccaagccctcttaaaacttcagcctaaggctttgctgcccactgatagggtgagactctctcaggccagctgtggaacatccagggagggctgtggtcatcatgaagattccagaggttggattgtgctgaaactcttcaaaggtccagtcaaccagggtatccaactcttgggggatgcttcagtcattcaggtcaggaagcagaatgatcatgccttaagcctgggctggctttttcctggaggaatggcttctacagacacatcttaacaaggctaaaactcatctagaacactcaaagacattgccttcagtcaacagcaagaaatcgcaagcgttgcagtaaaatgaaaacaaggcaggaaaggaacaaggagcccttagtcccaccaccatcaatagaagcacactcaaagataatataggtgtttaaagtaggagacaagaattaccaatgctattatagaaaaaaatgctcaatgatttaagagtaaagatgatataatgcacaaacaaaggtgtcagtcaggtttagttatcaacttgacatacctgggaagagggaatttcgattcaggagttatctccattggattgaccagtgtgggcatgcctgtgaggcattttcctaattgctaattaatgcgggagaacccagcccaataggggcggtgctatccctagacaagtaggcctgtgctgtataagagaggtagctgaggcagccagagaaacagtccagagagtagagggcatccatggtttctcccttcggtcctgtcttgagtttctgctttactccccacaatgatgaactaagcctccctccaccccacatccaatctcaatgcttatcacagcaaaagaaatactcatagaacagtaggaaacctctgaagaacaataaaaattatttttttaaataaccaaatgaaaaaaaactatgatctaaacataaaataaccgaaacagaaagttcactgaatggatttaacagaatccaaagcactataggggaaagagcagtggtcactcatcacaataaaaaccatccaaactcattggcttagtggcccagtcaacagctaggaggaagcaggtacgtatcaccagagtttggaaagtgggtggcaagggaaacatttttgaagattaacattattcatttttattttatgtatttgagtgttttggctgtgtgtccatttgtgtatcatcaagagggagtcagattccttggaaatagagttctagataatagtgagctgccatatggatgctgagaaaggaacacagaccctttgcaagagcagaaggtgctctaaactgctgagcaattttttccagcacaacactgaattaaaagaaaaaaagtttttttttttttgctttaaaccaataagacttagaaagtcacaatgaaacattttaaatcacatttctttttgtttcgtgatataaattatatttataaagtaaataagtatcaacattcaacacacatccaaaaccagccaccagccttgggactgagaaacaggtggtcgacttccttcaggatgctcatcagaaaggctatgatggcacctgtgcggcacacacggcagtggccagtggcttcgtaacgcgtgtagccagtaacagggccatgagctggatgagctttggggggagggggcccagtggctactggggtggggcctcagtcagaggctgcttgctttctgcaacagaatcactggcctttaaatcacattgaaaacccatgataaagagaaaaattagaaaatgaaactagggggaaaaaaatctatgttacctaaccatggccaggcaataaagggcgaatctcaaaatgattttgctgtgtgcaagaaactagaaataacatagtgtgtggaagagccatctgcctatatataacatactctaatcacattcctataaagagcaagaggggccgacactatctgtggcaacagacatcagaataatggctgtccttttggaatgtgttattttctgaaaagggaagggggtttataaggaccaaaatgctagtgtgtgtgtgtgtgtgtgtgtgtgtgtgtgtgtgtgtatgcaggtgtatgtatatgtgtgtatgtgtgagtacaggtgtatatgtgtgtctttgtgtgcaggtgagtatgtgtgtgcaggtatgtatgtgtgtgcaggcatgttatgtgggaaagttttttcttagaagccatcaaacttgttttattgagacaatgtctctcattagtaccagagtatcactgatttggctagactagcaagtcaatgaaccccagggatacatttgtttccatctgtcagtaatgcgattataagctagcacactacctctggctttttacctgggtggtgagtcaactcaggtcctcatacttgtggggacaggctctctaccagctgagcgatttccccttatctaaaatgtcagtatctcagtaagggcatgcctattactaacgtgcatggctctattcactgcactgtgttcataggatctgcacattgcatgcatatggttcatcagtaaaaagaaactcaaaattagcatattgtgaggacccagactaggatcaactttctgtttatttggaattcttttctggccaagtagagagacaggaactattagtatttgagcctaacctgggaaaagagggggtagagggaataatattgagatactagaaatgaaaagcatcttctagaggtcattagagccatccttctttgtatggacaggttttgaatgtcactgcaaagcagtgaatgctctcttctttttctcttgctcctcacaccctatggcgaatcactaaagcccaatatctctcctaaagtcagatagttttatattaatctttctgcattttgtttagaagcgaattttattttcttttttattaacaccaattttgcccccttttctgcttattctccaagagtatatctctggactcaacatatgaattctgctggaaatttttaatctgaataagccctagcaagataccgtggtgagaaagtgaggatgtggtctgatggcagaatgcttgtgcagcatgcacaaagtcaagttctggattttatccccaggatggacattgtataaaggcaggcatggtggcctaggacacctaggcctaggtagtactctaggacgatcaggagttcacaaccatccttggttacatattgagtttaaagtcatcctgggatacaggaggccatgtgtccaaaaaagaaaaaaaagttactgcagaacggagaaaggagtcagtggtaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacacacacacacatgatttctttaaatcataaaaataagtttttaaattactgaagaaaattccagtggtcaagttcttggggacaatggaagacagaacacatggtctagtgatggtacagttctgggaatcctgcctggatggggccgtgttccaaaggagaaattacacagccagaaatggaggggaactcaggaggcagagggtgcatggaaagtgtcagagatgctcagtcaggcagagtagactatggggagagagacactatgtctctgacactaaagggcaggagtaatggggcagggaggtctttgccgtctaggatgaggggaagagaattaactgatgctaatgggaatcatgagctcaaatgaggagcaaagatgatgaaggatagcccatgtctgaatgacaggatgtctgtagacttcagtagatgttaaggaataccacttaattcctagaataacatttagggtctaacagggcagatattactgggagaaaagagccatctgcctcctcatcatgttcccaaggctgtcactttccaagaacagatgtctgactaaggcgacacattttcctcctggtggataacagcctctgcctccccacccctgcagtgctaacaagcttatcggggctttgaaactgtcactatcttaatcattagtttggatctgcagttgcagcaacaataaagtccagaggtaggtgatggttattgggccacttggccacacccaacctgggctgtcccctgagggcacacacactcagaggaaacttcctgcctgccccactgagctctggacaggtatcagggctacctgctgctgcctgctggggactgccctgctttgctctgccagcccacatgttcactgtgggttctgactgttgggtgtgtctcctgctgcaagaatacaaggtgggtagagcacagcctgggctgatggcatttccaaccctggggcaaatgaagagaggggaaccaaaagagcaaaaatgcctgtacttgggatgcagaggcagggggctctctgtgaattcaaaactgacctggtatacatagtgagatccgggacagccaaagccacatagtgagacccactgtagagatttgaataggtttgactcctatagactcatgtctttgaatgcttggttcacagggagtgacactattaggaagtgtgtccttgttgaaataggagtggccttgttggaggaagtttgtcactgtaggcatggattttaagaccctcgtcctagctgccaggaagccagacttctcctagctgccttcagaacaagaggtggaactctcagctcctccagccccatgcctgcctggatactgccatgctcccaccttgatgatactggactgaacctctgaacctgtaagccagccacaattaaatgtcatccttataagaactgccttggtcatgatatctattcatagcagcaaaaccttaactaagatagtgggctttgccagtcttttcccatctgccttcagaacaagatgtagaactctcagctccttctccagagccatgcctgcctggacactgccaggcttcttgccttgctgacaatggattgaacctctgaacctgtaattaaattacaggttccaattgaatattgctccttataagagttgccttggtcatggtgtctgttcacagcaatggaaaccctagctaagacaccctgtcttaaaataaccaccacaacaaaaccacctgattcagtcagaaatgtcggtgaagagggctacaagagagaagaggggtttgagggcactgggatgacaattgataggaaggtagcaaagggggcgggaccaaggcaggaagtagcttttctagagcactgagaaaaaggatccatggctgcattagataagcaagggctcaggagtcactggggaagttgggcacagcatcactgcagtcaggtttacttgggggtgagggatgtctgagatcagaggacagtgctgtcagaggagaggcaagcacagcgaggaagagaaggaactttattcaagatgcacagaggcagagtcaaggcccagaaagcaagagcaagagctggggctagactggcaggaggtgcctgaagaactgagcttgctggttggtgtctggaaggccgaatgcttctgaatgatgtgcacgtgaaaggtgttacagctctggagaagcccccggaagcaggggtgagtgaggcaggaaaggaagaagacccaatttcccaattcaggtcttcagagacagaggtgcgtggggcagagaaggaagacctgagcttgggtcctggaacatgggcaaggaagagcattcttagcattctggagggttccacagttcttcaggcttccagtctacagctctgtccagtacaggctccagccaacttaggagttgactgatggccctttgaaactgtcaccttataagtcagcttggctctgcagctctaacagcagtaaactgaagggtgaggtaatatcccacgcatgcctttcttgccattcatttacttattccctccttcatttataagctctgcaagcaaggtccccaacacagaaacagcatccccatgaggctatgccctggcccaaccaaacaggttcagaaccaagatagacaccatggctttgttgtgctttctgccttccagtcaggatgttttatttctgttgctgagaaaaaatatcggggggggggggagtaaactctggaagagaggatttctttgattcacaacttcaagctacagttcactatttcagggaagtccagaaggaaacttcagacatcacctacaaagtcaagagcaaatggattaaacccacccttgcgtgcccaatgccatttagccttctcccttatactgttcaggaccccggtcttagggaatggtgctgcccacagtggaatgagattccctttatcaattaacaatccaaacaacctccaatgggcatgtctgaagcccaacctgatctagatgatttccccatgagtctcaattctaggttgtgtcaagctggacttcgtttatagtccaaactaaaccactatgaaataattccccagagcagcagatctggtccctgtactgcgctctgctccatgtgtgtttaattttgccagacatttcttactaattgtatacccccagcacccaccatggggcgcccgcacactctttttctgggagggagtgtctaacatttctcagctctgccgacttctctgaagcagggctgttaccacgggtcccagccctgctttaccagttgcgaaaccttaagtgccacactactttgtggtgtccagagctaaggctaaatagaagggacgttgagttttctctatggctcgtctgagtgccatcaccttttaggatcctccctgatagagtgtccagtcagagtgccaggagagagggcatgttcctgcatcctcccagtgtaaaggccaaagctccaggagggtgagcgcccgcggtgcgctcccagagccaggcaccaggcgtcgccgtcgcccctcgcagctccacggccccgcccccgccgcggagctggagctggagccggagccggagccctagcccagagctggaggcggccggaccgggccagacagatttcctgctctcctgtagggctgagggctgccggctgcgggctacgggctgcgggctacaggctacgggctacggactgcgggctgcgagagaagtcaccggcggcgcaggtacctcactgcctacgcgcgtccccacgaccctccctcgcgccggcggggacagcggacgccccggagcggagcgcgtcgggcgggcgcccgggagatgcggagtcgccgcggcggagcgatcggggctacagcaccggtccctgggaggtgagtggcgcggtgagggtgggtggcagtacgtccggagatggccgtgctccccgtgcacattgagcagaccgggatatcctgggccactgccagggagaaacgggtcgttgtacgggagctgcgtccgagccaggtccttgccatcctcctagtgtacaggatgctagcgactgtagaccctgcgaccccagctacctgctcgagacgcggtccgaacttggctaccacctaggcagctctctcggtgaatagctacacagagggcgtgtgtctgtgggtggcgactgtaggaagaggacaacaacctggggatgtgtgtgaacgcagtggaaacgggagtgggttccaaccggtgtgttgggggctgcgcacgcagggcttaagactggagcttttccagaaagtgactcgagttgcgccaactcccggcgcagcgggggcgctgcggggatgctggcgcccggtctagggccgggagccttccccggcaggcgtcagttggggattcagggtcaaggtggaacctggcaggtagctcaggtatgacgccacgaattgcagtccgtagggggacctgaggaggtcctgaagccaaaggccagcggtacccatcttggtgcttcctgggaccatctggggaaggcttggagacccacagggtgatgaggtagagccaagcctgaggactagggactggatctgacctaaattcctttcagtcatgaagtattgttctagagaggttagagtgtgatgcctgtaggtttatattgatttataacgactctgtaagtgttggaacctcagcaactacaggaagaaaatggagccttgactgtgtcggagagtttgaaggaagaccagcaaagggtgctcatgtgttctagaaatgattgtgtctcttgcctagtcactaatgtccttgcacctaagtgcctcgtgacccaaggtgcctggacacctttgcaacaatgtttatgcatttattttcctacaatgtaaaaacctatgcttagttaaagtggagctgggaaatgggggtgggaatgtttttccaaagctgagggactaagccaaagggggcatgaaacagtaggttgctggtggctgccaaggtccctcagctttcaggacatggacaaaaggctgggtctctcagtgcaagttcaaggtcctggggaaacaaaaggccaggtgttggttagcctaaaaggtggggtccacattgtcagggagagggtttctgtctcctgaatgccaggtttgggcccaggtcctagtttcttgggatcaatgttgcctgtggatcatcatcaacacaacccaacagttttctggttcggaagttggtagcattgtttgtcttcctgaaaggccaggtcattgggcaagctggatctgataatccaggacctctcaggcaaatcagccctgaagtttcagtaagggagttgttgtccttgaatgcttcctggagcccctgtctggtcacaaggttagaacaaggctggccattggttcccagcctggaaacacatttgtctctgctgtggaggcaaagttggcccagcagagctcctgggtcagcagtcctgccacttcagagatggcctggaggaggacttgaaactctgcccttgaaactatcctgggagtgatctcctcagccctaggcattcctgctcacaaatcctttcaccccgaggaagcgcagggaggtgtgggaaaggccattacagttgtcaagttgtgcttctgagcctggttgtccctcattgatcctcacggctccatctctgaggacatttattgaaaccacgcccctgctagtcagagacaaattggtaggctgaggcatgttctgcagtgcacctggtattttcttccagggcaacaaccttaccgccaacatgtcccaaatcaaaggtgtgccttcattgcccccgactccacacactcacctaacttctctcaatgctttcttcacccttccgaatgcactagcctcctttctgcatctaaaagggatgctgaacaggggcttaggttaggacaggactgtgagctcagcgcttggaagtagtttcttgctggctgctgttgggtggagaaactggtgatgaagtaggcctctctggaacatgtgtgcttatatgtaaggctctctggaacatgtgtgcttatgtgtagggctctctggagcatgtgtgtttgtgtgaaagagcttctgtgctttccacagatgtctgttgcaatgtatattgaagtgtactggatcatggaaagaggagacaaaccataaaggagatacagggccagttcttaaggggacactaaatcaaagagaccctacaggattccccaaggaggcaggtttgggggcagtagggggacaggaactacaggagttctcttccctcactggtgcattttcttattcatggtgtttgggtctcacctaggaaggctctgctccaaaacagaagggaatgcggctgttggaggagagtcgggcctcttagcccctgagagtcacttgagaaggccctgtgcaatgtaggttatcgttggcttgctgtttcctaacaaacagtgctgtggcctggtcttccagcaggcccccaactctctagaccataagacatggagcctgttatcaagtgatttagccttcctaaaacctctgtggaccctctgccagagagtactttctcttcctcttggttctatggacggacatttggccttattctaaagtacttgttcaagtctattttagggtaatagttgatttgttttaacagttcagctcttccacgagaaagggaaggtctctgagaccttggactttgttgggtttagacttggattcgaatcctgcctctggtgtggtcttgcttaaatgacttaaattcagacaatatgcttactcctcaggagtggaatgctcgtcactactttgtatggctacagagatggggtcaggggatgcatatacattagaaagcatgtgatcaacacccaagaaagcatgtatgtttcctaaaataccaaaggctatatgcatcatacatggtaaaaaaaaaaaatccaacataggacaagggagatggctcagtgagaaaagtgtttgcctaataagcaagaggacccaagttcaagaccaagaacatacataaaacatgccaggtgtggtgctgtccagcacaccttgtaaccccagctctggggaggcagaaacaggagtatctctgcgacttgctggatttgatagtctagcctatttggtgagccatgtcaacaaacgacactgtttctaaaaaggtagatggtatctgagaaatggctcttcaggttgtccagcaagtgaacaaaatcatgctagtggatagagtctttctttgtgtgcaacctgaaagaatggttgggatcaatatgacgtggcatattattaggcaactttaattttttcacaatgagctgaactattatgtaaattttgcataacttggctatttaatctcatgatgctgtcacttatggtgcaccaggagtgaatttattcctcatcgtgcaccaccgactctggtgttagtgatccgtgaggcaaaactacaacttgctgtagacattaatttgggcttgtcgcctgaattaagctaggctgggtgtgaagccaggcagaaacaaggtaactgtagtaccaagaggcagtgtagcccagaaggaagcatgcagaattggggcataaggtcagctttgcaaccattaacattagaacaatgaagctgtggatggctcccaaacgccctgggcttaactgttctcctccagagaatagggcagctctggaacatctctgaacctctccaggtgctaggggagtggttctcaacctgtaggttgtggcccctttccagttgcatatcagatatcctttatatcagatacttacattacaattcgtatcagtagcaaaactatggttatgaagtagcaacggaataattttatggtaggctgtcaccacaatatgagaaactatagaaaaaggtcacagcattaggaaggttgagaaccactgctctgggggatctctgattagattccacctgccctccagatggctggattgtataaaccacgcctaaggtgataggaatatacaatgtttccaattctccaggagaggcagatggtgggagctgatgctggatgcaggctgggaaggtcctccttggagaattacctgcctagccccctttttcttttctcaggtcctgttgctgttccacaaatctcaccagttgaggtccgccccatccaggtgtgccacacagggacttttgatgtggttcacagcctctgtactcactgtgtctggctctctgccagaaatatgggtttctttctttcagctacataaatgaatacttcaaagggtttggtgaagcttatgaaatagaaaaaatctcttagccacgtaattcagaaaaacaaattaacatatccttttatattgattcccaatgaaggggaggccatataaagtagttttaaagaatgctcacctatttcaaaatcattttaaatacaaccaagagtgcatttaatctagcttgtcacagaattggtatcaagtattgataacaatagggactctctctctctctctctctctctctctctctctctctctctcctcaaacagatagaaactccatcaagaggaaggaaactcaattaaaaattggtccttagctgtgctgggctgtagtcggatgtttgggtgtcagtagactggggtgaagagtggcgtattgattggggagtttgggcttctggtctgagtgtgggaagcacacactctgatcccttagatggtccagtgtaggcataatagtttggccacaagctcctgctgcagatgtgtgattctgcatctactcagggatggccagactattacagggtacctgggactgaggatgtatggtgtgtgatgagaaggaatgcatgggcaaagggagcagaggcattggtgtgggagtctgtgcaggaacggtgtaggaggccaagcacagagggctcttcagccatgtcaccctgcctggaacagagccaccaatagaacaaacaggtctttgtttcctgagggagatggcacaaactggggctctgtgcaagcactttgaggtggatgatgatgtcggaaagatgtggtcctctggtatgagcctgagcaggtgtgattcttctgccctgtctctttctctcccacccctcccgtgtgtgtgtgtgtgtgtgtgtgtgtgtgtgtgtgtgtgtgtgtgtgtgtgtatgtacgctcacatgtgcaaactcacaggaatacttacccacattatgtccttgtcacaggttcgaaggtttctggtgtagttcctccatcttcgttttaaaaagatgtttattttatattatgtatatgagtattttgcctacatatttgttgtatgcacactgcatacttgcctcatacccactagagtcagatctctggaatcggagttaaaggtggttgtaagctgccaaatgagtgctgggaatggaacccaggtttctacaagagcagcgagtgctcttagccactgagccatctctctagccctctccatcttgtgtattgagccatggcctctcactggcctggagctcactgttttgtctggactgatgggctagggagacccaaggatccccttgtctctatctatcccagtgtttgggttgcaggtacatggcgccacacttggctttgtacatgtgtgctgggatctgaatccaagtagatttactcatacgccgagcatctccggagccatctccacagcccagtgattccagtctttacaaacaggaaggagatggacctagatacaaaggttctggtgcagcaaaggcgaggtgacacagagcaaagacttggcttatgcttacagatcattcaggggtctcctcatttgaaccaagagcttgagaatgtccaagtctctgtcacgatgtccttggggcaggtgctgggtttctagtcaagaaactgatatcatctttgttaggacttggatctatttggatacttccagctggacattagtcaccatttgtactgaagaagaaaattagttccatttttttttcctctactagctttctggattcttgtttggatagaagcttgattgcagtatattatgacaagtggcctttagaatgtgtcattttattttgtctcgcactccaaggacctggagttttcgggctgtgtctcccaagccagcctctaagcagtttcttctgagggctgcgtgctctccgtacacaaggccctgaccttgactcaaggccaacaagcctaagtgctgtcccaagagcaagatgccccctctgtggggcctggaagtggggagttctatctgccacgggtatcttgtgaaactttgccagcgttgaccttcctttcttctccagctcaaagagaccaacctcaaagctggacacccacctgcaggatttgatgcctggcctggaggcctccctctttacctccacccatctgtctgaaattcccatcatgggaaccagcttttctttaattctgttgttaggattccccacacaggtggacttccacccatagggagggtttggtgaagcagatgctgatcttcaagtcttggaggcagcccactttcctgtgggtagggaagggtacatacatgcaggcaggcacggccaggggctctggtcaggctttgaggataccaacaggccattttctcatggcataatttcctacagctggccttgctctagcccagtgcttcccaaccttcccaatactgtggtcctttaatatagttcctcatgttgtggtgacctccaaccctaaaattattttcattgctactttacagcttgggactcttaatgtaaatatctgtgtttttcaattgtattaggtaatatctcttcgaaagggtcttttgacccccaaaagggtcaaacgcacatgtccaggatgattgtaacaattccatatcggtcatgtgttctagaacatgaggggagaagggatgggtcattagaagtgggaaagcctctagcttcctccatggataaagtgctcccttccttccacagaatgccctagactgctttccaggtcccttagagacccaaggtgtcccctctgggggaacaagtccagctgagagcacttcttgtgcaagttcctctccagtctttctccctttgccccattgtccctgcatcatgatcatcatgccttctacaaacagggaggagagaggaaaagagggaagcagttgctgtaggcaaagaaggagtgagctagacttgctgccaccaagctgctggttttccttctggcacgtgctctttcagagggagtgtggcgtcatatcttgggcacacctgagcagaagataggagtgagggccttgcctgaatcagttctagaaagcatggtggcacaaggttgtatcaggtatagaatccagacccaagcaccttagtcctctgacagagaagctctctcccagttacaggggaggcagtcagtgtgatttaataagcagccagaaggtatacgccctttctgttgcgttcaagggtgcacagacgctcagtctgggccagcaaatcgttgctgtagggtacttcctttaatgaacacaaagcttgcaaatgttctctcaaagagcataaaatatttagctgcgtagataaaactcctccgtagtcctggttgtactgtgccattcaccgataaaacaaaaaaaaaaaccaaaaaacaaaaaaaaacatcccggtctccagccacattatcctgcattgttacaaatggaaggaatccttgtccccgactgctttcctccttgagtggtttcgctggacctaaaagcagcctacacaaacagaagacgcttaagtgcgagatgggggtgctctgacacagccagtcactctgtccttaacttccagcctctgttgacttagtgctctttgcctgagctcctagtggctcttgaccaagcgcatcagtaattcaatacatttctttctgcccacattaacaggctttaacatagcagtcctctgtgggtgacgtcatcagccactcatttaaacatttttttaaagcaaagttccaacttgggctcaaatataatataaaagtgcaagaatcagaaacttaataattttgtactgtgctgaggggagttagggctattcttagcaatctagaaatatttcaaaggcactttctgagtttttcccccaaatgctagcagtgtttgatggtctgtaagaagaggcaaatagaatgcttaaatctgtattgaattcttagtactatgcacacacatgcatttatgacggcgactgtcctatggatgtcccaggtcctcagggataaggaaactaccaccccaagagaggcataggggggatccaatgcagaggtggggcaggcttgggtgtgaacgttttcttggcagccaacagctctgaagtatgtcagacagagagatgcttctgtaagcttgcctcccggcaggaagtgggctctcctgcctggggaacagcaggtgtctagatgcagctagctggagcagggtcagagaggactaggaaaagacagtgctttggggctcagccatcacagggacacaagagtctggacctgcctgagggaccagtgcctcccttggagattctgaggcacgctggcagctccttctgtagagacacgtgtttacgaactgctttttcataggtttgagagtcttgagtgtcccctctcctatcatgaaacctgggaatttggggatgaagttgttaagtgaaacgtttgctgtgcatggttttaaaaggttgactgtgttggcttatgtttgcagtgtggttggagactaaggaaagagctgacagctataggtgtgaccctgagcagaggttagtttagggagactgagccttcaggctatgtcataacaccagtcagaggtaccctaagaaccaaggcctagaggttctggccagcgtgactgggttccctggagcagatgctggctcagaggccaaggatgaggccaggatgtgggatgtggggtacgcagtacaagcacttgactctcctacatgggggttgggtctgttcaacagaagcaaagagcttttaattcaaaactgcctctttgggctaacctgttcatcttattaagattcagcaaaacttgtcttattagagacacgttataggctcctcagagtcacggtgcctgcctacttctacaggcaaagctgctatgaataggcccgtaaagtttctagtggtgaactttgacctctctgggggacaaacctggaattttcatttgccctagcatccgtgactttcatccaaggacctcagcctatacaggagcccacatcttaagtttcctttaaatctgaaggaaatctgtgtagtaggaatgagacctcccagaaaggcataaaggagggtgtcacggcgctcacaacaccctggctggtctcaccttgcaggacctggaaaagagacacaatcccagcaggaggaggaggaagcccacgagaagaggttttggcctgtggtgtgagcatgagtgtacatttctcaagaactgaccaaatagagaaatgcaggcccaggagactggaagctctctgaaggcccctttgtccaaagtcatggtggtcagcaccgatgcctctaggttcttcttcagtgccttgctctcccagaccaccctgacccaagtgcctgcccatccacacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagagacaccactctctagttattttctcagtgactttcctcatgtattttaacgtcaccagaaatagatctttctgtaccagtctttctgtttgccaacagctgaagtcacctcctgccttcctccgtctaggctgcagtgtgtttcatctccctatttagaggtggggtgtgacaccagaggcagttaagaaaaataagtcttacctgagaccccgtggtacacttcaggaatcaggaattcaatgtctgcctccccattctgagttgggtagactgatccctcatcccttgcttcctgaacctgaagctgctgggcctaagaaaatgaggcccaacctgtgtccagctgaggcaaactgaggtccatccttgagcaggacctgaaggtgggatcctagggattcaagctctgtatccaacctccatctgctctgttctgcctaagtgatgctcagcctattccccgggggatattttctacgcagcatattgcctccaggaggagtctcgacagcagcctgggtgtgtgtctcaagcacagtgggctttgtttggcaaatgatttattgtttgttttattcaaatgcacatcctgaatggatagggttgcgctgggcagagatcgatgagatggatcccagctactttgcttagcctcagcttcttttccatttgcagggtaacagggattgatagctgctgaaacagtggcgtcctttccttatggcttaagggtcgtggaagctggagcgggcaggctcaatttaccaattggctttttaacctggaaggtggggagagcggcaatgccagggtaactgctctgagctcattgctagaatgcttgactgttcaactgtaaggggcttagagggcatactggcaatggagtgactagtttctagtaactaggttaggatgcaatggttagagccagaaactccctgcaggagtccaggacaccctggaaagagagatcctggccttgactgctctgcctctgcgtggaatctctgctggggtctcacttgaggtgccatctgttggttctggtcctcatcctcaaagccaggttcccagagacctagtagaggtgtgactgtccacgtgggcaagtacctccctctgctctacccagacaagaatttggggagcaagaagtgaaccccaagtctggctaagtgaggatcaggacaaagtgccacgtggggaggtctatccccgagaatagcaggcagctgccttctctcctgggcctcagcctcagcaggcaggtgtgtgatgtcacctcagcggctgggagagtgaggactcctttgtactcctgtgttagaactcacatcacacacgaagaaccagcccagaaaggtgttgccttcaaatagaaaaggaaagacagttgcccttctgtcccccactctccttccacagatgtcctgacataatgagaagcgcattttctgtgcaagccttttcaggcaaccgacaaatgaagtcacctcctacccttatgagcggtctgcccaacagtgtcatctggctatctagaaccagagtctgtcaccagctttatgtcagagtgccaaggcaggtgagaggtgaagcctggccaagttcctcgcacatcatgatcaggctcactcactggctgagggagctgagagctcagaaacagcagggcctaagcccacacagagccatccaggccctgttgcctctcacctcagtccctggtgtcacagtggtctccagcagactcccactcagacctccctatagaaggagacagcatatcccaatagaaagtcgacctacagttgaatctagactaaccccaatgagagacttcttgctctgaaaggccaggctggggggactgtgggccctctttaaagtttcctctatgtgcagggctaactgatatttttctgatattttcaaggctcacatgtcctccttgtggtcaggaatgaaatcaaccccacccaaaccatgtctgtcacccactggcaggtgacccttcaggggctacgctcaaacccacagcagtggagtgagagcagatgatagatggctcccacaggacaccccacagtctgcattctcctcaggtggtgttgttcaccgatacagtggggggtgggggtggggggagcacagggaactgccctcagacccaggggagctaaacccagagtgaggcctctggagatgacagtgtggccagaggactgtacccgtccgccatctgtacgctgccaaaggagcccccatgtagtgggatttgcttatttttcctatggtttcatgtcattttaaaaattcagactgaaaaagtctgttgagttgttcaattcaagtctccagggtgtttccctgtcccccggcatgcgctgtggattttcacaagaaggaggggaagttgcaggcttcacaaagctcccatgggaatctcaacacgtggccagggctggaactctgggggcttttgcagggtcgcaagaatgaggtgagactcttgctatagaggaggacaggagggtaggcaggaggataggagggcacagctaatgagcccagagagatgttcactatgggcaatcccaaagtgccatctatctgtgctcctttccctagtccaggaagcactggaggcaagcagctggatagagccagccaggacgcactgtctgtggtgtggcagggtccaatttcaagggtactctttgcagaaaaaaaaaaagaagaaagaaagaaaacaactggggttttgcaggactgagctggctgatagcagtgtgccgggcagctgagtgacggagcagtctcataaacctttgccatgttccccttcagtcttgttcacctaagaaacaggggggcttctatactacactctcaaacaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcactgtttctccctgtcacctatagaggagacaaaagcaggtggcaaggtggatggtttccccaatagccacttgccctggttcccctccccaccttctccccacatcccccaactattccatctctgcttcaccactcagaacttcacagctagggcttcttagcctctagctgaggacactggagttggccaagtgaatgtgctgaccctgagccagcagctctatgggcagctgcggctgcctggaacctttggtagctttcccttccagcacccctgccctggggcagaggcctggagagtgggtccttgagctggctggaatggcatgccattcctttggcatgagtaatggcaaagccccaaaatccctagtgttttctccctgttgttgtctagtgccagggatggccttaccctatgtggagggcagagcaggtggccttcctggaactgagcaccacctaggggcacagtgcagggacatggtggaaacaccctgacttagacctcaggaagcaaagctatctttagctccctgctaggagtcagggagaatcccaattatgaaaggttttgccactcagcttctgatttgaaagtcactttaaattcattttagggatccacggagagttttgctttgagaagaatcttatcaaagtaacctcatgttggagtgtgtgtgtctgtgtgtgtgtgtctgtgtgtgtgtgtgtctgtgtgagtgtgtatgtctgtgtgtgtgcgtgtatgtgtgtgtgcgtgtggtgtgtgtgtgtgtgcatgtatgtgtgtgtgagtgtgtggtgtgtgtgtgtggtatgtgtgtgtgtgagtgagtgtgtgtgtgcgtgtatgtgtgtgtgtgtgagtgtatgtgtgtgtgagtgattgagtgtgtgtgtgtagtgtgtgtgcgtgtgtgtgtgtgtgtgtgtgtgtgcatgtatgtgtgtgagtgtgtgtgtctgtgtgtgagtgtgtgtgtgcgtgtctgtgtgtgagtgtgtgtgtgtttgtgtgtgtgtgtgtgtgtgtgtttgtgtgtggtcaaaggacaatgtcaagtattattattcctcaaattttttggaggcagggtgtgccagttgacccagaattccctgctttggtcagactggctggccagagtagtcccagaatcctcctgtctcctcagcactggctttacaatcatagtttaccaccccctgatttttacaaatgttctgtggctcaagctcacgtctccatgcttgtgtggccaatactttaacctaagccattgtcccagcctctccattttcctttcacagaggctccatatcacacacaacttatgcttctgtttctctgcaggatctcagatgaatttggaatctgaggtaaacattcagaaggggccctaattgcttgcctttgtttcccattgcctgagttttgatgaattcccccataggatcaacatgtatccagcagtcaggtcagtgttggatctggctccaggaggggacatccctgtaggaagcttacactggaaaacacccataacgagtacaaggcacatttgggtggagtttaaacactgtgtcaagatgcgtgaaaatagatttagtcgcggtgtcaggcagaagatgtcttcggaaagtgagtgtctgcacaaattaaaagagcatgtgaggacagactttcaattttctctatgcagtctgtggagacacttataggaatatgggcatggctgctttcaataggaaggatagggaaggagggtaagacatgcgataaggaggactgggagaggctcagtgcctaaagtgctttctttgcaagcatgagggcctgagttcaaatccccatcatctatgtaagaagccaaacatggcaacatgtgtctgtaaccccaatgcagggagatggaaacaggatggtcactgggtcttgctatcctggtctttctaggctaatttgagagctccaggtttagtgagagaccctgtttctgaaacataaacgggaagcccagcaggacagatcgttgggtagaggtatttcttacgtactattcaattgctgtgaagtgacaccatgaccaaggcaacttacaaaagaaagcacttaattgggaaggttagtccatgctcatcatggtgggaaacatggcagcaggcatgcaggcaggcagagtgctggagcagtagctgagagctttaatcttatccacatgtatgaggtagaaagagactgtgtctggtatgagcttttgaaaccccagccacccccagtgaaacactttcctcaacaaagccacacctccacctcctaatccttccttaaaagctcagccactagggaccaagcattcaaacatatgggatgggcctatgagggcgattctcactcaaaccacaaggtgctcgatgccaaagctgctgatcttagttcaatcctgggtgccgcaaggtggaggatgagaactgactctcttaagttgtcctctggccttgaagcctcacacacatacacaggtatgcaaaagtagataatgaaagttattatatacataatacataaacaaaggcgagctaaaaacaagtggaaagtgctagaggaagactcctgacattgacctctgggttccacatgtgcacaaataggtaggtgcacacacctacccacacatgtggacacacatgaacacaatacacaaatacaacatgagatcaagcaaacaggagaatagcagacatttttaccatgaagcacggtctgtttctttctgctcgcttttcttagcactgtttatgtaggatttgatgttgtactggggtgtccagcctctgcacattgcaatgcaatgttgtcatctatgttgtcaaatgtgttatacttcattcttgcatgtcttaagatgcatgtgttcctcaggcagcaatgtgaatatgtctataagccatataaacacccacaggactatccaggcaaatttttgataccatcccctgaatcgtagaacatcaaaaagtgtgcatggatccatggagctcagcacttccatctttgtgcttgctaatgtacaattttaaaacccagaaagtatgagcactgaatactggtagctaagcagggtaaatggtggtcatcattgcaaacggcaaagcaggagaacctgtgacaaccataccgtttctgccttaagcagaggcattgaaaaagtagatagtgcttaggagagagacgtggaagcacacatgcccgggtactatgtgcttgtgtgatcttcagcacttctctccttttctgtattctagaatgtgactggcacatttatcccatcttagctgaaggctggggcggggctctaaggtctccttccagagccggcaagctgatgtcgggtatgcacagtgggctttgcttacttgcctcctgcatgcagacaccattctaaggtcttgatggctgtcctggttagatcttatcagcttgacacaaaccaagagtcatctgaaaggggaaactcaattgagaaaatgcctctatcagagtgcctgtggcaagtatgtagggcattttcttgattaatgatcaacgtgggggagcccagctcactggttgaggcactacccttgggcaggtggtcctgggtcatataaaaaagcaggctgagcaagccttggggagcaaagccagtatgcagcatcctttcacaggctctgcttcagtttctgcctccagggttctgtgttgaatcctgccttgacttcctttcagtgggctttgcaatggaaggtaaattaaccccttccctccccaggttatcttggtcatcatgttttgttgcaggcaaggaaagacaatgaccaacagctgccttcctcctagaaagcaggatccacgagaaagcaagaaaccaccatgtctttaggatctagcctctgaagtcacatcctgtcatttctgtgatctacacatagtgacttgcgttagccatattcaggcatgaaagagaagccagcccattccaaagtgtaggtattgacaaagatttcttaggttaaattctgggtgcatgagtcctggatcttggcaacacatgacccagtgtgattctggttagcacaatgagaaaagaaatggtcagagcaagtttctggacagctctcagaaccaacgctgacgctggcaaacaaggttaagagaatgaacaggggtccaagaagccacagcttgagcttcagtcaagatgaggccacaggaagcttcaagtaaggatgtggccatcagtcctcagcctctaaggccagaagacacttaccatgttaaaatagcttagaacatcccaggacccacatgtcatactgcagacttcaatgctagggtagaacatataggagtcttgtgtctcctgctctgatgtcaggctctggaggacccaaaaggatagggagaccccccaacccccactccgggaagaaagcatttttgatcacccattgtacaggtgatctctccctgaaactggaggattcaggctgctgaaaacctccccctgtctgttcttcactgagcttaagtgttctttcagctgtgctgtagcttgtgcgatgatattaataaatttcgtgattccttatatgcattggtgtggcatagcctttagagttggtagataaccctgctgaaaaagagctaatcctttcagagaacaaatacacttcaacttttctttaagattagaactccctaaagcaggtcttctcaaggcagaataaggaatcttctgtttctttcacccacagtaaggaactcaagggcatagcttgccatattccatgccgagagcgggggacaatgcttctgccagtgcataagtgcctttgggaagaatgaaggatgtagaggttgttagcaaaatattttaaagggtttgggtttactttaatcagttacctacaaggctgtttaaatatgagtctcattaagagctaagcataggtgcccacgaatgaggaaaaggcaggtgtctttcttatacctggcaaggcatacttgagcattccctttcagcatgaagttttgcttctgttcagggcttctgttcagagctccttcaatcatatgtggcagagatggaaatctcttcctgtctgtcctgaaattgctttcaacctttcccaggagatgagcaggctgagcatttgagatgctgggctctactgtggggactagccacaggctgtgcaggtctaaagtagtcctgaggttaccacaaaaggaggactagcaggtaaggagctagacagggacatgagctgggaggctgctgtcattatccaaggaggcaagaaggagggaggaaggggggaggggaaatagatagggaaagaaaggggaaggagggggagaggggagcactctgaagccacaagtaaccatgtccaaaaatagtgtagagcaagccccacagtctcagacctctttaaggaagtggccgcttgagttccttagcatatttcttgatgaggatggggctcatttggtgtttcgttctctggcacctgaacacacaattgtcacatgctggtgttagatgaaatactggcttgtattttctggagagtggctcttcaaaaacactagaacctactcattgcagcaaggtgccccctacccactgggtgtccagtggattcctaggaccatagttgcaacttctgacatttaattaaatgtgtgtgagctaaccagaccatttgatgcatagaggaactgactgttagacatacagtatgttgcaacctgagagtggtactcctgggaatcaatgtcaaattcaacagctcccaaaccagggcatcttgagagacctgaagtcgctactgagatgtcaaggcatcccaggggaagcctggagtccctcacagcttttgtcccattttctgttatcatgactatgtttcagggacatttacatcttgcaattaaacacagtcttggggatgggttgtctcagtcattgggatcagaatgagatgactgactgcagggagagcgtagagtgagtcacttcctgaatcgattgaactttcagaagaaaagcaatctctctttccccggagcatggcggaggactctttattattggttacagttgcctgtggtgagctaaaaccttctccttcatacatggctttctctatggtttatattttgtttagacataaggtacagagagcaccgccatcgtttggctaagataatggatgctcctttcaaatctgctagagaatattgacttggagtggcctccatcttgattggctttctcgatcaacttcgtatccccgcatctgtggtggccttcagatgtccggttcaggcacacttcagagatgattaatgcgagtaattctcagcccttcgaacctctccagcctatctcacatgcttctgagtattgttttaactgataaatcataccattcctttgactgacgagtctgtgatttgtttatgtagctgtcttccagaccctggttccaggcttgcaccctctttcagtaaaccttggctactgacaagcctatgtttgtttcttcagtgcttaaaatttctgagtgggaaagagaagaaggaaatttgatgtgtattcagcagttcttgaactgttttaaaatgcatacgtgggcaccggttgtatcgatccggccctcctatggggaaagttttcagtgccaaagcccatttcctctttttcacatcctcaatggtttttctctgtccactggcaatgtgacaaatttactgttctgttctggattaagcaggatacctgtcgacagataccctgagcccagctgctgtgcagactgatcaaagagcaagtgtcttgttgtgggcaggaacttggaggccttcactttgaatgcacacctcccttcaaaggagtattttagaaaccacggtgtttgatagactggggctatactcataatgtcacatcaaaacatagcattctcttttatatagttctggtggtggtggtagtggtgatggtggttgttggttgtggtgagtgtgtgcacaagtatgtacatgtatggaagtcagaggacaacttacagaagttggtttctcctttccatgtaaacttcaagaatcaaactccggtcatcatcagtcctggtggcaaatgccctaacctattaagctgtctctctggtccttctcagcctaactctctcccaacccccatcccctgttttagctgataattaaaattttggaaaaaaatattgatttttttaatgtgtatgagtgtcttgtcttcatgtttctatgtataccacgggtacctggtacccaaggagactgaaggagggcatcatattcctgaaactgggcttacagatggttgtgaggcaccacgtgggtgctgggaactgaacctgagtcttttgcaagagcactcttaactgctaagacatctttgtagtcccaaggtataagctaggctgtctagtttgtgatcttcttgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctttggcatagcttatggtaatgagccaccaacaaccagtagtcagccaaataacattgaacaaatatgtcagaggttaaggcattggtaaatcagcttttgtacaaaaattagctgtgtggctgtgccaagggaaatgcctgttacatacagaggtggctgtgaggagacttatgtgctctgtttacacctgttagtacctcaacaaatgtgagcccagctacattactctctgttcacgctttcaaatgacacatgtgctacttgatgttaaaagggaaatgaagcctggtattagtgcagcccaccccattaaagcattgtatttgggaaagggagcttaatgtttgttgtaaaatgaaattagaaggtgatttgcattcatggctacatatgcaatttgcttctgtcaactgcaattctttcagattaatttcttccatgatgtgtgtgctgtgcaaataataaacttataaatctccttatacatctagattattatccaaatctttaatattaatgcaatgcagtgttacttgtatgagttcaatgaaaagtaggtaaattttttttactttagagatcagagaaaggagaggtttaaaaggatgatgatgatgatgatggcgatgataaataaagttactattgggtgtctttgtgggtcagggacacaaaactctgaaaatcacagttattgccctagagcatctgctattcagacatgttatttctacagggttccttgaaagacttgcccccagtctctgctgggcctgggtagaagaactgtttcagctacagcctcagcaggtgtccttgcgaagtcacaaggacagtcatgcccagagctgtatggagcagagggaccttgatcctcacaatgtgaacgtgtcaggctcaggttgtatatgaggacagacttcaaagagctagtaactcagcttgggatccatatttgagcctttgtttccttgctaaagataacaaaaaaatgttcgtgtactttctaatttttttagaaaccttttttttttttttagtttgttcacagaacaagcccctctttttgatgtacaacttcatgagttttgaaaaaaattgtagagttgtgtagcctctactgattcttgacatattttatcacctcaaacttctctcttgtttaatcaccctccaatcccatccctacccaggcagccactggggaatctcccaccctgtctccctgcctttcttgtaacagcagaaaaagggactcactttgtatacaggcttgtgtctggctttcctcacttagtataagggtttctgactcaagctgtgtgtacgtaccagtagctcattccactccattgctgagtgacattccacagtgtagttgtgcctcctttgtgcatttcccaattggagacatctggattgtttccatttgcaagcatgttatgaatagggtggctctaatgtgcacatatagatttgagaagacatgggatttcatttctgatggatgaataaggctgagctttcaggcttccacatttaaataaggtagtgacatacacctttaattccagccctcaaaagacagagacaggcacagctctgagttcaaggtcagcctggtctacagagtgagttccaggacagctagggctacatgaagaaatcctgtcttggagggtaggggtggggagatgagacctctgaactattattcctagaggacataccatttaccttcccatgaggtttctatggctctgatctgccttagttggccttaactatgttagtttgacacagcctagagtcatctgagagaagatgctacaattgtgggattatgtcggccatcttggcttgtgggcatgtctatggtggggctgtttttatcagtaattaggaaattgaagcccactgtgagcagcgccattccatttgcaggtggtcctggaactataagctcctgaatgagcaagcaagcagtaccccccccatcagttctagcttcaagttcctgcttgtgttcgggccttgatatccccaatgatagactgtgacctgaaagtgtaaggcaaatcacaccgtttcctctcttaagttgctttcagtcctgagtgttttattacagcaaccgaaaggatgttggaacagcatgtgtgccaacaactgaagctcacttttccttctccgactcctgccctcctcctcgggtgggtggaagggtttcagggcagtttgcatttgtgttttccctagcggtttccctagcaatgcttgttccaatcttttgcctgtttttttttttttttccattttttattagtttttagctcatttacatttccaatgctataccaaaagtcccccttacccacccacccccactcccctacccacccactcccccatgggctttctgaccctgtagattgaattttttattattcaaagcattgttctgatgatgaggtttacagaatggcaaaaggaatgcatgctacccagaagacaatgaaatccatgggactgagcaaatggctcagagactaacagcattggctgctctttaagaggacccctgttttggtcccagaacctacatgctgtcttacaaccatctgtaactccagttccagggggtccaacaccttcttctgacttcttctggaaccagacatgtatgtagtgcatatagatacatggggaagctcacacatacacataaaataaaccttaaaagcgattaagaacttttgaaagacccgaggcttaaagcccctttgttgctgtttttcctttttgctggtaccctgctgatgttacctcatatgcctttgcagcagtggcttgacagtgatggagtatgccccagttcattgttcgatcctgttctgtgaatgtaaatggtgactttaagcctttgcccttcaggctggagcctccccgtggttctgtcttactcagtgaatgggaaagagtggctactttaacttaggatattctatagccatgcttgttcgtttgaactcatagtggaattcttctgttttcttcctgtctggtaaaagcagtgaactaatactgtctaggaacctaacactgataccttgaattgggagccatttcttaatgcagtaatgagcatgcaagcttgtgatttaccattataatcgaaacctctacagccccgtgggcctggtgtattattctgccttattctgctttttcagcatggctttcttgagagaattcatctctttagtcccctgagatgattcttttaaaaacttgtcatggactcttaagtgagcagatacgtcttgatttagtcacaactgaaccagtgacttggactgtaacaccattttcaatggctaagtatttaggaatcataaagtgtgaactgcattaagtgtcatcatgttgctttgtggttcttctattatggaatgaaagacatagatgactgtggtataatattttaattccagctcaacgaaaacatgtacttaccattctcttcctttctgttaaaaagagacacattgagggactagaacaatgcctcagcagttaagaaccctggctgctcttgaagaggacccggcttcagtctccagcacctacaaggccacaccactgtccatagctacagttccagggcattcaatgccctcttcttaccctcattcgtactgcatgtacatagtgcatatctatacatgcaagtaaacgttcatatacataaaataaaaataagtaaatctttttctagaaaattgagaaggaagcaaatgtgatgcatatattgagcattaacaagctatgatttaattgttgcttccccatgagatttcctgactgatgggcatccttcattttatatttatcatattgtggccaaacatagatatgtcaggagctcatggtttgcagtgcaagaatatgagatggacttctctcctgaaggtgtacatagcagagctggctgtgtttgtatggggccatgatgagcctcataaagaagtgccagtaccaggtcaaatttgagtccttgtgggtgggtggagcaagaagactctttcatcagttcgcacttgggtctaactcaccttcctgtcctaccctcaccagatttttatggtgggctgtgacaaatgagcacactcagtaagttcagatatacagacaagatcagtttcttcgtcccttaggctctgtgggtcagaacccagagcatggcttccggtcctggctgcttctctacttctgatcttgacggatgaagttgctgtgttcctgggctgtgttcctttctaggaggactctccttggactcagctggcagaattcagctcctggtggtggaaagatggaggctctcactttccagacggctgtcatcggggcctctcctcatgttcctgctcactggcatttcaaatctggccatggactggggaatttctctcctggtcctctggctctctgatccccttctgcctcctgtctctagctcatttgttcctcctctgcttttttataaatagtttatcacagggacttgtttgcttgtggctatggggagagagaaacacacatgtcggggtacgtgtgtggatgctgtggttggctctttccttcccactacgaggtcctggggatagaactcagggcgtgagtcttgaccatgtgtgccatcatctgctgactgacctcaccagccccttcgtctgctttcaaggacttgtctcgtggcagctgatccactcaggtaccagagaacaatctccctgttttatagccatcttattagcaaagaccattccatctgcagggttccttcccagcaatccctaaatcagtacttgatgaagaaaaaaataaacggaagggtggacatctggggaacatttttagaattctgcctactacttcccccccatctccctccccaccccccgaatcttacccacataaacagcaaaaagtgacaaaatccaaggttctcctgcctgcctgcccgtcgcagagggatttgtttcctctccaagtcaatatgtgctgtgatcgttctgtggtgtttacacgcttggtgcctgaacctcgtggaatgcattatgcatctcttcaggaatactctttacataaattaggatggttttatctttcctgaaaacattgcagcacactatgaattcggtgtagaagttgggaactgctcacaccatgagccccattcaactctgggagaagtctgatgtactgaggggctgggagagggggtgtgtgtgagatataatccactgtgtgtttgaagtttcctaggggttttcttgtaaacatgatcacaatttaatattaagcagctatttagttctgccatcaaaaatacttctgaggtgccttggcagtcagtggaaaataataacccccagtattcattgttctctgtgtgctctactggaggagatacccctcccctgggatagaccaatgtcctctcatgtacagaagaggacttgaggttgggcatagtcctgtggctctccaggctgggccactgggatttcttaaaagtgttcccatcatgagtaatagcgaaagggaactaagttttttgatacagaatcttatgttgcccaggatagcttcaggtttgatctgctgtggatgaccttgaacctggtcctcctgccttaatctccgaagcactgggattctaggcctgcaccactgtgcctggtttacaagatactgaaggttaagcttacggattttatgtatgctacggaagcattctaccagataagctacatcctctgcccaccaacaatcatccggactttaatagttaatgaaggatgtctaagaacgtgctgtgtagctttcatggccctagacacttgccagttgtacacacacacacacacacacacacacacccctcactcctcagccctcacccctctagcagttaactcagtcttgtttgagaaacacgcagaagttaccaagtagaggggacctccgagataaaggctgtgtgctaagggcatcttggaaattaaaacagaagggacagagcgtctcggcttgggaacaagttcaccacggttgtactgaccttgctggttgtacttgacccacgtcacaaacatgcattctatgctttgcagccaggatcctgagtgtgagggttatcatgtgaagggggacactcttgtcttttaagattggcttttgacaaggtcttacagagcccaggcccacccccagctcactgtgtacccgatggtaaccttgaatgcttgctcttcctgccttcatacccaaagtgctgagatgacagctgtgagccaccacagttggctcttctctcatcctgaaagtgtcaggccatttatttaccttcttgagagagccacacctctggcttttgggagatgccctttgataatttaaagactgtcttctttatggatctgttcatcttctctatagacctgtccatctttaaaattatgggtctacatgctgggccttagatgatcagcctggttcaaatctagctcaggaaacttggaacctgacagtagacacgaagtcggaatcgctggccctgtatagccaaaatggcctccttctgtctgttacaagctcccctatgtgggaaggaagaaactcaagtctgtcactttgggccagtgctctattgagtatttagacaggagaccaaggccgtgctttctttcctctgtgcttaagtggcatcaggcatatgactggagagacttctgaaagagtatagtcatctctctagcctcggactgttggccctaggaggtggagtcctctacttctgtggtgtctgaggcagtgcctgtaagagtcttcctgctttagccctgtggggaggtgggctacaggtgtctggagtcccattctcaaagagaatttttcacacacccctgcctctctccaccactgtccctgactccctcgcaaccatgtacccctgtggcatttgcaaactatgtagtcagtcagtggtcccatctgtctgcctctctctcgttcagtttccatggagaggctggcactgggacacatgactgatggtatgctccccgctgcagtcccctctgagtgcctgggccttgggatatccttgttctttccttagccgtccgtctatacatactgcctgggctgccttgcttctccctaatcctgtgaaccaaaagtgaccctggctcccagatagaaagcagctaggccttgagggaagccccgaagataactcagtattgaccttgtgtgagatctctgcaggcaggtgtactacccaagcttgaatctgcttcctgaggcttcctggtcttctcattctttcccttaattgtgtccactgtgtccccagccacactgtccttacagcccatggtggtatctggtgtctacagtcctgctctttgctttcagtaccataccaggagacacttatttccctggcaggaccctgtctctatgagggtaacttctctgctctgctctgcctttaggcccctgcaagtcctgctgactctctccctggtggtgtaggtctcctctaggctccgcccagggtcaacagtgcagttagatattctgagattctgtccaggaccattgctaaggcagaagcttcaggaagggctaacacttggaggagaagaagtacagattccaagcctgcccaggtgtccctctcttgatgggctgctggtggtggcctgaaagactgaggtttgcagtttctgagggactggcacactcacctttaagacctatcgtttggtatcaagaaggcagttcccaaatctatagcatagctattcactttccattgaacctaagcacattgtgtgcgtgtgcgtgtgcgtgtgtgtgttgctgaaggtagaacccacccaaggacttgcatatactgggcaagtattcttccagtgagctacattcttaatcttcattttacttttaatttgagacaaggtcatgtgagtggtgaaggtactgtttatttattcccttataaacagccacaagccaataaccacgacctccatcaccacaggtgacaggaccccatgctctactgtgcctagactatctcttaaatgagcatgggtttggacattgcattaaaacaaaagcctccctgggcttgcttgacacagcttgtgcttttatgaaatgctaatggtattgaatcaactgtgggacgtttatatattgggctggctttgatcaggactcctcactttccattctaacactgagtcccgggggcctaagaaccatccacctgtactgagcctgcatactgctcagaggtcttggttgggattggaggcagcatcctaggtgttctctgttgagaattactctggcatctgtgcatctgatcatattcctctgatttcacttttgtagtaatcctagcagggagcatggggctgtgtgatgtgcaggatatcctaactgtagtgatctgggtgagggaagagttgaaacctgggccccaggaacatcatgacacctcccccacctccagtcatcctgactcatgactgtgaaccaccacactgggcagacactcagtggaatcctactttctgtatagctatgacccactgcctgttgctgtccttctttaaatgatatcattaaggattcttggcacagtgatgtagcttaagagtcactgtgggtattgagggcccacacttaagaccggcatctctccacactctgtgagtggtcccaaccttttgcaggcctaactgatatttttatctctaagatacttggctggtgagcaaagcagaggggaaggaagagctggactccctgctgtaccttgtactaatgagtttccggtcttaagcatggaggttagtgtgaatctagccacatgatggggccttttaaaagtctgcaccactagaagaaaaaaagagctagctgccttcccgtgaaccactggattcccgctctgtccatcactctgagcatctggcttctctcagaaagacgggggatcaagtgattcacatcatttgcccaaattaagccatgagtggaatgtataagcatcctgcccttttttcatgcagagaagaaataggagcaattagccacactggcagggggcactttgtagatgaggaaacagaagcccccaggtgttgtttgtgatccaggtggaataaatatctctagaggagaaagaaaaggggacatgtcctaggttatgcttttaaagtgagctgtttgcagtgtgtttgtgcacgtgtgtgcacttgcgcacatgcgcatgtatgtgccctaattcctgacttacatgtattagtaaagacatttagaagatgaagtgggtagttccttctcacgtatccttggagagagagaaagaaagaggggcttttattctgtgttttacccgacaacagtgacagcctgcccagatatgatgctttttaaaggtcaggcagctggaggtttgagatctgccacaactggctttgaggagagctgcctgtttagggcccatttggggactggattgtgaaaggagctgatgaactgagaagatgcctggatgagatggttgtgaaggacttggcaagcagaccttgagtggggaaatgtgctgtgcagcccagacatagatttcccagacctggagctctgctcaatggtgactctaattgttaattaagtggacactaaaaagtgagcacatatattaatataataattataatatatgtattactacaattgatactgcatttttgtagcttgaaggtatggcatgttggtttacctgtctgtgtgccttgtgcctatgtgcatgcatgtgtgtgcctctatgtgtacgtctgtacgtgtgtgtgtgtgtgtgtgtgtgtgtgtgtgtgtgtgtgtgtgtgtgtgtagaagcctgagttcaacatatgctgtcttcctcagtcactttccccattatcttttaagttgggatctctcacttaacctgaaactcacagatttgcctctgctggctgaccaagggctcctcctgtctcctccaccttccctgcctctaactagtgctctggttacaggtgcacagtactatgtgcagcttgaactcaggtgtcatgtttacaggacagacacttaactgaaccatcttcccaggtcttaatgctcctttttaatattcagtttttgcaacatatgcagagtgcacattgcttaggtagcatccatgccactgtaactgcttggggcagtcacctaatattacagcagatctcatcagaagtctctaagtctgtcatctccaaccctagctggaccctgaaaaatgtcaaggtgctccatgttggactccattaccattttttttatcagatcttccctggagaatgtcaagaactcagcatgtaaaagactggctgccatgaggttttccctccctttgagcaaagtttcacaaatgtcgttttgaacaagggctgtagaccagtccacaccggccgttcatcatatttaagtagcacaaaaagtaccaccaaaatcattttaaagacatatccttctagatatgtcataggagagccatttgtttatggcttgcacaatagcctttttctgtaagatgtgttttcagaactttttcctctcagtcataaaaaggaaatgtatctatccacagatacagaatttaccatcaggacatttagttttttttcattattctttattttaaagaattcccagctttctgaaggataacatctgttaaccttctactttggaagatgtgaatgtaacctgtggttactctaactagggctcccacatttgaagtcttgttattgcaggaaagaaaaccatgctgagatgtaaacatggggttcctccttgtcgggagcaatcacagcacactgctcaaccaagtacagtttaccagggttcttaagcagatggtgaacacatcaatgactgggatctgtgactgggatggactctgaatcgccttagggagcctgcaccaacacaacccacctatctttctttgcagcccctatttctgcccacctggatccctgtggaacctcattgaccttgaaatcctttcccacagccttaaactggcctaagaacctggtctgaccttggcattctctgatgagatggtcaggaagctcctggccagccctacacatggattcagtctacatagccagtttgtggcatgccgcaccttgtcttagctattgttctattgctgtgagcagatgccgtgaccaaagcaactctttaaaagcaaaatatttaattgggggcttgtttataacatttcagaatgttagtctattattatcatggtggggaacaggcaggcatgttcgctggagcaggaactaatacacaagcagcaggcagagatacagagagagacagagagggaaaaacagacagagacagacagacagacagacagacagacagagacctcaaagctcattcccagcagcataccccctctaacaaggcctcatctattccaaggaggccacacctcttaatccttccaaactaggaaccaaggatgcaaatctatgagtctatgggaggtattctcattcgcacaccaccaccacatgctcttaaggaaccacaagatttaagccctcttggtggaccttatctacacactgtgcttttgtggaagcctagaatgctcatatcttgcctgtatccacatttaagccttgattgtgaggtaattctttcctcttttcctgagtgaagtgccacctgcttccccagcaaggaacatattccttccctgtgctagaggcatgggagacacagatgagccctcttcggagatagaataaactcctgcatagctaactgccctggtattgcggcccacagttgacttgtgtgtatcccatgtatacctgtgctatctctcctgtgaccttggcacctagcagtcttccctgggcattcaggagcacagcaagtgcttaggtgccagacaaaggaatggggaaccccaaaaggatgctcagaacagactgaggagggaggccagaggcatatgcccgaccaaagtggggtaatgtcccagaggctctccttgaactgcagtataaagtactgcctgtttgtaggcagggcaggatgggaaggggaaagtgggttggtgggctagtctgtcccacttgtggaaaggagaaggctctgggagatctgaggtcaaggacagtcagcatcacagacagccagtaccacaaacaataaacatgccatcatctaataaagatttcctaccaacttaccctgcctgttcctccctcctgctgggggcttggacagttgacagttggcattcatagggacagcatgtgtttaaggaatgtccactctgtactgggctgtgacactgaagcctcaggagaggtcacagaaataattgccaaggtggggccattaacagaaaacagagccacatgggccttaaagaaggatggagcatgcctagccactgtatgcccagcttggacctcaaaatgataccacccctttgttttctcagaaaagccaggaatctaaaatttttatgtgaaatttctaccaggtaaactaacaacacagatttcctggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatgcattcttgggtttgtttactttttcttttgactccagatattcatccctgcccctttagtaaacagcttccccctcttccgtcttgcttaaaccataataagtcaagtccccatctggaaagctctgttgtcatcctagcaagtgaacacaggccccagacctttgcccagggcctagtgccaagtgattgacagactagaggacaggtaaggactggtccttccagcaccccccaccccagtcccaccacaccctcggaggccaagttcagaggcacgatccagaatgtgggcacacgttgatctcattagcacagactgtagcccgtggggaatagctgaagaaaacaggcaaaacgcagacgtgtctctgaaaagctgagtggctttttatatcatctcacccagagaaagtaggtcagcatcccaggagatgcaggccaagtctccggcagaccaatcaggagcacttagagtgccctcctcatgcctggaagctagggatcatgtgtcagagtcatgcacgtgaggagggatggagagagcttggaggtccaggaagggattttataagcaaggaagaccaagggatgctgccccatctgccatcgatcagagctagttaaaatcatcaggctgcaagaatgcaggagaaaccaggaggctgtgcgtcctgggccccaggcagcctaatgtagatttgttttaaaaaaaaaaaaaaagttctcttacattacctgacattcttcatttacaaaaccaaaccaaaacataatgaaacataaactaaatctatgcctttgggggcacatggtttgattctttgtctttagaattaaaagcaaacatggcatgtcataaacatggcatggaatattatccaatcataaaaatgaagtcctacgggatgagccttgaagacattattatcctaagggtgttaaggcaggtttctgaaactttcagctcatgtcaccttgcaccttgggaattgttgctcaccctgggtgtacgcgtatcttagtttctttttctgtcactgtgataaaataccttgacacaaacaagttagagagagagggtacattttggctcttagttccacggtaaggtccatcgtggctgggagggaaggacagcaggagcctgagccacttgttcacatggttcccttagttaggaaacggccatgggcgtgcagtgctgctcagccccattctccactgggatagtttaaatccctgcctagggatgatgctgtcttctcacctccatgaacacaaccagccctcaaaggactggaaagacagttcagcagtaagaacactcgctgctcttttagaagataagaatttgatttacagtacccacatggggcagcttacaactacctgtaactctagctcccagggatctgataacctcttctgacctccaaggacctacgcatggtatacatacatatactcaggcacatgtaacataaaactaaattatttctttaaaatccaataatcccttacaaacaggcccagagagccatctacctgattttgctagattccatcaagttgacaacatcaaatatcactataaattctggtggtgtgaatgacaaatgtctcctacagtctctggcatttggatgcttggtccccaggtggtgctgtttggggaggcttaggaggtgtgggcctgggtggaggaattatgtcactgctgacaggctttgagagtttatacactcacatcatgtcaagtccactctctcagcttcctgcttgcagatggtctgagccttcagcttcctgcttccggcttccggctctaaccattatgcctgcctcccattatgctatcctcaccattatgaccccagcctcctgggactgtaagcttcaaataaactttccgtacgttggattggtcatggtgttttatcacagcaatagaaaccctaactaagccccacatcaaacatttactggtaataagtcataatgaatttcattctaaaataatgctttagcatccatcactttccctgttttatagagatgaacgcggatttgcatgctaaggaggctgtgtgcttgtttgttttcacacggggaattcagtccccactgaatattcggttcagaagaggagcttctgcagtgttttatggagctgattgacgtttttatttcataattgctaatgctgagaatgtcactgttttagtcagtgttggtattgctaggatgaaacacagtgacaaagagcaactggagggggcagggttaacttctctcccagttccatatcacagttcatcatcaaagctctgcgagcaggatctcaaacaggacaggaacctggaggcaggagctgacgcagaagtcatggaggggtgccgggcttagtggcttgttcttggcttgctcagcttccctccctccctccctcccttccttccttcctccctccctcccttccttccttccttccttccttccttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcctgcctcccccaccctcaaatttccctacactggggcattgagccttcacaggaccaagggcctctcctcccattgatgcctgacaaggccatcctctgctacatatgcagctggagccaaggattcctctgtgtgtactccttggttggtggtttagtctctggcgagccagttttcttatagaaactaggaccaccagcccagggatggcaccacccacaatgggctggaccctccttcatcaatcactaattaagaaaagggtcagaggcttgcctgcagtctgatcctacggaggcattttcttaattgagatttctgcctctcaggtggctttaacttgtatagagttgacataaaacttggcagtacagccctttgcataagggtagaaatgtgtttagagtcattttggaggtattctcttctaatcaaaagttaaaaaagaaaatcatcgaacatttttttcaagtaaaacttctttcagtaatcctgaaagcaacgtttacattcaagcattctaacacaacacgatccaaagatattacatgttgagcagtgaccataggaaaatacttaacgtttttcttttctgtcattggaccattgtgttttcctaacggcagaaaattctgtgtgtccagtaaaaatactgtaggctctaacatattctaatctctaatcgaagctatcttagtcaggatttctattcctgcacaaacatcatgaccaagaagcaagttggggaggaaagggtttattcggcttacacttccatactgctgttcatcaccaaaggaagtcaggactggaactcaagcaggtcaggaagcaggagctgatgcagacgccatggaggtatgttctttactggcttgcttcccctggcttgctcaccctgctcacttatagagcccaagattaccagcccagagatggtcccacccacaaggggcctttgccccttgatcactaattgagaaaatgccttacagttggatctcatggaggcatttccccaactgaagctcctttctctgtgataacttcagctgtgtcaagttgacacaaaactagccagtatacaagccaggatctttcaggcagcatttattggtactgtgtggtgtagtggtatgttcaggacaaaatgcatgtgttgtgtgttcacaagcaaggctgtggtgaagctgggtactaagataaataaacagaccacaggcaatgtgacgttatgtatacgaagtccctaatcaactgcaaagataggaagcagaatatggtggtgtcagaggatggaaggaagagaggcgaagtggtgcttagcacagatagagcttcatctgggaagattaaaatctactggacagggacgatggtgttggttgcaaactgtaacaacttctaaatgcctctcgctgatctcagacaaaatgagttaaaatagagagttttgtgttgaatgactatcagcacagaatagtttgctggcagttttgattgagatctgacacgttttacatttccttattcatgacatctctctgctttctgagctcctgactttgtagtaaagtgtcctaactctcgcactgatctcatgcctaccttcaagcttattggtggatgtttaaatgtgggatgctaatgtcaacagtactgtgtttttaaattttcaaacatcacttgtttacttcttgatataacttttaaaataatggaaattttatatttacctcatgcgctgaaaatcttgcagccatcaagtaaattttagaagactcattggttaattaattgtttcaatttctacatttttgtatttttaaattcgctctccccttgcagtatctagaactttttggcatggtgttgaaatggagtactgagacacaggacagtcttatcttgttcctgttttcataagcaaacatctgttttcttataggcaagcatgtcttttgtcagcatcaagtgtaatgtcaggtttaggttctttgtgtgtgtgtgccttgtctgttcctctgccccttagctgggggttttccttatgggtcagtcaacatgctgtcagatgttcttcgatgtcacttgaaggaccctgaggtttctcttctttagcctgtcagtatgatgagttgtattcattggctttaaaatgtgcagccaggtttttggacctggactgagtcctgctcagctgtgccaacttctttctcattgttggattcaacttgctaacattttgctgagaattccacatttctgatcttgggagacgatagcttattgtttccttgaaatgccttggttcttttagtacgacactggcctgggggatcatgaagtagaccctcttctcccatcatttgggagagattatggggaattttaacttttccacaaaggtttgctaatctgctcatgctgctttccatctcaaaaaaattgattgttacttattttttctttaataagtatatttctgttcaaagggtcaaattctctattgtgaaggtcagaattctaggttggttctaggttaaggcttggagagggttgggagggacagtgagtgtttgcttaaaggttgtccttcacaccttaactggtcatctgcttgcttacacacccattctttcttcagtagctgtcttctcaagctatctgctatgaataaccccggccccaagaaggtggtgtgcctctgtctcacgccttcctgtgcatttggtcgagctgctgggcttttgtctttaatgtataattacagctctttggtttcatcctggcactctagagctgaggcagaaggattgttgtgagtttctagccagcctgagctacagggtgaggccctatctcaaacaacaataaaacaaacaaaaccaaaaaagcaagaaacacaaaaaggataataatcacacattctgattcatgtagactctgctaatttttattttatagaaatcattgaaatgagtgtgacagaagttacctctcagcatctgaaatgattgccaagcagattaaaagtgcaaacccagtgcgaacggtggtgggggaggatgcctttaatttcagcacctgaaaggcagaggcaggcaaatctctgagtttgaggccagcctggtctacagagcaaattccagactggccagtgctatccagagaaactctgttgagaatcacagacaaagccaagataaaacaaagcaaaaaagtaccaatccaccactgtttggaaggcggtatttagagtgactcacttttgagtatcagaatgtggtttggggacatcaggtacagagcacagctgtagagtcagacctgcccctgtggtcctggctctgccaatagatcttcctcctaatgtgaagaataactcaacccttcctggttacctgtgaggtttaggggtaggtgggtgatgctacaaagtgtctagcggcatgcttgccaggccatcgatggtgttgcttctatttattcattcattcattcattcaaaggttgatatgttgggaatgtccacagtgctgtgggggatgaaaggatgtaggagtggtgcctgtccttatagagaactcagtctcttgggaggctctggctgatgcagacaagatggaatgtaatgagaggtagggaagctagtgactgtcagaagcgggtcagaaaggggacccgctccttgtacaagcttgtgggtccctggggactcagggtctcatcactgaagagtcagggtagcatatgacatgctgtttgtcatgtcgtagggctaggcaggccctcttgactgttgtctgctctgtaccctgcacccccatactgaagatatccatagacaactgcagaaaggtgcagtagtaggagggtggcatctactggctccctggtgagacggctcacacctaggatgcccttgctgtccctttccagttgcttggtcagcatctctggccataatccctttgggaacatttttgccttggacccatggatctgacctggtctttgacactcagcttcccagactctgtgcttccccagtttctgtctgcctctgtactccatctgggccctggaaacctggataccccacacctctcttcctgaagcccttgctcctgtgagctcagtaataaacttgatgttgtgtatgttctgtcccccccccccaccggttgcttatcccagcttgtccaaactgtgggactttttcttgcccagaaacgagccatcccacgcagcctctcctctgattgttccgggaaccctcagcctagccaggggcggccatctcagtgcagagctatgggtttccaagagcctagagcattttttccccacgtgtccctcacgcatgtggccttctttggaggcccagatgggcttccttcggccctcacaaatgaaaaccattagacattcagcaagatgctccagctgcaatctgattctttagcatcgttactgaggacagtgtcctctttttggatgggggctggcggaggtaagatgagaacagtgttggcttgttggggagctgcttggaatgctcccagcgtggagaattgaaaatgcatctttacaggcttctccggggggtgtagctgggtacggcgggtgagggctggtagggaccgtcagctggcaatgccctccagacgatgatttctcttctgacactgggcaacaaaatggggtgccaaggaccaaaggtctcctggggggcttccaggagagccttgaacttgaaactgtcccgtgttgctaagcacaagagtgttgttggtatactcaccaaggtagatactcagttgttattgaatggtcaagtggctggtcatttggggtgagatggaccttcttgactgttttgtatgggggtccaaactgcaggtgaacagcccatacctaaacattgtacactccaggtatcagacatggctaggactagaagagccactggttgtcctttgcagtggtgagtgtaactctctccgtgcctggtgtcacctgggtcccttgctagctatcactgcacttggtagtccacacactttaagtgccactgacctgaaaacccaaaatgctcccaaattccaaacattctgaattcagacaagatgctttgtgtggaaaactcacactcacacgatgtagcatcctggtcatgatgcaggtgcactaaagaaacagatgaaaaggtgccttctggggctggatggaagcccagtcaagcacttgtcatgttatcgtgacaacctgagttcttgggtctccagactcccccccccccccccgcgccataaaaagctgtgtgtgatggttcttgcttgtaatcacacaccaaggtcgcagagctaggcagatccctggggctcactagcctagttggcaagctccagactagttagagaccctgtgctaaacaaataaacaaaacatcaaaaaaggttgaggctcctgagaaatcaacacctgagactgacatctggctcatgggcacgtcatgttgtgtgtgcactcacacatgcgcgcgtgcacacacacacacacacatgctgttgtacaaaagcatctagatacctgtgtattctgtatttgtgagacataaatgaatgtcacgcttagccttcggttctatccccaagccaactcattagataaactcaaatatttcagaaatcctgggggaagaacaaaagctggaacatctatggccccaagcattttggacgagagatgccgaagctgtttttattttaccttaatgtatttcttctcgtctcctacaagtctatcagcagcattagggggaagctgagctgtctccctgatactctggcagggccaggcatgtggtgggtgcttggcagacatggatggatgagtgggtgagtgtgtgtgagagtggggagggaacctgctggattcttggcataaacagcttctcggagatgatggtgggggagactctgtggtccagtgtgtatccctgggatgtttttaatactgaatgatgagaaatacaggaaaggtttgggtctttccttcactggagcccaggagtcaaggagaaagctaccccttagaactgtgtagtcatttggtagggggaagaagatgaacagaggtatctcaccactctatctatgtagataaaccatgtaaatgaaatgcccccgcccccaagtttggtagaccaggccagggagctctttcttaaaactgtcatatcactgtgtgaagtgagaaagtttgccctacccagaggggcaagtcacgtgttcttagaggttctgctaccggatggtgacattcagtggcatcccctagtgaggaagaggccaactcccttgtgggtggggttgggtagattggagtgtgccttgctgggtagggacctatagggcaggggtggggacaggatggggtagatgatgttgtcctgatgtccaaggctctgcagggcaggggtggggacaaaaaggattatcctgttgaaagcatagtatctagctcaagaatccctgggctatggtaaggcccagctatgtcagaagtccgtctgtcagcaggatccaaggactaagggacagcagagtgtgttagaaacgttaaatacaatgaatttggggaagatagaactggggccccaggttgcaaaacaccaatggagaggaaatgtagctctgagaaccagttgtggaggaagccacagatggcatctgcggccagagatacgggaacaagcagttaatctgaatgtcctgggccttcttcctgtagggtgcatcaggggcaggtgaactgcaccatctaaggctgtgctgagtgtggttccttctctatacctgtcacacaacagcagaaatgcctggatggactcaggtcctgcgggaaaccttccctgactgctggccaggccagggggcatcttccctaagacagatgtctaagtaaatatcatctcctagtgtgataacatgatcagccagagtaggtgctcagcaatgctttttaaatgagtgcacggtgtctttgataaatgagtcgcctgcagtgagaaaggcacttgctgagggctggatcagcatttggacggtggcattcgtggaacagcccacctgtaattccagcccattgggtgatggaatcaggatccccggagggagctgcacagttagattagcccaataagtggagggtaattgaggaagacagtcgacattgacctctggcctccatctgcgcatgtgcaggtacattcatgtgagcatgcacacatacgcgggagtaaagtatagtttaaagacagtaataatagttgtctgtgtctggatgggatgacagaatggagctggcagattcacagaggcagaaaaggatgcctttgaccctggggtgcttaattacgggggatgagtctgacctcacctggagtggcattttgtgagggagaggtgtgtgtgtgtaggagaggagatgagagagagggggtgggagtgtgtgagagtttgaatgtgtgggtaagagtgtgtgtgggaggtggcagtgtgaacatgtaggtgggtgtgggtgtaggtgtgactgtaggtgtgagcatgaatgcatgaatgagcatgagtaacggtgcaagggtatacaaatgtgggaggtgatggtgaacatgtgtgagtgtgtgcatatgtaggagtgtgtgtgtttgcaagtgtggaaacgacaagctggggtggtctgctatggacctcagagtatctttacaatcctggtaccaatacagctcatgtatggctcctggaaaagccagggccctaggcagttctatctagaaaaacaaaaatgtcctggtcaggaaaagagtggggtagggtgaggtgtgtgtgtgcacctagagcaacctgcatctaaaccctggctttagcgtcccctgtggaagggaatccaagtgccatctcttggaggtctcctctctcgtatcttttgcaaagctcctcagttactctgaaagcaaatgccagggtcatttaaagtcttacatatttttccttctggaatcttcctacctccttgccgtgcagcctgctctgaaaagctgaacgtgtctgcagttgaacccagagaatcacagcccacgactcacctcagccagcaggaaattattagcttcaaacttctaggaaatgtatttccagagacaacgtttctagctgtctctaagaatgaatgaaaggcttcacttcatttgttttaatcccttgcctacccatggacagtttgaaattttgggggaaggattttcatcgttattaataaacagcgttgcctgggcaatccacttcacagccaaaggcactgtgttagactgcagtcgtgagcaactttcgcatccctgtgaatgaaatacttgagagaataatttcagaagaggggaggtttgttttgctcacagtttgggagggtacagtatgtggccccatggttctgtggctccgtgagtctccatctgtggcagggagaatgcaccaggggatgacagaggcacaccactggtggcacacttcctctagccagacctaatcttctatagtttctaccaactcccaagacagtgccaccagctgatatccatggtatagcacatataccatgagggacagcttacatcctgcataacataacagatccttgtcactgagctgaggccgatggcaactgtgactttgagaacacagaatctactaatttcttaacaatttctttattatctacatgagggttttgtctgcatgtatgtctgtataccaaatgtgtgtctggtgcccacagagaccagaggagattttcagatacactgagactgggatgacagacagtcatgagctgctgtgtgggtgctgggaattaaacctagatgctctggaaaaacagcaagctctgttaaccactgagccatctctctagagcctgtaatgattcttttaaaagctctttatactagctaaggccatgctacttcattcttggcaagggcttgtattcacctggaactttgtagtacacagtgatcagaggctccaggacaccggccttctgctgaaaggacacagtactgctgtctctgagtgacaggagccagccagccatccttcatggatgatggatttgggccgatgagcccctttcccagagtttctcagacccctttggagagtgcgccttgacctctgaaggtctgcccaggtcagattccttaaatgagagcttcatggctatggtaagtggtgtctgcccctttagccgcatcttcaactcaaaagttccttgatgatatttttgtgactatcaaatggcaggaaatagatgctgccttccttaattttatcattccaaatgtcacgaggatagcaaggatctttacaagacagaagaagaacctcattagtaactcccatggtaaccaacccagctcgatctcttccttccctgtctgtggctattttcagttcttaaattgattggcaaccctgtggaaatggaggggggggggcacggaatgtacacgcccacttcaccaggggctgaagagcctttttgaatcttgctccttcaatgccatccctggtgttcgcagaaggtgacagccagctcataatgggaagtgattgtttctttctatgagaaagaaataatggtttcccttttttatcctcgtgtagcttatgttaagatatagctcataaatggttccatttttaattcagcttacagttgattttttttcaaaggcttaattgtcttttgtgtgtgtttgcctacctgtatgtctgttgtcatgttcatgcctggtgctagtaggggggcagaagatggtgttggatcccctggaactggagttacagattgccatatgggtgctaggaactaaacccgggtcctttgcaagagcatccagtgtatttaacagctaaactgtctctccagccccttatgtttcattcttgagcatggatgtgtaatgtactttagtggtttgtcattagaagatgagactggctatattttcactaagcatggagaccctcgagtgcagttaaggtttgaaactgtgtcctccagtccacctagctcctagcggactgtgtcagagctttgcaggatcaaggtcctgtcagtgtcccaccctgtcctatcacaggttatcagacattgagggtactggtgcctcagccagccctggacacctgggagctatgtctcttcactatccacacaagccctcctgcttctttaccttgctgtaaagtgccttgggtcccccagggcaccctggaagcctcagcaatgtcaccagtgctcacacgtgagcagatggctccagtgcacatgttgacagaccctcacttgctgtacaagagtagatctgctgatgttcaataaacatctcagccgccctgaaggagggcaccttcatttcactcctgaggctccagaagctccagggtctcacactgcacacttgggtggacaggtttctgcctgcaggacccaccacctcctaggcttcttgggctggtaataggaggaatgaaagcctagtggttatggcacacccagctccattatggctgtgagaggagctgtgagataaaaacttgtgaatcagagttcctcttttaaaaaatgaatatgatttaaatcagaaacctatctccaggcacacagtttgtgcctccagctaaaaatcttggtctagcagaaataaggctctgaggacaagtcagcacacactttatggtgacatccagggccacactgttttgtgacagccattaggtctcttgacactgatggtcatctgccacccagcggggaaaactcatatgcatggatgatgacagcagtaactctcagttgcccatattttgaaagtgagttttaagacaaactaaacaaatttattcatttgtttcctggtatgggcagaattaaaaaacaaatacctgttataatatactagaatatcaactcaaattaagatttggaaactttattgaaatacaacacatttacagaaaattgtgggcatacaaatgcatggaaacttatcaggaagccattgtggatctaacactcagaccaagaagttagggtgcccaggtcttactcccaacccccctgttgctataattaccacacctcccccctctctgtcagtggttgcctgaatttgaaattacatatatgatgtacttgttatgtttactgaacacctactatgtgcagggcattgcatggctttccaatggatttaaactactttccctggctgtatgccagtaggctgtggccacagttagtgtggacgtagctatgtgtaacgccaacagaaagtgtcctgccaacagtcttttttcattatataggggccagaaggcacaggtacccaagaattcaggcataggaagagggggttatgtgtatttgtgatatgtatgtgtgtatatgcatgtgatatatatacatatatatatatatatacatatatgtgtatatatacatatgtatatatattctatatatgtttataattctagtgccaggaacatggagacaagtggatcccttgggcttacaagccagccagactaatccacttgccaagttccagatcaacaagagaccctgtctcagaagaaaacaaggcagatagtagctgagaaatgacacccaagactggcctccgaactctatatgcacatgaaccaacacacatacacatacacatctacaaacactcgtccacatagacacacacacacacacacaattcatcttgtgtgacaagcaccataagagagacgatgcccagtgaaagcacagcccccaaagcagagagacaccttccagccctgtctctccacagctaaagtgcttttctccactcttcctgtgggccccacctctgatgcctggagtcaacagggagggctagagagggaaggaaaccccaccctgcccttccccacccccactatgacccccttccacgagcccagcctccatcctgctggctgttatttaggcgatttgtgttctcccccactaggcatgttagagaaagagagcccaattgtatcattcttggtctaaatggatttgggggtagatgctgcctccccaacttgctcctggcttcattccactgtgacataacccatgaggttataataaaagtaactgggtggctgagagcattaaattgaaacacttctttggaaacaccaggcaggttcggactcagcaagtgctgggtcccttcccctggagagagaagactgcaattgtgcctcagttgggtcctgagcttcctgactgaagtgaaacaaaggcttgtattgttctagtccctgtgaaagaacattcctagtctttcaggaaatgcaagcctttttttctggtactatgtactatatggtccaagacaacttttattctgtaagcagttaggatttgcaaccatgattcttatccttccattcccccactaaaaaggcagtatatctccttagcaactgtatagcaggtttgcatcagccctttgatgaaagcttctaacctgagatctgatactgtgatactcaaattggaaggctaatggagtcaagactgcactgggctagtccatcttttcaccttttattgccttacactaataacatgcatagagagatgggggatggaaggaggcctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatatgcatatatacccccacacatacatattatatccacatacaacatgcacactctcattcatacaaacacagtgtgtgcatgtacacacacacacacacacacacacacacacacactagcataagagcctgaatgtttctctctgacacatacaggcctccaccaggagaagcaaaggggaggaaccccagagagacacctcgctcaccacactggggctcaccacactggagctcaccacactggggctttctggaactgggttgctgggtgtccccagaagtacgctcagtccccgaagctggccagtggcaggcagttgctttgaggattcttgcatcacccacagctctgtgggggttggttggcgttttcagaattaatcagaagcacaactccaagctaagtgctctagtcacacagtctaagccaccacgaccgggtgcctgccctctgaggccagcccatctttcctcccacatcttctatcccaggggactgacttccctatcaccaccatcatcagtgcacaccctgcacatttttgcttagctgggagcagctcctcaaatccaccagtggagcagatggtgataggaagctgctggtgcatcagtggccacgccccaactggaagggtggctgggcactgctaacaaaaccacactcccccaactctgaagcttctgctattgactctgcttgtgttccccttactctgagctgaatttgctagaagtttgcagaccctcgttgtgactacattcacaaaagccaacctggtattgtcctcttgttcttaggtggataatggaccttttatggggaatatctattggagaagctctttgtgtgtctgtgtgttagatgtgtggtatatgcatctgtgtatatgttggattgtggtatatgcatttatgtgtatgtgtgtctgtgtgttagatgtgtggtatatgcatctgtgtatatgttggattgtggtatatgcatttatgtgtatgtgtgtctgtgtgttagatgtgtggtatatgcatctgtgtatatgttggattgtggtatatgcatttatgtatatgtgtgtcgtgggaggatgtgtggtatatgcgtctgtatgtgtgctggatgtgtgaaatatgcatttgtgtgtgtgttgactgtatggtataagcatttgtatatatgtatatatgtgtgtctctgttggatatgtggtgtatgcatgtgttcatgtggatgtgtgcggatgtgtgtgtacaggtatgcatatggaggccaaagttgaaactgcatgtctctctcactccctctcttgtcttatattttgagacagggtctctcattgaccctggagaccactgattcagataaactgcttggccagtgagctccagggacccttctatgtcctgctcctcagtgctggagttacaaacacacccaaccatgcttggtttttacatggattctgagggtatgtactcagatccttgtgtgctttacccactggtccacgactctgcccccggtccacgatcccgccccctgtacaatgtacctaaagctggggttggatgaacttctgtgtagttgcagtgacctcaggttgcagaattttctgtggtcatcaccctgtcctatacctgtaccagaaccttggaggtgtccccatctacacacagcaccttaagactctgtgtcctgtgtcacccacagaggtcctgcttatactgaattgaagtgttaagcaggatcttgacatgagtgtggactttattggtcgtgagtgtttgccatactaatgtgacactcacaggctgacaacacaagttcacgtccagtactcacatccaaatatgtgggcacagaccagtgaggggagggttgggacaggggttgacatacccgcggggacaccacccacacaacaggagttgcctttctaagttggagaaggtccttctcagctctccattccataacaagtaaccagcaagatggtgcctgcctggtgtttggcacatggtgcagacaagaggaacaggagcctggtgggtggtgcccaggccacgcagcggtcatggcttcaatgcctgacacgtcagtgcctaggtagattgagtacttagaggatggtggccatgacaaattcccatctagttctgtgatgcatttagacaccataccccatttcccatagggatgcattgtaagacctcctagcaaatactcgaacgctaggataatcgccacgacccacaagtactatgggttttgctcttatgcatccacatctatgatgaggctcactttttaattgggcataataagagatttaccaccatagctaataataaaatgtaacaattccaacaacatactgtgataaaaataccagtttcactgtggaatctgatcattaaaataagggtcaatccacaaagggaagtagctactaagtagccaatgagtgtctattgcacacagcagagatagcctgggcaaagatgttgattcaagcccctggtaggatagcaagagatttcctaactctcagaagggcaaggcatttaaaatgtatggagtcttttatttctggaaatttctatatgctgttagtcaaccacagttcactaactgatacctcagagagcaaaactactgatacagaaacactgtgcctgtcagtgtggctcatggggagactctcaagtacggcaaatgtgtagtagataaaggccggttctaatatagtgcccccagctttgtagtggctcaagatcccagccaggcaatgctcattcaaaccaggtaagtttctgtgggtggccagagaaatgtgtccattagcactctctgataacactcaaccatcctcaggcatagcactggacttcatgcagttgctcaaattcaactttcagaatttcatctttttttggagacccagctagggctctaggcctcagcagattctgcagaggattttccttgaattcggtcttgagtctttgatgagttgggggtgacttgggggtggcacttgtttgttttctttgggggtgccactggtagatggcttcttaaggatgtggtggcatttgaccacagagcattgtggggagggaagtgacacggccagagcccttcctctgactgctgggtactgaccacttcccctggctcttcctggaaaggagttctcccaacacagtctgtctctcaggaagtggttcctggccagccccagaggtctggtagggtctttctaaggtgggggtattttgcagagcagtagcatcacacccctttagtcccagtacttgggaagcagaggcaggctagtctctgagttcgaatccagcctggtctacagaatgagttccaggacagccaaggctaagcagagaaaccctgtctcaaacaaataaaacaaaacaacaaagaagattggggacttggcatgtatcctgggctgggtgtggattctggctagttctcttatcccagcaagtcacctcagacttgtccagaggatcaggtagaatactggataaaagtggtacgcccagcgttttgacatctgtgcagggcatttcgggagaactgcacagacgagctcctcaaatacactgcatgcgttcacagttctccctggcagcatgaaggccccaagctactgggacacacccgatagaattctagatcgttctagtaaatgtgctttggtttggtatctggccttgcccatgccacttgtgggcataagcactctgtttcccatctctgggcctcacccccctcagatcctgaattcacccccacaatcctgtcttgttgggttgtcagggtaaagctgcctccgtgacctcaggtacagagactgtggagcagtcaggcctctgctctgggccccagccttccctgtgtctgtgggcaagacaggttcttgatgctccatccttgttccctcggactatggaccatagaaggactcctagactcgtgggaggcaaacgaaagccaggcacacagcagcccagctctgcccgacctctgacgtctttgctttctgccaaggcctagaaccaccagctgtttatccagcagctcatgcacacgtgagatgattttctggcttaaaggagacgagtttctttgaaattatggctgtaccgcctgcccagggaagagggcagctgatctttctggtggtggaagcagaattcagtaaaaactcttcgcttgcattgcagcgtattgttccggcgtggagcagggcatacttttgtcataatgcagtttttgttgtcgatgaatatggcagtgttcttttctgtggaggaggaggaggaaggattcctgctgagttcacagaactttctcagtcggctttggagtgtaggtgcatgtcctgtgcaacacccatcaaggctggggatgcatttgctcacagccccgtgttttgtaaatgctctggaaacgtatgtttcattaggcactgtttaagcagagagacacagcttttcctccaaacgatgcggctgaagctcactgtgccttccttcagctccttctctccctctcttactgtgaggctcggttctgtgaattttagaatggactagttccatggcttgagtcaaacagttgttggaagatcactgcaccaaaatatttgagggtgctcttgctaaatgattacttgattggcagatcttcctcttaagtggtttcatcattgtcaaaatgtttctcagaaatgtcttacaaactgctttaggaaagttcaggttaccgtccccttttcttataacatgaatgtcttatctcagcccctgagtaatatccctgcacatcaataagaatgctgtaggccacgcaggtccctgtgcctctgaggcaggagcctgccaggtgcaagggaacgtaggtcctgtgcgtcactgtcatctcccaccctcgacctggcaccatctagtgttcaatgccacacaagaatgacatctgtaagtgtctcttttagacttaagaccatgagggtctgtgggtggtttctgttgttgttgttgttgttgttgttgttgttgttgttttttaacttctcaatccttaccagttggcctgtcactatcacacagcaggcatccagtatttgttaaatactggcctagccattttatccatttagtcttcagggtgctctgagctactagtatgcactcagaaacacttagacactaaaagagattctggcggttgcaggttcttctcagagacccaaaccaaccgaaacttctgtgtcagcgaatgactgactctcattcttgtcaactgtaaagtgtggctcacacacacacaccccatacagggtggctgctatgatgacaaagatggctttctctttattcactgtcttacagccagatgcagctagggagatactgttgaaaaacaaaaccacagagagagaaagagttaaagagataagaatgccaagagtggggggtccaggaagtctggaggacacagatgagatccagagaggggaagagaggagtctgacaggtcctggtgacatcgcacagcgtgaggacatccagacctgctgctgtactctgagagcagggttgtcttccctgtgagtggaggcctattgaggccctcactgtgacatcttccttccctgggagggtctagattctgataaggacctacacattatactcttcttatctgccccaattcatcacttagggaagacaatcagtttagtttagggtggccactggggcctggatgtactctattctgcccagtctgcagcttggttttagagaaacgcctaagcgtgagaccactctttaaggttgtaagggaagcagaagccatggacagttctcccaggccaagtgccatctcaccagtttcactaggagaagtctagctctttgagtcctttataaagcacctctccatgtgcatgtgtcccaggcaacaagctgaagagcccacttcagttgactgattcctagtgtgtctatgaatgttgaagtgtcttggggtcattttcatcccacacagcagtagaaagtagcagagagaagattgcattgtagatgatgtttttattggggtaaagatgttggggactgtagggcagaaaaccggagcctgcaagctgtcaatggagagacgagtgtgggaagggccttggctagcacaaccatgggagatgcctgagctctgcgctgcttcccactcttaaatggcatcaggggtaaagggagagatgggaactaacatccaggaagcaagacgtctatgggcagctgcaaggggcggggcttgggatgtaggggactgaggccctctttaatggagtgtggttggtgaagcaggcttggtcagaggtgtgtcactcaaacctaggagtaggggaaagggacaaattgacaaatgactccgttgtggaagggagtggtgggtatccagtgaagctgcgtgggtcagcccaaggacccatgggggttctgtatgagaagtgtttgcttgtctgcggctgcagagaaaatggggccattgtttgtaaagttggtgttatagttttttgttttcttgttgttgttggtttttttttaattctgaaacggtctttagtctttggatgctatctaagagtgcagggacaggtttgttttctctgctaattaaaaattaaaaggcaggaaagaagtgtccctgaggatcttgggagccatcatatactccctgggaaatgagggtcccctcttgggggttcttagtctcattaataacagaagttgagaatcctagaagctagaggacaaagaacagattcaaatggaagctcagggacaatttattggcctttaaaaggaaaagtccagggctagcaagctgtaaatcttgcagttgctggaaaagaggagaacaggggaggagaaaagacttacagcttgggggagagtgtcaggccagccacctgcagacaaaggtgccccagagaaggagctttaaaaaagaatcaaggaaatccgaagccttagggagttaggaagcatacttgggctctggccagcatccaaacgaaaaagaaacagttacacctttcagagtcagacctcagcaagaccaacagacctagccactcatagagactgccatagagaataggaattatgggaaggagaagtgcatggtcggggaaggtaggggaagccaccttttctggcctgccccacggcattaacccttaagggaggagacaggggcatgtctccacctagaggaggcttccattctttacacagtgggctggcagagttgggggggggggtgcaccttctgagaaaaaaacacacgtaagcttcactggtcctgtcttcctaagtcacacttgcatcatgatgcttggaatctccctgcaggacccagagctcagctctgcattatcagaagtaaaaattgtgggtttgagaggtgatggggttggtccatgaagctgtgccttagctgtgtgtgttgtggtcagaaggcaactccctaggtgagcaaccgcataggtgagcttggggcatgagcaagcactgacagacagggagagggtccttctctttctaatgacctcatacagccagttctgtccaggacgagcccaaagaggcagcaaagtctgtaaaccagctctggagccactgccctgctcagcggtgggaccctttgtagcaaatgactctgtgttcggacctcagtttctctgtctgcagagcagctcttgtaatggattcctcctgagagtcctgagaggctgaagtggcccttgttgggatgcctctctaagaagcttgacaaagctgttcaaggacaggagcccacaaggaagcagctcctgggggtgggggggagagataaaaatgggaaaaaaacaacaaccaacaaccacacaggtccaagtcgtgacagtgactgccgctgtatcactaccgggaaagtctgtgtgccctgcaccaagaaatgagcgaatcattggcattcacctgaagctgagagcatcggtgcctctgaagagaatagaactgaactgccttgctcctgaattccagggcaatcacaacactgtggacagatgtagcaatatggaaaacaccgggcctgtgcttacaaacaagggttcccctagcttactaatatgcagagggggcaccccacagtgctccgttagagaagtgccacatgtacttgggtggagagcaagcaggtgtcttgcctgggcataattgctagaaattttccagcatttgcaaagtgtgcttgctagtctgtttgggttgacaaatggatagtgagatggtgttaccttggtgacaccgttgcaaaggttcacctccttgtctgggcagctggaacctgtgaggtaggcaggggagccatctcaccacactcctttgtgcggggagacttcgctcctctacattcagcttctcttccctgctcttccgtgcatcggaagatggagaagtagcagctctgctggtatctacaaggtaaacaagaaaactgtgagacttggcagtgtgagatctgtgcaatctgcagcctcgatgattaggaaacatgacacgctctcggcactccacagcccctgccagcaaagtgtggctgtctgatggaatgcaggcaagccctaggcatggctggggcaccgccatccccctattgcctgcctgcggttctcttgataggaccttggtttctattctatttctagcagtgccctgctgtttagccagtctgtacattcatggcaatagtgattaggtttgagggttgctacgactgacagtgaatagcaattcttactccccgagtggtcttgaatcattgaccactgccttctgggaaaaccggaatctcaagagaaggcagccagaatgcagccagaatggaggaacttggccagtctgattattcacagtaagatttgttcaaggccaaggtccctggtatttccccacatagagttctctgtgccttttgctatatggaatctccaactgtcataaaaatgttcacatttcagatatgaaaaatgtgcgcaagagttttaaaataaaaacgcaagcgcttcctcaatttttaaaatcttatcacccattcaaaagaaaagtctgtagctagataagctgcaggcagccaaacgctgcccacaggattgcccgagctgcacgtgggccactggtgtacggaaagacactttgcttttgtctgagttcagaatgattggctagctctggccacctcaacagcaactgtaactttatcctcagccagagtggttccgtggacttcgaacactaccctcgattgtcttttctatgaagcttggctgcacagtaactccattgctgggtccttctatcttgggaaccatcagggctaagcctagctgctggtcacttcctttgggagcgcttttcctgggcctgaccttgcctgaccttaggctttcctcagggtggatttccccttttctgatgctgacaccaccctctttcccagggtaagccaggcttcctccctccctgttctgaatggatgtgacgctgcactcaggcaccagcaaccccagctcttcttctggagcagatcagttcagaccactctaaaaagacttatccctccccagatgagggatgtggcctgtctggctctttccagggatttctagactaaagaggacagtggaactgggaggaatttggaggaataaatctgcctgtaacagaatgtcattccgggctgtggcaagcagcaccctgaacactaggaacttagagagggaaggcagtggtgccctaaagaaattacagctttgctttgctaggggacagagctcccacccaaaactatgagcacgcaaggccaggggagtcagccaagagtagcaggctggaggagcctcctattcccccacatcctcacaccacaggcagcagggtccccatctttagggaacacccccctccttgcctcataagctagctgtgaggtgtgaaggggaggaaacaacagaagctgtcccccagctccgtcctccctcctccctccttcccctttttggaggatgctggctttcaagataagagcaggaagcttctagattgtggaaggatgttgaacaaactgcccacatcaacggccacctcaaccctcaggttttaaatgtttcatgtgccgttttagaagttttgctcagcgaaatgaggactgtctacaaggcctcgggctaaaggaagtgtatagttggcaaacgtttattttagagcctgggttttttttggggggagggcatggttttgttgtagtcctgctttagagaaatagatagctattcaatcatgcatgaaacacagaccgagagtgctcagcccattgagctatctgaagttctggggagtcaaactctgttttaaaaacaaacaaacaaacaaacaaacaaaaccatgttacttcaaagttcacttttgagttatcatttgtgtttgattgtttatctagctattgaccaaacagcctatgcttctacaccaaactagctttttcctttgtggttttaatctgatttgacccagccttgtgcctccagctgtagtcctgtcccagaagcctctgtgtattactggacttcatttcatattggaacaagtcagcatagcattggaagatagttttgagctttcttatcaatttccctgggaatgtggagacagtgtccacctcagctttcctcattgcttgcctcctcgcaacactcctgcaagcatcgtctctgggtattttagggtgaaacaaaggggtgaagttttgtaataaactgttctacaaagaacagtttacctatccacattaaccattttctgcccagcactccgcctctgccttgcacttgggcattatgttatgtggggccttgtggcatgctgggaaccctttgcaactctatgtgactcaatatgctgcctcttcattatttttgattccttcgctagggaatgacacagtgtcagatgttacaaatagatcatgaatgctgttggtttgttgttaataaatgaactgtgatgctgggactgttggtttccctaagtatagaattactattgttcccgcatcagctttttgttagcctgtgtaacactgttgatattcttgggctctttgtcctatgagctaagtgcatgtcttagcgataggggctttttattccataggattctctacatagaccattataccacctcagacgtatgctttatacatctcttctttagttcatatgtcttgtattttttttctcgctttattccattggctaagattcccagagctaatgaccaaagcagatatcctttatgccattagaagtttgagtataaaatttcccaagcggatttaacagttcttagttgcctgaattagttttctgcttctgtgactttaagacgatcacatgagttcacttctaaatttgtaactatataataatttataataacttgttataatttgtactgcagagacattgttaaatttgttttaaagtaaccagccttgccaggactctcatcacaagcaatctggtaaaaggcagcgtggagtgagccagctattttaaaatagagacaactgaaaactgatcctaccctttagctgtgtaagtgagtaatcacaacccagccagatctccatccgcaggcagatgaaagtctgataagcctnnnnnnnnnnnnnnnnnnnnccagagtggtggacaatgaactcatgagtgtatattttctttttggatgatgaaaatgatcttatattagatgtgtgagtcttttttttttattaattttatttcagtgtgtatagagtgctttgcctgcatggtatgcctgtgtgccacatgtgtgcagaacgtgaggaaaacggaagatgatatatcccttggagctagagttacagagggttggaaatcatgctggtgctgggaatcaaaccctagcactctgcaagagcagcaagctcctagccgagccatctctctcgcctctaacatgagattttaatgaggttactaaattcttgaatatactaaaaaccaataaattgtacattcggagtgggcaaatcttacatatataaattatatcttaataattctttttaatgggaagaacacacagcttaagctaggtgacgatcagaggcgaccccaggggtgtagagtggaaaggtgcctctaccttgaaagaccatctccagggaaggtatggggactgcttcgggtgggacctttacacccctcactagggacagcaaccgattgaagtcaggcccttaagggctgggtgtcaaacacttcagaccctggggagccacattccaccctcaattggcttccagggagcacaagaaagtttggtgcaggtcatagatgttgaaagccaatgcatgtagcaaaaagaaactaccatcaagactaagcaagctcctgaagaccctgtgaagagtgtcagccaccagcactgttggaaattggagacccaagtgagagagaccaacagtgtcaccagaaaactaatgttcttttgttttctttctttctctttcagactatagccctcatttccccttggtgagtacataattttctaaaaattgtttctaatgtctgattggttagcttaagatgcctgggatttaattgttctgtaaggtttatcctgttgagaaacaggccatatggtcagagggtgacatgcaaatttagtgccttaacttactcaatgtctcacatcacacttctcgttattattattttttccctggcatttgaaatgtagctcagccactcgatgtcctgagatgcattgctgtgggcagttcccacgtgctttcctttctctgtcctgtttcttttacaaccttatctcagtggcacacattcaacacccattagggtgcatagcacagcggcacatggcggcctgatgggcgtttcttctcataagtggagctactgccctgggggaaacgggtgaggaggtgtttttctgaatgacatttctgaaagatgcatcaatgtcatggaattttgtgttgtacaccgacaggggctaggtaacagccaaattctacttctctgatgcctgtaagaaaatacattaaagactttaaacatcatgacccacatcttgttttgtcttgtttcaggcaagctctcactacgttgccagagctggcctcaaactcaaggtccttttgctttgacatccttagagatgagattccaggcctatactgccaccatccccttcatagcctttttcaaaaacatttaaatcaacttaatgatgttccccttttcagaagaaagggagagaggggtgtctaagagttttgttgttttgctttcttgcttacttgcttgttgaggccgtaggtctgactggcctaaaactcactgtgtagactaggctggcctcaacttcatgtgatcttactgcttctgcctcctaagtattgaggttcagggcacactccactaaaccccacagaatctgagtttagaaatggctgcagtgtggtcacaagaggaacacaaaatgctcagctgataatactgcccttaatgggcgtcaccagagtgcaaagtaggaagttccatttccgaatgcacggccacctttgaaatatttttactgttggggcagctaccacatgcctgtaatcccaggacttggaagacagagccaagaagtctcgagttaaaggctagcccggtttacatgagaccctatgtcaaataacaaaataaaagcaagaacaataaacttctactgtgttccagactttaaggctgttagattggctggcctcctctctgaggcaaggggtccttccttggtgtttctccattggaacgtaaatgtgtacagttgtgcttggtttgatcagattgctctttctctgttttggcaatgtgggatgatgataatccagaatttctcaagctaagaaagaatgaagccttcctttagcctttctgagttttatggtcctgctatctgttgcattgttgttagatgtaattgattatgagtggcatccaactctgcttgggtaaatgggggcagtggggacaaaggggaggctcactgggattgtttgtatgagataaagctttaattgccagtcagcaactcctattgtcctggaacaaaagccagaggtgttgatgggtgcatgttggcggggaatgcacatgaaacgtgacactgtggatttgagcggtttgcttttgtttcttaaagtgccttccatgctggagggaagtagtcataggttaggccccatggatttgtcttttgaaacacaggaacagattctggttggttctaaacatgtgacctttgtacttcttggcacttggtgctgggctggcttgtccagagccagccttccttcctcccattctagcatttccgagcctcttggtccactgccctgatgcccagcaatgatccagcagctgtccaaacgagtgatcctgtgacaacagctgctaacctggcctcagcttctcctctcccagagccctgtttaaaacccagcaacaggtctggaaggccagacctcctgcccagcaatgctaaactgacttctgtgtgtctttgtttcctgtgtggatctgtgatatccaggcagcagctccgatcctcttggccctgacttttgcctcagcatccattctgctttagtcagtcactcagttcctggctttaaatatatggggctgggagatggctctgtggtaaagtgtctgctgagcatgcttgagatcctgagttccaacccccagcacctacacaaaaagccaagcacagaagtgagtgcctgcaactgcggtactgatgctggctggcgtgggatgggcagggcaggagatcctgagggctaattggccagccagtgtgggagaaccccagtcaagttccaagtacagtgagagaccttgattcaaaaggtatgtggttgaggaagactttgggaatcattcactttgacatgaggcgtatttgaggagtggacagggtaacctagtctgccttcactgggactgtgctttctggccctcagcaagattctctggcctgtttggtttccgttagcaaacatttgaaatataggcacagagatttaggatttcagtgactggtcaacagaatgatttctaacttctgccctctgaaactggcttttggacgatttgggactttggacagtctgcttgggtagtgcaggtaagctccctgaaactggagaccatcacaagccctcgtccatgctttgtgtgatggctgtaaagaaaccaggccagcaaccctagcaaaatagacacaccagccccagcaaacctctttttttctgcccagctgtcaaaaggctttcagtttactggcatcattcttgaatttccactaaaaaataactatcttaatattggctttcttaaaaagattcaaaattattctcttttgtttgggaagtcctttaagcaagagtcaacccttttaattttgcatttaacaataaatttaataaagttcttgctatgcaacatgaagagttgagtttaattcccaacaaatgtataaacagctgggcatggaggtacacacttgtaatcccaacactggggaggcagaggcaagcccagtccctgggactcacgggtcagctgccctgggcaaattagtgagtttctggttcaatgagaaagtgggtctcaaagatatggcagagaacaatagagaaaaacatctgctgtggacctttggcctcttcacaggcacacaaacacacacacatacacacacatacacacagacacatacacacagacacacacatacacacacacatacacacagacacatacacacacacacacacacacacacacacacacacacacacaccacaagctaacacacaaaagacaaaacagtggacttggagaagtagtcctgtcatgcttatctgtggccaaaggtgtttcatctggagaatgtcacagttgagtgggttcctgtggtccagaatctaatgcaaagaaatgggagaatagaatttatggaagacagataactaaggtttaaatacattctccagcctcgaggagcatctccactttaaaacctaaaagtggccacagccaagaagaagcaaataacgctgtaaagtgatggtctcaccctggctcatggaaacaccaaagggattaaaaactgaacgaaagtgctaatagcaaacagcagccgggcgggcgttcaccagttcaccagcacagacctatggctccgcccttcacacttgcaaagcttgtttcgttttctcctctgagtcaatgctttttcagtggtgttggtatgaatgaccactcgagcaagacaaataatctgattttttcaaataatagttcctgcccctgctcttcgaggtgttggcatccttaagtggaaagtcactggggtgactttagtaggcggagcaggagctgcaagccctgaattagcctttggaatggcaggaaggggccagagtaagtcagcatagcacaggaagaggtgcacctctggagggtgtgtggcccaggccctctgtgaggccgttgcctgtgcctgggctttccctgagagcctgtggtctgcaatgcactctgggagctaagggtgactcatggccttccagtctcaaaccccagggagctgccaccttttttctagaagtgcttcccagaggagtctggtaggaagtctattgtcacacacagaggcaggcaatccccatcagtcactctttccacctgaagggaaaaaggaacttgggttttccatataaactcctgtctcgtcaccgcacccgaggcagaccttgacattcatctcaaaatccgtttcggctgacagagaagcatggattccccagggccaggatggctgccatgcgtcgtcccgattggacaagaggtaaagaggggacccgaggggagcctttcttgccatttttagatttctgtcatgcttgcttataatatttatcatttctaaagtacccaaaatttaggttaaagaatattatcaaggctttcactaaatgcaaattggcaagcacctctgctaactttgtccagccctgtgcaggaaacctgggtttgtcccagagccagtttggtcccacaacagcccagcccaggcagacagccacgcactgggcccagcaaggagctgctgtctgggcctagagagatctggagggccatcagaccaccaggaatcaaaggtgaagttatttttttctagtgacatggacaatttccacctattatttagtaggcattttatcatcaagagtgccctcttaatatcattctttgggatttggaaagtaattggaaatggcccactaagagaggaggaggagctacctacctgaagcaggtcattgggccaggtcttcacgacctgtgtctttggttcgagagccagcccccacctcccttgccctgtgaggttttcctgtctgtggagctcaaatggtaagacagatggtgtgagcaacaacagggcatcagcagctgactggagggtgccatcattcacaacgtagacacgaagtgtatgagtcccattgtgggtctgagttacagggagatttctcagacccactgacctctgaattaggagcaaggtcaggtgctaaatgcaaagacagatacatagcagggaactgactctcaatggcatctctaccaacaagagtatgtcccatggcagttgagacatcgagctacagattagacagcatctttgccaaacctgccaatctgaaccaacttctagaagccagtctggtgtgaagttcaatagaaggtacttagaatgctaggggaaggatccccgtggaattgctgaacaaagaggctccacgtcatgggttctctacacagcttaacagaaataggccaatgcaggaggaaagactgggtttgggctgttttgtggtgagagcgagtcggttctcagcaaccttttaagaatatgttggcgattccacatgttgatccacaatgagaaatggtgcggatcaatgaggcagggaagcttatgcctgtaaattctctccagaatttgggagactgagacaggaggattgctgtgaggtcaaggccggtctaggctacaccgtgagatgctgagatgtgtgtttgttaaagctgccatatcactgtgtgactgctgaagaccaacattctgatgttgatagcaatgattatttggagagcagggcttggtctgtttcctgttttgctcaatgatttaagttccttatgcctaaagcgcaaatttcatttattgtagggtgcatccaatataggacacttgacagtgtataaagcaggttcaaatttattgttatgtgtgcctcatacatgcttggaacagtctggggataccttgacacctctgccttgaagattaaaaatcaaaaccaggggctggagaaatatacaatgagaaagagcccttgctactcaagtgtgaagacctgagcttaaattcccatctacagtgtaaaaggtcagatagagtcacacatctgtaaccccaataacctcagggctatgcgggcagagacaggaggattcctacggtgtgctgaccgtaggctagttccacgttcaaagagggactgtctcagggaataaggcagagagatagaaccggacaactaaaggtcttctttggattctgctcctactttagacacatcacagagagagggagagagagagagacagagacagacagacagacagacagacagacagacccaagcaggctgaagaagtaagtcatcaccacaggcagtaaaatctgtaggggctagcaacatggtaacattatagtttgcatgccaatgtgtgtgtgtgtgtgtgtgtgtgtgtgtgtgtgtgtgtgtgtgtgtgtgtgtgaagcagagactataggcagttatgagacatctgacacagatgcttggaactatccaggtcttctgtaagaatggcatatgctctgaacaactgagccctttctccagtccctatagatattaccttgaatatgaactatgtgccattccctatagcagactaatagactgatcttggctgagttgtttgaaatccactaaagaaaaccaacaaatccttccaagtgtccctctaactggctgagtccttttcttccttaaatgccagccagctcttctgcccatcacccaaggtgaggtcatacatgccgaaagaagggactccatcatgaaaaatattttagagccctgcaatcccacagagcacaccgacaaatcaaagcattctatgggccgtgcacatggctggcgggtggatcattgtattttggaacaacctcatgaccatcaagttgatcttggctagccttcccagagatttcctcatgttatctgctaaccaaactcagccttccaatctcttttcacaccctcgatgggtttcctcccagcacagcctgtccactcccttgcccaatgtttatcagtatctcctgcagactcatagttgtatggtttttttttttttaaagttctctggggaaagtgggagacaacttagtcagtaagatgcctgccatgcaagcataagacctgagcttgtatccttggcactcacataaaaagctgggcttagtggcacacacttataatccaagtaccagggatgtggagacagaagactcctgagcctcgctggccagctggtctagataaaatggtgagccccaggttcagtgagagactcggcctcaaaaacagaaaaaacaagtaagggagactatcagcttctggtttccacccatgccttcatgtatgcgtgcgtgcgcacacacgcacgcgcacacgtacacatacacgcacagagagagagagagagagagagagagaaacaagcgttagaccctaggtctgctttagtttgcaaggctagcgtctgagcccttgttttagcaagaatgaacgtgaattttgtgcaggagtttagaggagacctggatagggacagatggcaagccagtggagaccagtaacctagtgatctgctggttttgtttgagaaaggccaaatgacttgggtgtgttccttcacctgagtcattcacatcttcctggtctgagacatgaaggactggataaggatttttacaaaggtctcatggagacaaaactttgtgatagctggatttgagctaaccacagcggtccccagcagataatgactgctgtatatcaacaaggctctggcccgtgaggttagtccttactgggatgggtttgcaaattattatctctgtgatgataatctctgttttgacagcagctgtcctgaggctctcatctctgtccacttctatttgctcttaatctgctaaaaaagaaaaaaaagccaccgtaggaaggttttgttaatggaaaacttttatttgaaaagcagtcagttttcttcccattctgctgctgacgggcgacaagaataaacaaacactggggttctgtgaactttgactttacagagtggctctaacacttatccagtgtgccggaggctcctttaatccccagagatgcagaccgagagggtggctctcccctgccctcagagccagtctacgggaccctttccaggagccacaaggtgcttcatttccctggtgggtgtgggtgtggttcactgcaaagaccagttaatatgcttagaaaccatggccaccccaatattgcccggccccacacttggggagtttggcagaggtcagattgaaaattgtatgtctttgagatgctagaggttcgccgtgcccaccgtcagtcccaggaatttctagttcacaaacctattttggcttccttccaatatgaagccagctctgacattcccttatgctgtttcctgttgtgggcggattgatttaatttttaatgagtgattcactgtccgtggctgtgtgttttcctcctgttgagctgagtattaagtcatgtttcctttaaaacattatttttgatatcaaccgagcaatgtggtgctcagctgtggagacaaagggacccagctatgtcccagaagggatggcatttaacctgccctgggaaatgacagttgtgtgctgtgctgttctcccaagaggagactgcctattaaacagccagagtgtttcttttatcatagtacagagctctgtaattttaagaagagttttcaggttttttagtgttaatcttgagccccttggaaagtctcgtgctaggcatccctgttggaaagcctgcctggaacatgagctgccccattgttgtgtcttccctcatgtctgttactcactccacgcagcttctgtctgctcagccaggtcatgaccaaaaaaaccagtatgagaaatacactgatcccccagagcagctcctcctctttggtcccctctcttgccaaactcaccaagtgcctctcctataggaggtatcaaaatgaggaccaccctggccttatgaggagactctcctcgatggcctgagcattaagccgggggcctgctggataagtggtcccggctttcccctataaccaactcagtgagaccccagtatcatattttacagtgaaacctgtgcacttgggaatccaggagggtgaaaaatgcagccaacaaacggctcacagaggcagcagcaaggtgagcagggtgagtggcctgctaggtgtgggaggtcatgattcaaaagtggcagttttaagaatgagggctaatgagatgactcagcaggtaaaggcacttgcctcaaacctgatgacaggagttcggtcctgtgtgattaaaggagggaaccaactccttcaacttgttcgtcctctgacctacacacacacacacacacacatacacacacacatacacacacacacacacacacacacacacacacacacacaccacaggcacatactatgcacatacacactacacactcactacaaacacacatatgcacacttgcactacatacacacataagcacacacacatacacacacacacacacatagacatgcacacacactaactgttaataagaatcccagagtaaatgtttttaataagacagttgaagagatacgacaaccatacttcaggggaagcggggctccagaaagcagtcttgctacaagtgaagactcctaaaactacagcagctgagagtgtcctgctttgaaaatgagctgctttttgtttatttggtaaggtagactgaaactagggcctaacataccctaggcaagagttctgtccttgagccccaccccctccactcccctccctccaatataccaatctcttcttaacctgacatcttgagccggggctcaggaggtgctggtgcagaccagaggagacaggtggccgtgcctggctctccagggcccactggagcccaggagaaacaaggatacactgagaggggttgggggagagagctggagcaacagccttcctcctattcctattcccattccctcttgggttttggatgctgatctacctgtatcgaagtctcaagaacctcattggaaatccagatgcctcgtcaggaaaccaaaccccaagttggaaacccaaggtcctcctcaaaagcctaggaaccaactgcgtctagatctgtaccacaagcccaagagacgattagaaaaccagccagcacgggcaggcagtcctcttccacagcccaaacccctggtcagagagccatggctccgttccaggcgttcgtaacagtcatgtggacagcagcctccatctttcacccaagagtgctgacctcctgaaacctcttagggtttagaaatgagacttgtcttattttagttgggttctagagcactttctggatgtgtctgccatgcatacagctgtgtccttgcgatttattttaatattttagttggaaagccagtaaccatgagaattaaaggaataaacaacctgctgctagttttggtgaaaaacagagtcttacaggagggggggtcttaagacactgggggtgattgtctgacgtcctcagaccaacagtcagaggtctccctccttgaagtccgttgctgaaagagaacaagataccacagcgagggagaaggaaaacccaggacggacactggcccactgacacagaaccagcagtctggctgaaggcaggacttagtttcctatttcccgtttcctactcgatctacattttctatatgtgactcataacttaaatcatgcttggtcggatcacagcgccgggcaggggaacatctattttatcccatccgactgtgcctcgaggccgcgagggacatcactggtgaatgaacctattgtcttggagtccccaggacttgcccagcacctagcagatctgagaaagcttggaaactaatctgtgactctgtgaacaaatgagcagacgggcacggggagagtgggttctttactcagctcagggcagcactcacggtgaacgagccagacgcatcaaattcggggtcacttgatcaaagggcacggaagaaaagctcctttcttctctcgtgcatccgctttggactggtcctagtcagtggtgcttacttctctctaatatcatgctccctcaggcggcagggtactctcgggccttggacttggccggaggagggtggccacacagccttcactttcctgtgcctgagccctgtcttctgcagggcagttagggggaagggcagacagtagcagatgaaccacggggagtgtggcagaatgtggacatggtgtgaatcacgacaccaagatcatgggatgtctgccacagcccattttacctgcaaaacacaaactcaaatggtaacagatttagaatgggtatcagagccacggttcagagccttaggcctcgagacagggctcccatgatcacactcctctggagctagccctaggggtgagtcgtgctcagcttgctgtgtgctcacccgtgggagtggtagaaacaagagcatgtgtccttcgcagttagagttgagtgatttctcatctgtttctctgtctgtcacacccaatacctaaggcttgcatatgccctgcctctcctctctgttctactgcgtggtgctatcatggaaacacactccactgtttaggcctgctgtaacttgcctatcctttcttaatgagaatcgtgggccttctggacagagctctctctctctctctctctctctctccctctccctctctctctcgctccctctccctctctctctctctctccctctctctctctctctctctctctctctctctctcacacacacacacacacacacacacacacacacacacacactggtggcaaaagtgtacccagagaacctgggtagaaagaaagactgacatcaactaacaccccacaggtctcaggaactcttcaggggtcctctttgccagccccactggctcctgtgacctctttgcaggatatggccaagtttattgtgctgttttgtgactgtgcaggcaggaatcaggtggacatgttggtacttccaggtatctctctgcttggtcacagggaagagccctgctctggttctgtggcggcttccaggccagccagctgtacacttttcagtccaacttggagttttgatgcctcttgtgttcccaacacccacttccacagtttcaaagagctgatagatgtgcccgctgatccgagccacttattaccattgagctcctctgtcttgatgtgtttagtcacctgtgtccaaaaacaaggctgtggaatcatgtgggggtttcatctaacaaagaggacgaacctgttctcagcatcagtgctgcgatgcctctttccacgcagacagcgtggcaagagaggcctccagggcaatatggctctaccattcaacatccagcaggctctcacatctctctcagggatgagaacccacaatgcatctcctgctttctggactcaagaatgagatgaaaggttatgactggcaaatggcacaaaccaaccaccacttcaaggtaggggaggccactcaagatctcctgagctctgatgtctagttcccccaccaccccatccatttccttgaagatcaaaatgtgtgtggcttcctgctaaacttgtccctaagccagagcaagctagaaggatgctttggctattgtcacaggggcagccaattcggaaatggctaacacagagcagaagagagagctacaccactgggaaacattgtgggggtaactgggggttaccccactttcctattagagggaggaacagggaagcagggaggctcagtttgcaaacacagtacccttgttaggtggctcagaaccgcctggaactctagatccccccttctggattccaaagctaactgcactcatgtaaaacacacacacacacacacacacacacacacacacgattgaaagtgagtttcaataaggctctcaaagtctgcatactctcagagtcatagatccatgatcatagagttgcccgtgatgatctaaagacttgacctgagttgttggactggatggggcccacagccttgtatgatttaattagcagcatctgcaggaggttgttttaaacaccttcatggaaaactagtttccaatgatgctgctctattcaattatttattttttgaagggatcacaggatagcttcactgagagcaccacctacacttactgagggcggaaggaaaacagcccacttatgaacctcatcatccctccttgcctcgttttgcattctgtccacgtttatcctattctcgcatgcacacactaaaaagttatctcagctcaccttgaaccaaatggatttgacctctatttataagatgtgccttagcgtgaaagacggagctttctttcagagttcattcagcaagccgtctgcctctggctgggtcctgtgttagatgtcagccttggggtgagcctcatttctcttggaaaattcatgtcgtggacatcttgttgccaggaatcggcgtgattgacttttcatttcagagtgatgtcaaggctcatgttattcccagtgtggacacggagtggtgaatgatgtctaattatttggaaaggagtaggtttcttgaaggatgtgctgtgttgggagcttctgttgcctggcaacatgtaactttgccggtgtgtcaccaaagacattttaaagggctagagacacacactgagacaactgcatgttaaggggagaacctggaagctgccctgttagaatcatggcttccaccgcagaaagtaaacactgaagagcaggtgtgggtggaggctgggtgcagagcgcatgcccaggcacaggtgtgaaagatgcaggctagccccgttcttccttgcatctttctatctgttgggttaaagtctattcaaaatccgtgtgtgtgtgtgtgtgtgtgtgtgtgtgtgtgtgtgtgtgtacactttatgcagatgcctgtgcatagacatgtgtgaaagccagttgtagacattgagggtcttcctctattgttctctttccttccttccttccttccttccttccttccttcctccctccctccnnnnnnnnnnnnnnnnnnnnccctccctttctttctttctttctttctttctttctttctttctttctttctttctttctttcactgaacctacagctcaccatttcagcctgaagatccaagtgtccccaccctcccagcactggagatacaggccagcactacatctggtctttcgacatgggtgttgggattcgaactcaggctctcctacttccacaacaagtacttcactcactaagccatctttccagatccctcatttccagcaatgctctatcagtctagggtctacttctgggtatatatgcctgtaggttccttttgccctctttgtacctctgcatcaggggatggttcaatccactcctggctgcccatcccaccacctaactgttcacttctgctctcagtctcattctctgacagaagctgtgctcacgaaaacacttctaatggggagggagcaggtcagctcggtactcaggcacagggctaacatgtccaggctgctgtgaattactgtaaatgtcgcaaccctcatttctttttgaggtgggtgttgtaagaagtatgtccatttgtgatggcagcctgcatctgaggtccccacagcattctttactatgtggagaatattgtctttgtgtccctaaaacaacaaaacttctcagcctgcagtcatgccatggggaggagacttgggaaggggatgtgaggggcacagagcaaaaatgagagagagagagagagagagagagagagagagagagagagagcccacactaaaatgattcaaacttggattagcttaatttcggtcaaacatagaaataaggatttaatgttttcccttgttggggtccagcttcataattagctttttttttttttttgcaaatagcagccactaatatctaggctatttctccctttgtaataacaacacacacacacacacacacacacacacacacacacccttgaagtggaagctgacaactgccttgagcatcctgattggcaggaacagtaaagggaagcttgcagtggcctctctcaaggcagctttcctgccctctgctgggctaagccatcagcactctactcagaagctgaatccttgggttagaccctcagaggatcaccatcctggagtccttgggttagaccctcagaggatcaccatcctggagtccttgggttagaccctcagaggatcaccatcctggagtccttgggttagaccctcagaggatcaccatcctggagtccttgggttagaccctcagaggatcaccatcctggagtccttgggttagaccctcagaggatcaccatcctggagtccttgggttagaccctcagaggatcaccatcctggagctcttgtccagttcagactttgagtggttcatctctcaggaagccagagcactaaaggtggagaaattcaataaccttcatatttcttaaggtagagttctcagacttggactaagtactctgtgtgtgtgtgtgtgtgtgtgtgtgtgtgtgtgtgtgtgtgcgcgcgcgcgctgggaaaccaagcttattcattgaagagtatgtggtggttagttttaataataacttaaccacagcttaaaatcacttaagaagagagcctccattgaggaattgcctagattaaattggcctgtgggcgtgtttacggggattgtcttgattcttaattgttgtaggaaaacccagcccattatgggtggcactattccctaggctatgtcctgaattgtgtaagaagagagaaagctatctgagcaaaagcaacaagcaggcagcataggtgtttgttcttctctgctattgactgtggatgttatgtggctagctgctttagtttctgccttaccttgcccttagtgatgggactgtaacctgggagtataagcctaataagccttttccttttctaagatgctttcggtcagggtgttttatcacagcaacaggaataaaactagatccaagtgaatatggcggactttccaacaagaaaacatgtagctctcctttctttcttcattattccccctgtttaaaaactattttgcacattatcgatagtggtaaggatattttccctagccgtttaacgccgggactgagttgatacattttcagacgttatatccttttccaagtcccactgtatccatcacattgataccagcatgcacacacggtcctctgagcagcccctcaacactgtgggatagagctaggagtccatttaatgatgttgtacatgacgagttgtttgttttcggaaaagcctgtaccatgtgaggcgaatggtttgatttaagtgtgagatgtgactgcgattgcaaactgaacacacagcagcaatactgcagccgtcaccatggcaaccagtggaaataatggcccccttcgggaataaaatagatctcagatcccttcccaatcagcagcgttggtggtttgcagtcgaggtggtttgcagtgattgcttcagactttttttatggacagaaaacgaatgggcaagaaaattttgagaaaataaatggatttacagacaactcatgtgataatataagccatgaaggaaagcaagacagcagttttggcagctgagagcaagtgcccagggcattccatccacaggattgtcccctggctattagaaacctggtccctgatcttgccacatagaatgactctggacaacccctgttgtcctatgtggccaccagactctggacgttttcttattggaggcagaaatgctactgagccaacggaaagagaacacgcaaacatgtaatgtcacctcagcacatggaaaacactcaatgcacagtacttcagattctcggggtaaaattaaaatgagcgcctagattgcgcacaagaacagtaatagtttttcaaaatataaagcatagggtgcttcagcaagcagctctcctggaagaatgaagtgcagctgtgggggtaccccctgttcctcctgcaggacctgatgctttgttagaactctctatacacattggggtgcgcctgcactactgccctgagacgcagaagaacagtttctttataaagttgtgctgcccagggatatgatgaattctcactttgctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacccccaaaggagcccatgacagagacttctccattgtgccttctcagtccctgtgggctgtgaattcaccttgacctgggcatggggccctcttgaggtccatgtctctctatgtttggtgagcagaaggcttctaaccaaggatactgctcactaggatggccttgtattttatcttatgccatcttttattaatttttttaaaaatcagtgtgatgctgtaatggttattcctggttgtcaatttaactacgtctggaataaactataatacagaaattgagggcacacctgtgatccagaccttgaggctggaagacgcaggtttctgacctgtatcttgacatgaggtgacacatacttttgatccatatctcgaggtatggtggccatgaaaagttagacccaggcaaggtactacatacctttaaacccaacagactgaggcaagcagatctctgagttcaaagtcagcctgggacagagcaagttccaaatcctagtgtggtggtccatacctttaatctgagccatacctgctgctggaggcttacataaggacaatcgaagaaggaaggctctctctctcttcttcacctgcttgtgcttacttgccagcatatctgttagaacctagtttttcaggattccagcttatacagaagaccagctaaaacaaccaacctatggtagtaggtcggagcagctactcgattcttggagttcccatttacagctgcccattgttgggttagttaaactgcagactgtccatcattaccataatttcccttagtatgtagagatatttatagcctgcttggagaccctcatgttataggccagcagcctctggtgctagagacatgggtttgaaggaattgattacctgctgtaatgccatagacgtgcaatacagatgagaaaggggatttccaggatgccgcttccatcactgctttacactgtgagacatacgaagtttccaaccatctttaatttactatctaacgttggcactcagtaactcagaaacgtcacagcagttctgtctccagtgtgtgcaggagttcaagctatcgctgaaaagaaacgcagcatccatgaagccgtcaggttctcggcacagcgcagatgaaacaagcctatgggtgccttcttgttttcgtagactcctaacacataagcaatttctcttgagctcaaaatataggagccagatgtcagtcgggccgtggggtgggggggcatgctgttaatcccaacccttggagagcagaggcaggcggatctgtggtctacagagtgagttccaggacagccagagctacacagagaaacctggtctcaaacaaacaaaacaaaacaacccacatatccagtaagctacgaggagaggcttaacatttggacatatgtgtttggacaaagataaaaatgttgcaggttgtttagaaactatccaacaggaagtggactgagccatgatttgacgttcccacactgggaagggaagttttttgttgttgtttatttgggttttgttgtttttgttttgttttgttttgttgttttccggagctgaattgcttctttcctctcctttttttttttttttgttttgttttgttttgttttttgtgttttgctttttaagcatactgctaatggcttaagcctatgtccttttgactgttttgcatatgttcagactgtctttaaattgctaatgctgctgctgtgtggttaagcaacacagactctggcttacctgtgaagagcttctggtatttatgagatcagccttcccactgagaataaataccaggcttcaccgttatgaggtaattcctttaagtccgtttatctgtaagcctcagtctttttaccgtacatagacaagaaagcattacaacctgactctccacccaacccaacggcttagctgctcccaggtgcactctaagaattctgttagaatccatggaggtcattgtccagaaatacagagcagcagtattcagagacatccatagtcagtgtccatatgtgacagtgtccaggcataggaagctgctgttcatgatctacaacttccctgggagccgtggatgatgggagggtccctgcacacgtgagcctccacatagcacatctctagccagatctgtagttcactgtagtttgtgccttgctgtgttgtctgtttggaaaggctggggaggacaacaggacaaagacaggacttctgttaccttcctgtcagcttgggatctgtgataaccgctctgcattaaagagaagcctccgggtgggtcctcatgtgtgtgagtgtagggctaggtgtgtgggtatgtgtgcatgcgcactctgtaggcagaacggacacaagaaaaggtgagagggtgttatgtggcgcttgaaaaggcttaagaaatgttggctttaagagcctgcttccaaacactggctcggtcactcagtgtgctaaagaaaagctcacagaaagagagactggagcactgctagactgccaggaatctctttgcgagatagtctagtgtgggggtggatctgggaggtttctccatttttttttttttttgatagccactcaaatctgtccactcccgaatctcttctctagaggctttccaacattgctgcatgaccctgggctgcatcccacccctgcactccaggcaggcttctcagactgggggctgctccacctgctctgtcaggcctggccctggaggaaatgccctcactatagaccatgcactctccatcctgatgctctgaacctcctgggggtgctgaggtgttccgggcagccataaccacaggggagttctcagattaggggaagcacgttaatggtcactcatgaagacgctccacgattgtctgtagtgagcttttgtaaacattgccagggctctgaaggtcctggctcctcttttctgtcctccataaaaaggctcatgctgtgctttatgtagaaggggcagtggcagtgttttctctgcaggctggagggcagccctgccccagcccctgtacccagcagggcctggcagtgctgaaggaggaactccagctcttagcagccaaatcctcaacagaatgcctctaaatccacagtggatgcaccctgggttggaagggccaagccatgactgtgtaatttgtagctaagcctggactgttcccaagtgctcagtttatcaacctcagggccatgggagatctaagaacagcaatcccatttgggggttgaagggtgagggtgggggtgggggaaggaaacttccagcgagtttgggctataaaggtggacactcaagtcttccttaagtaaggctgtgttctgcagggggaaagttggtagtgagcattacgttctagtcccaggagcctttgtgagtaggaacaggtgggatcacggcacatgcagggagagcaggcacccacacctgctcaccacctgccccactttgggcactcttttagttagggtcttactgctgtgaacagacaccatgaccaaggcaactctttttttttcccattttttattaggtatttagctcatttacatttccaatgctataccaaaagtcccccatacccacccacccccactcccctacccacccactccccctttttggccctggcgttcccctgtactggggcatataaagtttgcgtgtccaatgggcctctctttccagtgatggccgattaggccatcttttgatacatatgcagctagagtcaagagctccggggtactggttagttcataatgttgttccacctatagggttgcagatccctttagctccttgggtactttctctagctcctccattgggagccctgtgatccatccattagctgactgtgaacatccacttctgtgtttgctaggccccggcatagtctcacaagagagctatatctgggtcctttcagcgaaatcttgctagtgtatgcaatggtgtcagcatttggatgctgattatggggtggatccctggatatggcagtctctacatggtccatcctttcatctcagctccaaactttgtctctgtaactccttccatgggtgttttgttctcacttctaaggaggggcatagtgtccacacttcagtcttcattcttcttgagtttcatgtgtttagcaaattgtatcttatatcttgagtatcctaggttttgggctaatatccacttatcagtgagtacatattgtgtgagttcctttgtgaatgtgttacctcactcaggatgatgccctccaggtccatccatttggctaggaatttcataaattcattctttttaatatctgagtccaaggcaactcttataaggataacatttaattggggctgacttacaggttcagagattcagtccattatcatcaaggcgggaacatggcagcatccaggcagacgtgttgcaggaggggctgagagttctacatcttcatctgaaggctgctagcagaagactcacttccaggtagctaggataagggtcttaaagcacacagtgacacacctattgcaacaaagccacacctcctaatagtgccactccctgggccaagcttatgcaaaccatcactggtactttgtgcagcacagagttagacatgctcaagcagctgagtcagtggatgaaaatgggtggatgagtggcacttctgtggcagcctgggtctcacagagcatggttcatctcttagcacgcatttgtgcatgctatcctccacactcatgtatggagaagaacagtggccttctgtttgggtgcctggttcctgtcccagcttgtcactttcttgctgagaggtagaggtaactttagctctgtaaggtaccctgtacctccccgatgccccttacatggcactcagcagggcactgcctgtgagcaagctggcggcacacagctgagagcagtgtgggggggagggggggtaccttgtcggtagtctctggctgataccagatgtaatcgcttcttatttaaggatcgtaatttcaagaacttttttctaacgcaccgcaaacatgagcacgggggatgggggagatgaatcgtgggtgaaatgctagctctggaggctcaaggagctgagttccaatcccctgagcctatatcaaggtagagtgcagatgtagctggagtcagaagaaggaggcaggtaggtctcgagaactcagcggacagacagtgtagtcaaatcaatcagctccatattctgtaagatggcctgtgtcaaaaaataagacgtgaaaccattgaggaagacatctgatgatctctggcctccacatacatgtgcacacaaatgcacatgcccatgcacccgaatatacacacacttacacagacacatatgtataccatcacacgcatgcacacacacacacacacacacacacacacacacacacacacaaaatataagcacatacgagcactaagagttctgaaagtattctgagctcttttgtttgtgaaccatactatgctctatttatcctgagagtagtgtgagctaaacaaaaagaaaggaaatggccagaaacgtggcttacggcttataagcactgcctgctcttgcaaagaaccagggttccaatcctagcacccatatggtagctcatgaacacctgtaaatccagttccagggatctgatgccctctgctggcttctgcaggtattgcacacacaattaaaataatttttttaaaaaataggagaaagttgactcattatcatattagcaggcaggttatttttaatatatcattttaactatgtttatgtgtgtatatgtggcgggtgtatagacatggatgcagttgcctggggaggccagaaaaggctaattagctcccctggagctggggttacaggtggttctgaaccacacagcgtggatgctaggaactgaatttaggtcccctgcaagagcattatacgctctttaccactgatccactgttctggctctcttagcgagcagctctaaaggtaagatttgaagtgcttggaaatgcaaacctattgtcttccacccatttgtgtctgttcacaggcagacagagggctctggagtcctgccagcattttaaaattatagctaaagaaatgatccctacttaattagtatagatgttgctgggtaacttctaataatgactgcaatttgcaatacattctccccatgtaatttagcacaatggggccctcagaacgtaggactcatatttaatcaagactcaggattaatatagacaagaacaaagtttaggtccccagcctttgtaggggtgtaggggggctctgcgggtgctggaaggaagatcctgtaggtaccaccattctcaacagcccaatcatactccagagtgcatctctcatccctgaagaggaagcaatgtcaccactcagctcacaagggtctcagtgtttatgtgcctcaattttcctatctgaaaaatgaagacaatgtactagagatcataataatatatacttacataactatgtttctatagatatataatcataagtagtatatcaataagaaaagtaagttgtgagtagattggtggtgaaaggcacatagaaagtagcacgcagcacccaacagacctggctcattatcctaagtagcatcacctgggatatttttggatccttggctaaggagagcagccttcatgccagaacagagcatgtgtttgtaagaggcagcttttcgttgctgtgaggaaaaaccccaaggctgtataaagtaaagaggtttattttgtcttatggttctggaaataagatgtctgaacatcatggtatgagttggcaaagtcttttccaccctagaccccatattgtatcatatcatggcggggggtacctgaataccactctccgtgcgtgggctgtctctccctgtgctgcttttatccctgctgtgaccataggcaagggtttactctagatcctggtttgagggtacagtccaccatgggagggaggcgtgacagcatggggcctgctatgaactggtctccttagcaaccaactctttcttctatgagtcgctttggtcaaggtgttctatcacaccagcagaaggcaactgacagaatcccggaggtggtttgtctttcttgaggtaaacttggccatgctgaagtgtatacaccatttgcttgtaagtccaccccctgtgcccagttccaacatgtttgaatcagtccaaaaggaaattcccccatgaagcatccttccttccagtcctgggcaaccgccaatctgccatgtatacctatcaatttacacagtctggttattttatataaatgaaattatacaatatgtgaccttataagtctggtttctttccttttgcaatatattttttagttcatcttggtaacagggtgtatcataccattccgtcctgactggagactctaccaatgtctcctcctttttacccactaatcctcagctaggcgttcaactcttctctgtatcttaaaagatatggctaacaagtatttatgtacgctttttgtttgaacacctgttttcaattcgttgggggcacctacatacctcaggatgggctatatataactctgtatttaaaatttgccatctcttcagtccatgatgttcttgcaaaagcgctcagttcgatctcagcacccaccctgaatgactcaaaactgccacatctagaggctcacagccacctgtaactccaactccacggcagctaataacttcttttggcctccacagttacctgctctctcatgaacatgttcacatacagacacataatcaataataaaaataaatccctttttaaaaaaaaaaaaagaggagctctgcttcctgccgatgctaggctgaggactcccagctgtcttgggctttcctgggctgtgactgcattgctccatttgctgcctcaacctctatatgtgtctcctccccttcttcgaagacaagtcagtggacctgtcttgcccagctcatcgtgactttaactaactgctcacaactacagagtccctgtgtccaaacaagggcacagtgtgagtttccaggaagacatgaacttgggagactctacttagtagctcaccttttgcctgtcctcgtccttgaaggtcttaagcaaacccatcctggggaagggagggccttccaagaccagcttctgcctctgctctacagttatagccttaatccatgtctccagggcatttcacagacagaagaagggggagattttcagaggcaaggaaggctaaatctgagcactaagaattttatgcttaatcaacttctcgtccctcttaggtacttggctagcttagaaaatcactgcttaattgaagactattatttccttcagtctgatctaagcatgatccaggaggatggtggcatttaaagattcttggattgattgctatgatttccaatggaaagagagaataaacaatatttgggccatgtgaatgcaaggctacattttaaatgttattgctatcagtgtttgtgtgtgaatgcacagacgcagtcatgccacaacatacatatgaaggacagaggacaactttcaggagtccgttttctcctctcacccatgcaggtcctgaggaacgaactcaattacaaactcaattacagcgctggctgggagaacctttacgaaatgaactatctcaacacctctgaggctctatttctgtggaaaccttgaggacacagagtcggataatgtcagagggtggggcttgtgtcctttctcttctatctcacttaggagggcctgggtttgggagagaagtttggggttggcatatcatcatggctgacagaatgaagacagcttatgcagggaccattgagggggtctctcccaagccttgagatcatgtccagtcccagggacgtctgattctcaccagaaaacagtattctgtcttgccctgtcacggtgtcttctctgctcctcccggcctctccacctgcaccgtgtgacacgggaagaatgccatgctcatagaggcttgagtcacagcccctgcccgccctcctgaccctcacaggtcccaccctggtttgacaattgctaagcaccatggcctaaactctaagacgactgaagcctggtcctgcttctcttatgactcttcttcctagtgggttgtgacatctccttccactaaggtctcttccccttttaacagagcaaggagatgtctcttaaaggacataatattcttgagtctctgttgataaatatttgaggcgatggggctctgtgtttatagaaacattggttacaggggaagaaaactcaagttggcccttggagtggggagtaaaagctgtttcattcacccactgggcaaatatttattaagtacctattttaaggatgaggaggccttttccaggtagaagaggataaacgaagctttacatgcggatgtttagagtcccagacccacaaaatgctaacactggcttctgccaaaagaagcaatggattttttttcttgaggattgggggagtcagtaaatatttttcagttaatttttttggaatttacaaaatgtgtatccgtttgtcctaaaatgaaatgtttgtcaggttagatgtgcccccacactcatcatgacgaaaccgtacaaagttccgaagcagaagcatgcccacaactaacgaacttcattggtggccatgtggggggtctgtgttctgggcacttggcaggttgcccaagtctaaactcaggctttgtcgttttactaattgagtgtcagtggactgcttgcctgaccgctctgatccatagtgccctgtgaaaccggcactgtggaagccttgtgttgttccagagagcgaacagaggccaaaaagaatcaactctagccttgtaggggtggaggctaggtgctctctgctggccttacaggagccttcttagactggatttgtttagtatggaaggctcagaggctcggctacagtgtagcacctgctggatcctgtctctctgctcagagggaagagccccttctggcatctaggaggctctatgtcctgcttgttctgggagtttttgtccttggaactacaagtgtagatcctcccccaaatgtaggtcctccctcagcaccagcagacacaaaaagaaacaaaagtaaaatggatgacacagccttcactttggtcacctttgaggtgaattcgtttcaaagtgtttgtttacattccagaaaggtccatcgtcaacagcagggagcagtgtctcagttcattccagagagttggtgagctagttcctgagtagtgactctgtccacgtgaccatcctagcaggaatcagggctgctgcaccaagggcttccctcacctctctaacttcctggagacataagagtttaggctccacttgctcgctttacttatccagagagagacaacgctggtccaaggccactcagcttagggatggcagctggtatcttaaatttttgagatccacgaatctccaatgagcagctgcagagacagcagccatggtaggaagttgctggtttaaacttaggaatcctcaattccttaatcttctaactattattattgaagtagtaaaggttatttacttggtgggaaattttccctataaagacaacagaatttccctcccacttctctgacagcacatagtcaaagggaccctgtgtttggctccccaaacccttggtgaaacagagaaggttgggccatactcagccatagccatgagccaacagtccaagcaaacagggaagaccaaagtgtggatatttcgttccttcttagaatagggaacaaaatacccatggaaggagtttcagagacaaagttcggagctgagacggaaggatgggccatccagagactgccccacccggggatccatgccataaacaaccaccaaacccagacactattgcatatgccagcaagatttgctgacaggaccctaataaagctgtctcttgtgaggctatgccagtgcctggcaaacacagaagtggatgctcatagtcatctattggatggaacacagagcccccaatggaggagctagagaaagtacccaaggagttgaaggggtctgcaacccttaaggggaacaacaatatgaactaaccagtaccccccagagcttgtgtctctagctgcatatgtagcagaggatggcctagtcggccatcattgggaagagaggaccttggtcctgcaaagatgatatgccccagtacaggaatgccagggccaggaagcaggagtgggtgggttggggagcagggcggggagagggtataggggacttttgaaatataaatgaagaaaatatctaatgaaaaaagagaaagaaatgatcactctgttgatagcgcacattacagtacaggggcagggggggcattcattatttcattcattcattcacccattctgtaagtcctctggtcagtccccagatgtgaagtcccctgcaggctgacaatgtggcatgacgtccccagcccctttagcccctggcatttgctcagtacaactggcctcactcattcatgtcatcagtgttcccctagaccgagctccccaattcacagcatttgcccaagctgctcttgcagttgggaaatggaaaagccaagggacttggaatccaggttctcgccacgtgcctggctctgcagagaaggcttggctgggaactagccctttcccttggctgagaaataacaaggctgcccactcagtgaagaataggcaccatctccacatctgggaagaggctaggttgccaacagtttttctccccgtggctgtcggcgtgttaaatagccaatagcagattcattaagcagccggcaggtgaacgcaggtttccccagagccactgccacctcacctttagtgcttcccggatacatatgtgtgtgtgtgtgtgtgtgtgtgtgtgtgtgtgtgtgtgtgtgtatatgtatatgtatatgtatatgtatatgtatatgtatatgtatgcactgcgagttacagtctccaggataattgatttcaatatgtatggaagaatcgatgctgtgggaagagagccagtgtcctgaatgggccatgccgtttgatgggtaatttcctcccagctctttcagccaagggactttcactggactgttaaatttcttgactgagggagaaatgagggacccacggatcgtagaattgaattgaaagtgagaacatgaggggtgaggggcctgctagggggaattcagatgtgccttagaaggctaattcctaattaatcgcttcaccagtgtgtgaatggaggatttgagaagtttgtcacagcattgctgtggtcgttattcaggaagtgatgggccagaaaacacatttataaagtgaatctgctgaaatgctggtcagagggtgacctctggggacacactgagttaggaaggctgagctctgatctggcagcagcaggttgatgtgggtcaatatttctgtcactttccagtggcgccatctgctggtcatcttcagcatttgccctctagcttcaagtgttgagagtgcataaagagctcctgaatcccgaatctagaaggctttcaagttcaggtactaagctgagcagagaccataaaatgttaaccaataatgccttaatcacgtaaaatcaccttctcggacacccatcagtttcctctccaacagccagcactttcctatcatgtgtctggcccactgggcagtgagctttccgagtcccctctcccactcatgtgtcttcatgctggaacccagtttcaggaggttctcagctgtgggtgcccccagaagaactgggacagagatgtgccatgaccatgtgtgtaatatgcagggggactgtcctgttgctggctcagagcggatcatgaacagggctcacctgggttctcccatgcatcctaaggttggcacggggtctcagaccacagagcctcagattatggaaggtagtgtgtctgagagacaggcaacttacagagtgacaggtactgagcccaggtgtctgcctcacccatctgtctccctgtcctcggtgtactggcaggctgacttaagacactaagatgctcaaggctgcttgtacatcaaacctctctggagttcaacacctgcctcacaaggcaataacataacttctgcctgcccttggcttgcgagatccagaacagtatcaccctgtgatgaatagtaatagcattccatattgctgttcatcctggctcaacagcaaatagaacatcaaggacatcgttctgtcccccaaggtaggactggtgagggcccctgaccttaggaaggctttctccaggcaagccatctgttgaccatctgactctcggctcagctcgggagccatgcgggcatgcctccgacatgacagacttggaagagcagtatttcatgcacccaggagtgccttgaagctgaggatgcaaacgtaatcaccatggcttctccagcacccagtctatttaggtggtgcaagggggtggggcaggaatacctcatactcactgaagtcatctatcagagagcgcccccacctgtcccagttagaatagaaacatttaaagtgagcatgtttgtctagccttgccaggtaaactagactccttccatggtatggaaaacacctgttgaaccaatgaataaacacatcctgggcaaataaagaacaatccctattaccatctcctggtcacactaaaatcagcatttctttaaaaatgcatgagctccgtgatgcttcccagtgtgaaagccagccattttatgaaattggtgtgcattttctactaaagagtagagtgtctacttattaatattcccaaggggtagcttttgggttctctgctgtgctgctgttataattttctataattatatggtgctgattgtagtttgccaacagaacgtcaataaaatgaaatgtaaccctggaactaacacactctctcaccaccccacccccaatctcattctcaagaattctttttctccgactatgcagccttacaatggcctggggcccagggaggcaagaggacgtcctccccgaaatcctaatcactatgaccatgagtgcagagctgtcctgcagaattcaatttgtacaaataatagggaggatatctggtagaggactcgtgatcatctagaaatggagggagaattctgtttgtatttctttggtcttgcttttttttatgatgatggagaataaacctgggatcttgcacatatttggcaaatggtctacaactgggtacacacacaatccatggattctctgttagagcagcattatgagccagatccagaaaggagtttgacagaattcaaaattaggaggcagagccatctaagagccaggaaatagattctctctagacactgaacctgctgacagatttagggtttggaaatcctaaaactctaaggagtttctattgtttatctaccatgtgatctgatgtgccttgctcagtaacctgaattgtaaagggggtggagcaaccacactcggtgccattaaatagttgagtgacctcatatgaatgagtgagtgaatttatgaatgcatgaatgaatgaatgaatgagtgaagctaccacaaactgacttggattggactagaatgtgcccctccctcttccattttctagatgtgtgtcttgggccaaataagttgtggtctctctgggttgtggtcacctcaggagtaagaaggctgtagggagcacatggtccctctgtgcactgtgcaccaggcaggaaggtggtgaattggtgggattttaatactagaaataagagtgccctggtctgggcgtgggggctttagaacgggcatgggttcctcgagaggccggcatgggctagataggagaatcgggaggaattttcacggttgaacatgtgcgagggagtgtcccaagcacagactcagggctgttgagaggcagagggcaggctgctcctgaagtcggagctgatgaagatgctggaaaggcaagtatggggaaccacccaaattagcctctcccagaatcctctctgagctcaacccccgagcatgaggaggtggctacgtttgttttcctttttgacgcaattgttagagtagatgtaacctcttccttcctgatacattactcaaatacattagttctcataatttttttgttttatctttttatgaacaaaaccacctgaaacacctgggtccccgctttctgtggatgagtgtatttctacatttggaggtagcatctatgtgtggagacactgtaagaggttcttgcttaggttttgaagattttacgttaatttggaggatttgaaagcatatccatgcacataaggcctagagccttctttgaggagctcaggtgtggccggaatcactgtgcaacacaaaatgatcgagcttcaccccatttcttggcatatcatccctctccccccatctgcctctttacttacagcctacagccgctgctccacaggtggacgtgcaggctgggcttagaatagctctctgatggcagaaggcacatggcactctctggcaccctcgctggaattcccacaggacattgggaaagagagttgaagaaagggaaagcctaatttttattgcctgattgcaagcaacatcctttcataacttcaagtgaggtgtctcattttcagcacctcgccatgccaagttgtgggagaattttaattcagtttggtcttccttaatttgccgagaatacacgcgttttaatcttcttttattaaaaataaatccagcctcctcacttgggtctcttgtgtaaatatctaattagggcagaagcgtggcctggtccaacgggggtgtgtcattgtccctcaagaaagaactgacttcaaagaactccccctgccacgtgagcaatgttaattgagccaaacaacgtgcatgaattatttataactgctcccctggttatttggtgacaaaatctgattccaagttgcagctagatacacaatgtccccgaattataactcagactttctctagcacacccagtcgtgtgagcattgaacatgcacagcttctgtgttacctgggatactatggaggctcaacctgcccaagcctggactaatctgggcaacctctttccaacccagcctgagtgctcctggggaagggtataggaaattgagagctgctatctcacctcccccatttcatgagaaagagaaaccaggctgaggtttctactgctgagatgaccacatactctgagtagcatatagttggtggtcagggaatctgcaggcgtgagtttaccttgcgtgtgcttggatgagcatcactcctttttactaagccctttcttaaaaaagaaggacaggaaacatgacaatctccactaaaggtttagtgcagcccaccagcagggcaagatagagtcacagtaatgaattcataccagtagcatttggatagcaccttttctgcctgtagccttgaccccttcaagacacacagagagctgtttccctacctggcatggagggtgtcagggtgctgatctatgactgagaatacaccatagtatagaagctacacattggaacctgctgcctagaagggagccaggcactggctttggtctctttgtttttgagctggagtttcttgtaactcggcctgccttgggaccctgaatgagctacatagccaaggatgaccttgagctgcagaccagcttgctgccacctccagagtgcgtgggttacaggtgtgcatgtggcctcactgatcttctatctcatgccgtagatggtacccaggatctcatggatgctaccagcattctgcccactgagctacatgccccgttttccactgtgttctgaaagcagccctcttctaaaggtagaattacataataagggcaaatatgcacagacctcaagcctaaggtttgatggatttttgacaaaagcatgtctcttttatcacccgaacacctatcatgagggcagactgtttccctgagaactttgataagctgctcaagtcactgtcacagaaaataatgctcatcccttcacctctagaatatgctttctagaactttctactcctagtggctatggagggaataagtcagtccattgagccctacatgagggcacaaggaaattccccagcctgtttcctcttggtctcaattgggtgggaatcaccaggctgcttcctggtggtgctgggttccttgtgtgtgatttcttcccacaaagctttgcagcaggcaggtagatcgatgatgtctgtgcagcagcctctagctgtaagtcacatccctgtcatctctgtcacttaaatctcctggcttgtggtccaattaaaacaggtttcattgacccaaccgggctccatagtctgtggctctgttcgtgcagatggttcttgctacttctggaagctaagcagagttggctggaacctctgctgatgacaaccattccctggggatagtgggtctgacagatgaactaggcaggaggtagaagtggtgagatttgtcgttatatatgtaattagaggctctcgctggcctttaggaagtccccgaatggagacaggagagggagaaaggaataaaggaaaggaaagaaaaggaaaaggagacagaaggggatgaagagatacccagtggttaagagatcttactcttgctccttcagaggatctgaatttggttcccagcactcctgttgggcagttcacagcctcttacaactccagctccaggggactcagataccttcttctggccttcacacacacatttagttactgggcactggtagagctgggtgccgaggtgatgggcatgtttgctgaggcaattattctgagatgacagaagccgatttcagcatagagaacattagtctgtcgaaatgctcgtgagtctcccttggaagcagtaatgcgagtgttggtttatttatggatcttgatcgaagggcgtcactagctgatttattgtccagataaagtcaaataaaagtcatgagggggaggaagtgatctttccctgactcttccattgaaagtgtctgtacctggagggctcccaaaacactgcccgcattgcacagctgtctcttgccagcaccccaggtgcagctggcatgccagttccctgaacggtgctttctgaacagaacacaggatgtgaccagaggggaaatggagcagggccagggctacttgcagactcgtgaaagtaggggaactgcctctcacgccttcttgtccccccaaagcagaaccccacagcttagcttgggggctgtattcttgggtctctcataatgcaggttcagagaaaaggttgtctgcagcatgaggaccagcggcccgaaggaacagcacatattcgtcttgcccctccaagcacactggctccccagctacagataacctgcttccccatcttctgacaattttactaagtcctgttgggacccggcctttctttctcctccagccacctgtgtagctaacacaagacaaccaggtggctctgactcacagaaccacacattcaaatgcaaaaaggagctgctgacagggagcccaaggagtgggagacagatggatagctgccatcaatgatcaagtcagggtgatctgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaaacctggtagggtgtttggggtgaagctctccctacgttgttttcctcgtgtgtcttgtcacagcctcggaaggctgactagcatggagaataatgagacttcctttcccagtgaacgaacatcaccatcgccgttcccttacataattggcagtcccttctatcagtgccgtgagatttttctgattgaaaaaggaacagagactgagagggtgctgagggcagggtcctattggttatctctcatttttaaatctgtggatattgaacttactatctacagggtttctttttttttcttaatcaccaatatccactcactagtaaaaaaaaattgagctaagtaagatcaaaagatgatcccacaaatggcttgcctctatgtgacttttgaggaatgaagagttgaccgtggccacatttgctggtcttatgcagcctccatcctttaactttatgtgactctcattcactggtcttatggacacacacacccccattcactgctctctgtgacccccacccatgagtctaatgcactcttcatacacttgccacttgtaggttttcagggtcttcctggcttctctggttggaaacttccaggtccctcccccaaacagggagagtaaagtttatccccaaaagtctggctacatgtacctcattggtccccactgagagaaacgctgctagcctcctgctccctaaaccactaagcagactggaccagacacttgctgcttgttgatgaagtgagtccaaggatgctgagtggaagcctatgattttcatgctctggtcttgtagcctggatgaaagtgaatgagttcctacagaagagcctcttcacttcttactcgtcttcaagagggctcggtgaataattggaattatgcaaattagcatgcagcacatagggaattgaaattgttccctagcaggcctgcgacaggctcagagactcacaggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttgagggaaaggagtcacaatggtttgtaactctggttctgagggatctgacaccctctatggctccccaggtcactgcactcatatatatcacacacagacaaccaagccctcagagcttcagtttggatcctataaggtatagtaaagtcaggaagggccaagtctggggactctgctgtgctccacagggagtggctgatgttgctagccattatgccatagtgctgttgccttccttcccacatccggatgtcctacattgaactgcagcctatgggtgcagggtgaccagccttagctgcctagcacgcatgggtgtatgacatctgtgctgcaggtgagagggaaatacctgccagttgtcactcgggtgtctttagtcctcctaagttcacttctgctgtggggatttgtcacagatcaagttcagcctccccccagaacctttgctgtcccgcctcactaagacccatggataacgtgtgtgccaaagtgaagcaccctgagaatcggatagtggccctgggaaagatatcctggaaccttccatgtctatgtttgtgtttccctggtgtggagatggtcagcccaggaagctgaaagggaaactgtggccctcacacattggcatatataacctatcactctgcacaaaaggaggtttctgacatctgatattgagcccctatgtgatttcagtaatctgagttgttagaagaaagtgaacctgaacaaacaagtctcaggctaaggcatcattgcatggccttctccattcagccccaggcttcccaccctcactcttcaggtctccctaggaagcagagctcctgtgggctaaaacaaagattgccctgaccgtcggccacgcacagcttccttcaggctgcagtgtcatcccgcctgctgaaggttctggttgtgtgtttcctttctggggaacggtgaccgacaacctggtcactgcctttattccttggcaacatcacctccacagcttctcatggggccgctaggtctctacccttgaactgcccttccagctccgggggtggtgtggtgtgggggtgtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgttgatccttgtcatgggaagtactggagtagtattcagtggaataagaatgatagttttatagtcctattgagagatgggtggattttgagtagagtaaaaataaagtgtgcttttctgggaagagaaggctttgttcatcccagctctgcagactgcacaggctccccgggccgcctgtgcttagcacttggcaggcgcacagccaatactactcagctacaatccttggagctcggcgtagatttaattcctctttcacacattatttctgtgcagattccgtgcctgtgcttactaagtagcctgcgcaagtttttgagaggggatggccagggagcctccgacaggttgttactagccttagaattcaagtggaataataaagagacaccagatggctgggcaggtttgatgtctgcacactgtatctccctctactggtcccatcaggaagttcggctctaagaacttgcagacagacagccacacttaatgaggggaagcagttgagcttcgtcctccccaagggtgctggcctagcctcctcctagatcattgaatgcttggtggggaaggctattaatgcttgggatgaaacaatgtttcacccaggaattccgcatctctggagttggattaagccaattaataactcccaatcaattaccctgcagtttcctctagtgtatgtaaagtaccatggcagtgctcagtaacagattggagagggaaaaggcagtgtgtggcattgtgtgtgaagctgcctgtcaaatgagagcctgggcagcacggatcctgctgagggtgtgcgtcgccagcagccctgacctccaacatgggctttctaatcctgcagtctgacttaatctggtctctcatgctccaagaaccagtggtgtcatgccttgaggggttcctatgtacacaacacccatgcgagtggcaggctagagcagatgcacactcaaccacggagctattcgtgtctggtccactttataaatctacaacatgaatttgggaactaggaagaggagaggtcacacataccatgccagtggccgctgactaatttctgtgaggtcatttttataatgtgctttgggtcccattcgtcttggcagttctacctactgagaaacactgggattgcctggctccttccacgtcttcagtaattacaaacattagtgctccctgttggaacagcttgagtgctgagcatctatctactggcctcagttctgaggtctgggtccatttgcatccttcttggaggctttgggtagcaaaacttttctcagtagagatgggacagagcccctgggctggctgtggatgaggtttccttgacagggaccccatatctgcatgggcaggtgccattgcttgcctccattggttaggagtccttaagcaaggttttctacaccacagggtagtcaccatcactgtcatctctaaggatgattgaaggtgactgggcaaaatggggagccaagatctgaggacagattgattacctgtgggtggggtcttaatataaaagaactttctctgtgctgaaccccttgtcaatctgtctgtcccctgcatccattcaactcggtaaacacttagctctctcctgaggctgtagatgactctgtagagtagaaagttggtacagtcagaggcaaggccaggagagggctactgaggtggtctgggagagtgtattgccacagaatggaagagggtagagaaggacactgatgctggcctcaaggctgcttggtcagaagctcctgagccaggtatggagggcatggatttggctggcctagtgagaggggcccaaaaagcacacaggaaggcatgggcatctcaagacaccacagccaacatagattcaatttgtccagataatggctgtgtaagggaggcagaggaacagttggtattgggggatgtggtatctggggtgccaggtgactcatgcagatgcctcttggctggcaatatggataaagctggggtctgatcccactccatgctggctcaccctcagcaatgtaggagctgtgagccttgggtcatcagtctggacctgcagatgacagggactgcactactgtagtatggagacaccaaaagagacaatgaagtcagcaggcaaagttcttggtttcctgaaaaattacaatgaactactctcctatttcttcgtcctccctactgagtgacagccacgtccagagacttctattcggaaagattctgagcaggtccttttctcttcgtaggtgcaccatggagcccttctgtccactcctgctggcaagttttagcttgtcgctcgccagagctggccagggcaacgacaccaccccaacagagagcaactggaccagcacaactgcaggtaaggacccctaacctgtacccaactggccctgctgcctcacaaactgccatctcccaagcacctagcaccgctgggaaagatctccagtggttcttcctgtatgccaaccaggatactgtgtatgtacctagaaccagagccatctaagtgtgttcaagaaggatgttccacctgctggggtcagggtagggatcaatcttggaaatagggagtgagaaagtctgtagagggccatccaaatgtctaagtgagacaaagtgctggctgtcaggcctaataccctgagttcgattcctgggacccacacagtggaaagggagagaactgattcctgcaattgttctctgacttctacaagtacactgtggcatatgtggtcacacacacacacacacacacacacacacacacacacacacacacactcacacacacatacactcacacacacacgcactcacacacactcacacactctctctctctctcacacacacacacacacacacacacacacacacacacaattggttaattcaacaatacattctgaaaagtttgtgtagagccctactaggagcagctatgaccaaacactgaccaagaggttgagcaaatgtgaatattggcttgaaggtttgttgtgtaacttttcctgaggagagatgagcaaacatctaattactcaacggaggacacccaccatagacccaagaaatgactgtgtccatgcctagcttggtgaaccagtaagttttgggagattacttagagaagcatgagtgactcagaggcagctgtttcactggaaaagcccactgcagcctgggtgacaactcacaaaagctatatcatcacagtctcctgcacagtttgtaggcagctccacttaagagtccctccaccccaaccacaccccaggcaatttgcctctggattgtaaaacttcagggccttatgagtcttgtagctttatgttttgcgagctccctgccttcctttcatgagaatatgtttgaatatggagcaaaaaaagccgtgtaacagggctaataatgttattacttgtcatttgttaatagtctgtaatattggtatgtggtaagttttcctcttttaaaagaacagctgttacttttctaggtaaatgtggagcattcttgggtgtgtcatggcttcaaggagatagagctgaaatggactgccatcgtcctagcctcactagaatgttaggacagatacaccccagggcaggcatagggattattcttagtctgttccctcaccttgtagtttaaatattaaagacaaaaaaaaaaaaaaggcatacagatgcccatgtgacatcaaggaggaacctcagagacatttccaccgatagaaggtagacgtagaaaccccatgatacagactaaggtaggattgcattgctgggaaatatccagcacctgaaaagcatggacaggaagagtagtgagcagttgctgggatgaggagggagacaggaggggtcttactggagacaaagaaatactctaaaggtgcgaccatagccagagctgcctaagcttggcaaggtactcaccatacattaaaaacaagttaattttgcatgtaaatttcatctcaattaaatgaataaatattatgcaaagccaatgtgaggaagaggaggtagaaaagaaaaaaaaaaaaaccaaccaaacaagagtaggtctttttggctcttactccctgggttcaaatcttgtctcagccacttgttagttgggtaacctgaaatcactcactctatgcctcttctatgcccctctttgcatcccttccccgactcatgaggtacagaggcagtgagcattacgaagataagcaggctggacagtcttcagagcatagccgaatttctcaacatctgacttttgctgtggtcaacagggagcaagctccagtcagctatccagtctctgatagccaggagctctgatgcttcagtccctcaacttctccattgtaaagtttgtgggttgtgttgtatacagaaagagccaggttcagggcagatgggtgaggtcaggagcccttcctaaggagttggcagggattccctgaagcgtgtctagtggcaaagtcagaaagaacccgcaatggcaaaggctggcccctatcttttcacatgccacatgcccatccatctcttcctacacacttgctccattccttatagggcaaggcctacccacaccggggcagaccatctgctttattcaacatatagattctagtgttagcctcatccaaaaattcccttagatggtagtctcgaaattattttgcagccatgaccccatcaagtttacacatggaactgagcaacatgtttggtactggcccttgcaaggcttaaggaggactcaaattatcaatatccttaccgaaaagcttcttagaaaaagtcagtggtagttggtgccttcccagtgggtcagaagttcaactttcacccctctcaagggcttcacaaggttttcagaccatagactaatttcctacaggcatggtggtgtccctaaggggagggaagaagaagcactattctgccacgaaatcaaacacctgagagaacactcttgctgtattgtccttcctccctgccctgacatccacatccacagccacaacaaacaaacaaacaaacaaacaaacaaacaaacaaacaaaccaaccaaccagacacttcgtgcaggcctctctgcacatggctttccacatgcaaataagctatcatgtcctgcggcaccgaacattgtacttagacttgccccaaggacagtgaccttcaagaacattcactaaagtttctcaacccacatccctgacttccctcaccaaatactaatcagctggccacttagggataccgcgaaagctgtctgcacatgctagtaaacaccttgaagccaccgggaacggagcatccatctccccacaggagaggtttgatctgtcagagtcctgtgacagccccacaggtggtccctcagggtggcatcgccatccaagttaggactttccaggttcatttgagagcaaaatgtatcggttcatcacatagccgtgggcaggaagtgttgctttcaagaagagaagactatcacatgacttcagcccccagaacagaaacttgctctggataggtctcctctggggctcagcccactagcaactgctctggtcccgctatcaggagctacggaggcctccagttacacggctgctcctttgtcctgcaacttggaagggggtcccaagtgctcttgaaaagatctggcccctgaaaaatcatgaagtatctcctgaggggttagcacattgccagaatgtgacagaacaacaggaaatggtttcctttcatctctggccaaaatgaattcaatattcatcgtgacacattttttaagacaaagaattcattaaaaatatgtaaaaaaaaaagatgtgaggaagtgttattatccataatacatacaggaagaatccttaattttaacgtgtgaaagagcacattagagaaatggaaatgttctggtttgctttgctactgcggtgacaaacactacaacccaagcaccagcgaggcaagggttaattaacttggcttacatatttcatcatggtccaccatgagggaacgtcaaggcaagagctcaaagaggaactgaagcagaaatcatggaggaataccgcttagtggctcactcactgcctcgtgctcaactagctttcttagacagcccaagaccacctacttagagatggcgccacctccagtggtgtggggcctcctacagcatccaataataaaatgccccgccgacatgagcgtaggtccatctgagcaaggcaaccctcagataattccggggtgtgtcgagttggcagctgaagctattaggtgatgtcaaacacaaccaggcaaaatcaaagcatctaattaattccattttactcatcaggcagaggttctgaactctctagatattagagaaaatcaagttaaaatgttattgtgcttttgcctgactaaaagtggaaggatcattagcacacagggagacagtgtctcccttgtaaaccccaggcgagcctagaagttggatgttttgggaggccatctagctatttctactcttgtttgatgatgactgtaggcgacacaaaggtccacttttaggagccaccttacagaaaccctggtgagacaaagtgcgagttaggggctggagagaggctcagtggttaagagcacttgttgctcttccagaggacccaagttcggttcccagcacccacatggcccttcacaactgactgaaacttcagctctgggagatcagacaccctcttctggccaacatgagcaactgcacacacgtggtacaaatactcgaagacatatgaccacctacagacacataaataggaatatcactttttttttaatgtagaagtactgggaacagcaaagtgggaaatagcctcatatacccatacaatctgggccagtccaaagtgtaggacggcaagcagccaggacacaggatgaagaggcttacctagtgtggcagctctccaggagcaatgagagaggtgtgtgttccacccagtcgcttcatacatagcatttgtgttgggatatatcgtcaagcagattattctttataatcagttcatctgttttccttccctaataatttgtaaaataacagtacttccttcagtcatgcaatcttggatcccaggagagattagtgagtctaatttatttaccaaacctatgtgtgcatgagttttgcgtcacagaagaaaaggcagggaaaattacactcacaacttcatgctagggaagcaaaacagcccacctatgtgtgttcgctctgactgggctacttggaatgtttatcgtacgcctcgggcccaagaagctttatggaccagatcccagaaagtcctccagagcagtcctccagggactgtcgtctcttcccagagcacaattgctcactgtgcttcctgccttttctcttcctcttcctcttcctcctttactcctccgcctccttgctagggaccctctagacatgtagagtgtccctcgttggaggggcactgtctgttgcagattggtgcagagttccatggggtctggaaagaacttaaccaggctggcccatgctcttctgcctgggtccttctgacacagcagatgagtcactggggacatctgtgttcagagtaaaagtgtcaggtcccactgcacacacaaactattgcctttttagtgtcaagaccaggttctgtgtaagcaactgtgtgtgtgcacacacgcaggtatgcctatgcctaaagtctatgtgaacacacatgtactcccttatcacagacagttgggaaacccagcaacactttaggaaaagggctgaatcatctagagagacccatctgcacctccccactctggcccttcccccccacacacacctccaagtcagtgtgaactggaaacagaatgtgaccataggatatcctctaggaaacctcatgcctccctgggtggaacaccactgggaccaaggggacattacctagtatgcaccaggatttatttcctggcccacattgtttatcaaaatttgtgttaaacctaattattgaccagcatccacaatttcaaagacatttcataaggtatgggcttcttcttttgcagtatttgaggcaagaagtagtacggacccatccttccataggctctgacactgtagccagagcatgcccacggttccctatgtcccgtcccacccagctggctctgggtgttctgctacccttgggaagcctgcgaggttctggccctgacctctgccttcctagacaaagaacattagaagtaacagaaaccaaattgagggataatgagtccctctgaccatcctgcctgtgtgacaatccatgtaggccttgtgtcactcaactcatgccttgtggggtccccatttttctgtgactgcagcttgtactccgagaacctggacacagaggctggaccctcgagtactttgacagagcccaggggaggattcacggggtcgaagtccctctgtctatgatggagtggaccttgtagccaagccagtttagtagctgcttctgcagagcagaggctgggctctgggtaatgcagaagtgggtattgtcaccatggtgacacacccagaaaagacagtgagcatttcctgagaagaaggaggagactgcccacactttctagtggcctttgaccaaaaatggatggagttgaatcagggaaccctgagcagtggggctccctgagattggcttagcgctgcccttcaggcccaggcagctctcggcagtccaggttaaactttgatacaggtcctagtctagggtataccatttccctggagccacagccgtggaagtcgtggaccaggctgctcctaacgggccccagctgggcaatgggcaggtttggagtatccccctgagggagggacagatattcctagccattaagtctaatatatacctgaccttgacatgctgggaatcagcttctcttggccagggccacagatggcagactgtgggtcatagcctgtagattacatacatgcacaggactggggaaactatgacatttcaaactccttcctggagtgctgagtttctatggaccagggtggcacatgggaggaaggacatgaaccctggcacacacactcagcttggggacaatgtttggcacttctggaactcaagaggatggaaatcgagctactcacctccagggcctcccatgggagaccggctcactcctgatagcatgtgctcaccagctgcagatcatagctcctctggaccagttcacaggagccacactcattcactggagaagcaggcttttgatggggccttttggctgggagctttgtggtgataggagggcaccctaataggttgagagagaatgggtcaattgatgaccacaaggacaccaaaggcacggtgcaagggtagggatatgtgtctctctgaggaaggtggacctgggaggtgtgaagaatggatgcacaagttggttccaggaagccagcagtctctatgacaaagaattcaaggctctgaaaagccaggccattgtgtgcctgttcctcaataactgtatcaaacctcgggaccgggctgtttccttatacctggtgctcctgattcatctgggttgggacacaacaactgtaccctgaggggaagccaccttcctccacctcctcattgaagagagaggctgggccaaagatgcttagagaaatagctgggctgggcagtggtggcgcacacctttaatcccagcacttgggaggcagaggctggcgaatttctgagttcaaggctaccctggtttacagagtgagttccaggacagccagggctatacagagaagagaaaccctacctctgaaaaccaaagggaaaggaaaagagagagtgtgtgagagagagagcagggtacattggggtacgaggaggtcacccttcgtcagagtccttgaacaagtcccaccattgcactcctctgtcccctggaaagaactgaagggagataatttctaaactgtagcatgggggaagtccttacccctacccaaggtcctgatggggtctctgccctctaccaccccacccacccacaggccctccggaccctggtgcatcccagccgctgctcacctggctgctgctgcccctgctcctcctcctgttcctgcttgcagcctacttcttcaggtaggagtgtccccaggcgctgacgtgctctcaccagctcctatgaggaaatgagtgtgctggaggctgggggtgtgggcccaaacagctcagacagcggctggccaggcctgagctgccacacagctcagccatgagcagcagaaagaacttttcccggctcacctggtgggtatcaccacactcagggcttgggggttcccgcggtgctgagacctaacacatcttgtgtgtgcctttaaggttccggaagcagaggaaggccgtggtcagcagcaacgacaagaaaatgcctaacgggatcttagaagagcaaggtattgtacactgggcttggtacagcgggcaggcatggggctgtcactcaagcttgccactctctccagctcctcctgggctcacgctgtcacttgctagtaacccagaatctctgtttcggaacttagtgtgagaggtcgttttttccctgcaagagagcggatgtctgagacatttcagtttgtgaggttttttttttttttttttttttttttaaagagaccactcatatcctgtcggtttagcagggctttgccaagtcacatttctcactgaagcctttgaaatcaccccgtgatagggctctaactcatggtgaggagtgttcagatgtgacggtactacctcaggatcaagctggaaagggcactgctctgccagagctcatcgctcttgagaaggagtgccagtgaggggacatgcctaacttaaattccagctgtgtcctaacttgtaaacgctgcttatgaaagcttgtttttctctcctctctgtgtggtttcaaaggtgcaggctctagctgagtcggggtggcatgggcttctaatctcagtattcgaaggcacttgttgaggcaaaagcaacacaggttcaaggccagactgagcgacgtaacaagatccatcttcaaatggccaagggacctggggatacagctcagtggcgtagcacctgcccaatatatgccgagcccctggtttttagtgacgatttaaaacacaaaacgctggctcacagcagtggttccagctttctgttctaacttcctgcagagctttgcctgccttgaggtaacgtgcatgccgtcagaactcaagcgacactttagaactcccccaaggtagtaaaggaactaacacaaccccacagatgggaaggctatgggcaagagagggctcagctgagcggtagcattgcagggcttgggggacctgcacatccgcatagacaggtctggtgcatctgcagtctgcaacctgcccttctcgcctccccgcacatcccaaaagccagtgcagagggaagagtgtggctgggaggggcaagaaggcaaaggcttctaccagctcatctggctgcagccgaagggtgtctcagtgagctctgcaggtgggacagggccttttgcaaaggtgacagctgacttattctactgatcttatggaaccagctccctctctgtgaagagagaaatgccagtccccagcagccctttgtagtgtcctctcctcccgtgcttcagagatggtttgtttctctgcattgtaatgcatgtgatttaaggaagcgggtctatgcattgccaaaaaggggaggctgcaagacagagatcctggcagtccccccatctgctctgagtgtatacccagagccctgtgattactcttctctggatctagtatcatgaagctgccatgccgtgcgtggaaggaacataggctagagggaaggctgagtggtgggtgagcttgcaagcaaggtcaagaatacgatgtctatgatggacaggaatgctgccatcacttgctgaaaatagggtgtgttgggaaggagatgtttgattcagttgctcagagctgggttagccccagggtgagcgagcgatttgagaggactggtcccctcccattgtgcagatccatcaggaatgctgtccgaccatctaaggaatgagtcagccatgggcaatggaactaagtggcttctctgttgctcctggccctacagagcagcagagagtgatgctgctgagcagatctccatcaggccccaagaagttcttccccatccccgtggagcacctggaggaggagatccgggtgagatctgcggatgactgcaagcgattccgagaggagttcaatgtgagtgtcccaggtctcggccatcgcgaggaatagcgggacagtcccagccagtagttccagggactcgggactttatgtcacttgtggagctgctcagaagtggggtctggagagcccagtcactagtgcagtgctcttcactggtgctccttgttccttaggaagtgagatggttgagcctggcgctcctgggggttgctgccagctccatgattgggtgccatgatatgacagcagctgtgataaacgtgtaattctaccatgtggtgcgtggtgtaggtggcagttttatttatgctgaaggatacagggagcctcccacaaagcatcttgtcatggtccccaagaggtccagcttctaatcagaccagcactggtccctctgagcaaccatcacggcacaattcgttggttatgaagactgtctgtagaggacactagctctcgttcagtgtgtgtgagtctctgctgtatgggatgaatcactcccacaccctctgagcagcagtggctcactccatgctcggcccaccggcagtctccatagtcattctcagaactcttaactcaagacacagcacacattggtgacctaacccttagagtttttcatttccttttttatacttttaattttttatttcatatgtatgtgtgagtgtgctttgtatacgcatgtgcaccacatgtgtgcagtgccagaagaggccatcagaccccctagaactgcagttataggtggttgtaagccacaagtaggctctgagaattgagcccaagtcctctccaagaaaggaagagcttataatctctcagccatctttccagcccccaagttgttgattgcttaatgactgtcatatgggtaggcatgaagtgctattttgaacacagagccccgccgcactgctggtgttctgagggagtttgttcaagtcttcaccctgggtgcaggactgggagatgaatgttgggtcagagcaagagggggtgtccctggatggctgccttggcctggctctgtcataacagctattgtactccaggtcacttccaacaacagtgtctgggggtggaggctctacgacagtacagatgtgagcctctcagatgatgagctttttaaaaagtgccgtgtggttgtttgtagagaggggaccaaccacgcagagatgcctgcgagggcctgggaaggctgtggtgggctccaccacagtttacccacttgtcagacttacatcttcctctttagcttgcttccctttttactgctgccaaatgtgttttcctctttttccccccctctctctctaaattaggtcatactgaaagacagcaccaagcactgttgttttgcaaacttacaacttaacaccagaagtcaattctccatttttaaaatagctgttgctcacattgctggtaggagcttgtccctcctctgcatctcccacttccccttccagttctgctgtcatatgtagggtgccagggaccagactgtgaatggagggtcttggagtagggccaggagcaggatgaggcaggtgagggggacttggctcaggtgcagatgtcaagaggactggaaaagcacagcaggcaagaccctggtcccatagcttatctaaaatagcaaagcaaaagcaagccatggtgagggggacagattggtcactgtcaggagagaacaacggctgtgatctccctgctgcccggggctccactgtgggtgttgtcgagcagatatggagtctaccattattgaacagtttgatgtttttcaccattatgagttttaaacactaagttagctttttagaaaggatgaggctgctgatgagatggctcagccggtgaaggcactggccaccgagcctgaattctgaggtcaatccctgaaacccgcatcatggaagaacagagctgtttcttgaaaaccaccgcgttcatggcatagcatgtgtgtgtgtgtgtgtgtgtgtgtgtgtgtgtgtgtgtgcgcacaagagcaaacaaatgttatctaaaattttaagaagaaaacatatgatagaaaagatggaggagccccgtaaattttatactggaaacaaatgattccctctcgtgttcctcccaccctgcctctctgtggccctcagttgtgcagagtcctgctgcctgtagagatacagtgtaaggtaagagcacagacagcctggctcctctctccatggccacactcctacgacacccctctcctgtccaaaccagccaggccagttctcagagaagacatttaagtttcccacccctccctctctctggtctgacaccctctcctaacggtcatggaagggatctggataagtctcaacgtgcatttggacattcctatactgccaagtccagggttaggtggccatgaacttgaggataagaaggactttggcattcagatcatcgggagaatgggatgaatgttggaaccggtttgtctgtgtactatcctggcccggaagacttgagccagtcccttaacctctgcctcagtttcttcatctgtgaagtagggattttccctgccctgtggggctttgatagcacttaaaccaataagtaacaggtaacttacagataagatgttatctgctagctcctcctggaaaggtagatctctagcctgtttccaggtcctgacttcagtcccagaaaaggaggcctctggtaagcatcttccccagctctgacccagcaagctgtgtcaagcctccctatgataaatacaatagaaatccgtacagagggagttgtttgtttacaggagtccctgcaaaccagagccttcctctgtcctctgggtctatgaagcaaaccagacctcctagagcatacacaaagagtcactgctggcagatcatccccagacagtcttacttccctggggctaccaagcagctgagaaacctgaggttcttagtagcctgacagcaggaaaaaacgtgctggacccaatctgtgcagggaacttttcagcttgcttggttctgggattatgtacaggggcagagagaattctgcccacctccctttgtcctgtcctctaagagcctggggaggcagagtgaaccaccacatctctatggcccacatctcagagacacacagctgtggaagggtggccagagcctgattcttctttgtacttaggctccgctggccatcatgttgccgctaccttgccttcctttgtttaatccagtttgctgtttttaataagccttatttttagagcagttccaagcatgcagaacaattgcatgcatgctagagtgtccccatgcactccatctctcccacggagcatgtccctctgtcgtgggccctctgcaggggcgaggttcatgtattacagttatcattgctgttggcggtgttatcactgagcccctagaatctgctcattcttgagctttgccagatgcagggtttttaatgtgccaccgtgacattaccatgcctggattttgcattctgagttaaagctttctgagaaggtcctgggatgtcagcacaaattcagtgtccacttagggctgaggggtagcgccaagcctgcactggtggtgagtctgagctcaaggagcctgggtgttcatagctagggacaaggttgagaacttctcattggcattgccaggatgacctctgattggcccctccacactgacccaggcagagcctctgcctgtggctatgagatgtggtggacctagagtagaggagagagatgctctacagcgccttgatgtaagcccttgtgggaactgagttggccactgaagaagctcctgtcttctagagagaggccagtgcccttacataaaatgagaacaatctcggaacattatggatgtcatctgaggctgctctaaaagccagaccccaactcccagggccctaaagtgggacacagacagcaagaaggccctcatgtttccctgtgcttgagcaagggagtcctttcaggctatattactaaggtctatcttttcagtcaagtgatgatgatcacgtttttaacactgttcatttggtctggtcccatgtcatctcatcataggctagttgtaagggaagccatatattttccctgtgcttgacacagcacaaacacgtcttccttggcgcccagtggtactaggtccaaccagaggaaggcttaatgttgaagagcatgatttgaagttcaaggtgttctttaccctggctcatttgagcacaaagaggagagcccagaagcacgcaaacagcagacagctggagggaagcaagcatcagaggcaggtggcttctgtggtagaaggaagtagaaagccacgtgtctactttattcccagatgtgatgattctcagttttagcatcgtggcaaagtgaaacttccatttcacactgatactcctagtctggggccagcggtcattaacggggtacatcttaagctgcagagagtcccaaacacctaggggtcctcggggtctgggagaatcagtatttctcaggagcttctggtcctgacctaacccacagagaagctgagtcctgggtatggtgagagctgcatctgcagtcactctccaggatcctgcttctctcctgcagctcagttgagaggtctcagcactttcttctcgctagtctttgctcctctgtctcatgcatcagaactcctttgagatcagttcacctgtactcaaggagtctctgcctgggccaagacctgtgtggactggggcacgataggctatgttgtgagtgagctcctgacctcacaaagtttagaatctagacagaagaccctgaagaaagcccatctctgtggatcgttcactgtcttcccagtgtctagtgtgggacctgacgagagacgaggacaatggaaggatggtagtattaattcctgggcttgttagtggtgctgatgggaacctgggtttagattaattagtgttcaaccaactctctgtttctttccagtcattgccatctggacacatacaaggaacctttgaactagcaaataaagaagaaaacagagaaaaaaacagataccccaacattctgcccagtaagacttgttgttgttgttgttgtttgctgtctgtctttgcatgatctgtgacatgctggttacacttggcactgcttcacagctttgctatgtcacagattatgttgtgactgctcagtgcgtgtcccagggaatccagagccaccctgcctgagtgcccatttccctgcacagggtgtgggcatctttgctgctgctggccactctggttgctaagcaggtaggaagcaagctgggcaggaacacttcacagacttaggcacaagcaggcaaggcctctcctgccagcttcagtcctgagtaccagtctaggcctgtcggtggccttgagcagtagcttccttcatagtgagtgtttgattaagccaggagcaagtcctcagtaagatttatggtccataaccaaagaccaagatggtagaagggaaagcccacatgggcttggcacccttgaggggctaaacaaacccaattctaactttagcaggaaacattaaccatgagctggtgagtgtggttgccaaggaagtgtcagagttagggtgaaagatgctgtggtctgggcatcttgtgacctgctgttgctggctgagtctaggcctgaggtgtctgtctcaccgccagggcaaaccttgcatgttcccagccgacttttcaaaagctggcgcaggagggttgcgacaccctgcctagcccacagccctcccatcctcccaaccacagggtcacccttcaagcacacagaaaagcagcctcagacagctccactaagctcaggcttgaaccctgaacagaggcctcctactggtcccagagacctttgctcttaaggaatgcctggtggggtcaggaagcaggcctcagtcagcttcagtctatacatggagctgtgacctgcccattacatgatcctagatttctagtactttctggaagcagctcttccctgccattcatgtataattaattgacttttttgtaaaggccaccatgattctaggatccaactaaacctagagtaattaatgaatgagtttttgtttgtcagggccaagggaggaggaccaagctgtgagggtggtttgtcccaagtttcgactctggacacagtagctttactgctcagtgagttgtggagatccaaggaagctatttccatggctcaatagctcaaagagcaagaagatatctgggctcttcagagaaatttatgtcaactgataactgtgattctcaaagaaccatttgacttctaacttagtacttcaccttcctagatgacttaatttatgacttggtttggctctcatgtatttaggacctcttagggccaaagacattcagggcatcttgcctaactttctctctttattagtaaacctactatcccctaaagccaatacccaaagtcttaaccaagaatatttctgagccagaggtagcaattcatgcttgtaatcctagtagcctccaggctgaggcagatggctctccagatagaggccagcctggctacatggcaagcaagaccctgtgtcagaatgggggaggggaaatgacaggagtgagaatgggggatcaaagaaaggagaaaaagatagagacagagacagacagaaaaagagccagagagtcagagagtggagtgctagttcctggtgagagctccggaacagaactcatggttaacctcctgcaccaggcacagatagggtgctcagctcaccaaggaatcattctagcacaggctgggtgccttccaaaccttcctgctgtacatgagcctgggttggattacagaagaaaaccagcctgccttctccctatatgaaagtgtggcagcactccaaacagtcccgctcaatgcgcccccaccataagttcccttgcccctgccccagggtgaggcctcatccctccatacccaggagtaatgcctgacttggggtgtcgacagctctccaggactgtgggtacatggcatgtttcacaggggtaatgggctgtttgttgtttgtttgagtttcctacagtatggaaacagcacatacgtcaaggaccaatagtggcatccagttaaggagagacatgcctggctatgttggagctgttggtcctgctggggcaatacagtgggctgaatgtcatggaggcaggttaggatcagcaaagtgggatgggaggacccaatgcccacagttacaggtgcccctgcccttcctagttcaccccaagccagggcagacttgcaataggttcaaagatgtccctgggctaaagtgtaatgttggccttagcctgggattctcaaagacttggacactctgtatccaaaaggctgagggcttgcatgcctgtggggactctctgtggccaagcgttctgattgttctctgctgggaggatgccactgctagtaattttagaaagcagtgttctgacaacaaagtgtaacttttcagaatgtagacccaggaatctgttagaagatgtgaaggtccaaggccattttgccctgtgtttccataactgtcccctggtgtaagtcattctaaaatctcttcagccagcatgacatgtgctgtggcacagttgtttccatccttgagcccctgaatgggaatgtgttgatatgtgacagtggacttggggtttgtcatcctggccagcatgtgtgggctagtaagtgtccccagagatgtgccatcccctcccctgcccagagtcggacagatgcagctcagcaatgaaactcagggagtctgagataacacacggcactcagccaacaaccttctatgtaaaaagggccaaggcccaagctagcctggaactctcaatcctcctgcctcagcctcctcggtgctgggactacagaccttcccgcatcagccaccttttacacaatccgttggtgctgcagtggcagcttctgtggaacacaagcccgcagaggagcagggtcacaattacagtgcaggcctgactgcagctccctgatatgcagtacattacaacaccccatacccacaccacatattaccatcccacatacaccatgaactgtccactataacacatatcacaccacataccacatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatggtgtatgtgggatggtaatatgtggtgtggggtgttgtgatatactgtgtatcaggaagctgtgtattatactatacaacacatccttaacacagatcgcatgtgtgaaacactaacacacagcacccacaaatatgcatatacagacacaaacacacacacacacacgtgtgtgtgacttccttccaactctgaaaaatgcccccagggagccagctagactcccatagtcaatggtctaacatgggcaaacccagctaccctccagccctggggcagatggtgaaggatgatagatattgagttcagagttccaaaccctttacccatatgtcctctggaagccggcatgaaaagacccagttctgtatcctgaagtctcttatgtgcacctgcagttgttagttttggacccactgtgagaacatgatcacttcacttgctgctgtctgtgtgatcactgggcctcctcttttcctcccctagctgaggcacaagtgaacaatgcaggggcaccccacgctgccctcaaggggagacctggttacatccttacagtaactgactcttaggtaaaagacaccctgggcttctgtagctcattgttctaacatcaaagggtttgtttgtttgttttcccctactttcccagatgatcattgcagagtgattttgagccaagtggatggaatcccctgctctgactacattaatgcttcctacatcgatgtaagttgactggtttcctttcccctggcttagcattcaggggctgagtctaaaccatgccgtttaggtgcccgccactctgatcctgagcacttgtggtcacactgagagcatgaggccattgtgccttcccagcttgcatctgcaccagaagtcacaaagataacaaatccatcgcagctaatgaccccagtggaggtgtttggtcttgatccttacagcgctgacaaattaaaccccaccgatgcatttgactaaaaataaaccacagtgggcctcggaatttagttatctttgagatatcatttaaagttttaaatgtattaaaatacaaagaaataaaggggtttgtacacatgagcccatttaaaaacatcgatcagcatgttgtctgctgtgtgtatgaaaacaaaaacacggtagtaaaggccgcaggaaaggaactctgttacctttgagattgctaggggggggtttgttgttgttgtttttgttttcgtgtcctttttctgttttctacactctctcgggtggatcattcctgctcttctataaacacagttgtcccctagtcaaggatagtcctggataattatgggtttgacttcacttttctagggctacaaagaaaagaacaaattcatagcagctcaaggtaagcgttcgattttgttcatgtctgcatggtatttttatcgtgatctgaatatctaatcgattttgttcatgtctgcatggtatttttatcgtgatttgaatatctaattgccaacaatacacagcttcccatgtgtgtgcaccactgtgtcgctgtgttagacactcgcactgtgtgcccctctggggtccacagcacgcacacacaaggggcctctgcttaccccgagactctcattcaatagagaactgacttctctcagtagcctgagctctgaaaggctcctgctttgggtggaggacagaatggaggggctgtgagataaaggtcctaaccaatgtggctcagctacaagatcctgtccttacccttccacccagtcccaacccttctagccggcccaaggctgtccttttgggaaggtggcgcaattccccagggaccagtgaagctgaagcacgactctccttcctgcttctcctaggccagatttcctagacgtagaaacacttgttacacatcggggaactcgccccctgtaaatgagagaaaagccggtcagacattggtggaaacatcactaaggcctgtatttctctcatcagcaccagcttgtcaaggatttctttgtctcccgtcctcttctcttcagccaagaagttttagccttaggatcgaaaaatagctgttataccccctaggcactgtgtcatatttagacaggaagtgaacagagggcaagggagattcttcgtcacgtgacttggagggagtcaagcatatggtggcctccagccactatgaatgcagaggagacattgctctcaaccatcttcctgtggtccccttttcttttgcccgtgaatcggcctagccgcccaaactctgcctggctgcgcagaaagcttccaggctgcagggcctgtcatgcgcctgaggaaggtgtgatccttccaaggctcaattcacggacaaagtttagacggctccttcatcctctgcacacaggccctaagcaggagacagtgaatgacttctggagaatggtctgggagcaaaggtcagccaccatcgtcatgttgacgaacctgaaggagaggaaggaggtaagctccctgcactgaccctgcagtctttccttctggcccccacactcaccagagaggcctgaccactccctctgactggacagttctcagctaacagtggggggcaaacagcactcaggccttccagaatcctatgctgagtttccacacctcactgtcctgctccaacattaaggaatcagaggtccccttctttgtctgaggatcatcatggccacccgtggctccaaccccactggagaggaacagactttagagtgacaggtaccagtgtgttctgtgtgggacaggtctggctggcctatcaggctgagcaggtctttcctagactagagagatggcctccagcaggaggctcgtggaagatgtgaatgagtggctgaatctgaagcatcagctggggttgagaggttcactggcctggtctcctaacaaggcagactctggtagcatctgcagagcctgagtctccatccccattgccagaagctggcccagatgcaggctggaagggagagcaacagtgccctgggagacttgaagcctggcagacttgttcgcgtggaactcgttttccaagaaaaaggggaattggaagcctgagggaagctttctcaggtggagaaacccagctggtagactgtgcttctagcgtattctactatgaaagtccagcttggcagaaggtacctgcctgttgggtccccagccagggcatctccctatagatggcactagtctggtcctaacggtaccccatgtgctgaggacatagccagagcctacaggatttgggtggaacagccattagtggggtacgcaggagaacaaggacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgttttgtttttgagacaacaggggacagtatggggactgcttcttcttacttactgcatgatgtctaccctgttgtcctttgtcacctatgctcagagtgacaggagcaaaactacggtggacctgcccaccagagccatcctgccctgtgaggagggaaccctggcttctgtagacagggaggctgaccctcacaagagctcgtgggtctctgtgatcaactgctcacagagtccagatctcccaggagttgcttagccctaaaaagaggcagagaagccctaaggacttctgtccccctgtgtcctggtggtgtcatccacattaatctctcttagagcctcctgctatatttttctgaccctgtgacttagggttgcctgttggtgctcttcatttccactacctcagatggagtcatttctcaagagagttccttttccttggtggcttgcgttgtggtctccatgatgtccacatcctgggcagagcattgcaaaacccagctggcatcttatgaactgagagtgggacagccaagagttctctggagcctgagaccccttttctatctttgtaagagtcgttcagggaggaattgcttgagagtcatcagagcccccagaggaaccatgacttacccaaaccagaccctttgagtgtcactacaggccacaccctgatgccctgtgactgtaggtcgtcttaggccagaatacaggaaggggttgtaacaaggatgctggtctccatggtgacaggcaccttttactttaagagcgtattgatcctggagaactggccaggttgctgtgcctttcaccggtcatttcttggacaggctttgaggtgcccgcaaggcttgttaaattttagagatttctccaaggaagactgtgcggcttttgtccctctggtggcggcgggtgatcaccattcattcatagactgtgctgatggacagcttgctgcctgttaagcactggggcttcaggaaacgcagggtgcctgcggcttgtcttctgtaaagagctgcctgggtggcctggatctccccaggggtccccatgttagtgtgccatacagagtgagtggtctgatcagaaggagaacagagagctggagcccaggggaatgcctagggaaggcattctgaaagtgtggaggcagggttcacttgagccagatggtcgttagggtcaggctccctaactctaaagtggcttcagcatgcacggtcatggctgacgtaataggatgtgagagatgaaggggtgagcgaatgagatataactatatgctccccccaaagccactctggttggtccacagccacatttgccacctcggaggcttctcttccccctttataaaagacacactcatgcagagtcatgcttccagctcatgatacacagactgctgacacaggttatttgaccttatgccacatcccgaactgtgtcttgactattctccttcaattgctcgtcacaggagaagtgctaccagtactggccagaccagggctgttggacctacggcaacatccgggtgtgtgtagaggactgcgtggtcctggtggattacacgatccgaaagttctgcatccatccggtacacatgaatgtcttatttggcttctcgggagcgaggttggcaggggtgggggtgggggtggggctttacagtgagaacagctgccccaccttgacccactcatagcatggcaggaactctcacagaggctgtggttgcagggctggatcctgtgacagactggggacagggttagtggatcaaggacccgaatctgcagagggctggatgctttgactcccagccactgtcctgggcctccccagaaggtgggtgagccagctggagtggtagaggattcaatgggggttgggggctttcccactgcaccaagcaggcactgcgccactgagctactcctagtgacaagctctcactatgtgatccatggaggtctggaacttcctgtgtagaacatgctggctgctgactttcatagatccacctgcctctgcctcccaagtgttgggatgaaagacatgagtcgccatgtctggtgacagaattgttttataatggtgtcaaaaattaggttcagactctcccccagtatctttcatgctcatttcgaggcagccttcgatcaaaatgctcgagaacaaagcagaggaaatgaagaccacagagacaggctgtttttattaggaataaaatgtagagcggttggtaaaattaagttgcaaaaatctgaaagaagtgtctagaagccaccgcagaaggttttgaaaggatggactgaggggcctagcctaatggtagaatatgtgcctgaggcatcccaaaattgttatcccttgcttccatacagagaatacacacacacacacacacacacacacacacacacacacacacacaccttacttctaaacacactggtattgtcatcttccaccatcaggagcaggagaaccatgcatgctgcaaaggcttggagaatctgggagggagggtctggaggtctccagtgtgtaggctgacccttcattcttccttcccacgctgactctttgagacttaaatatgctggcagtgactcaggtcgccacaagtcaggtgggactgtgtagatggagcaggcaggtctgcctcacagctggagtgtgtgagcattaagaccagctttggggatatgtggctactgggatcctggcctggtatagccagctgcaaaagccctttgccagccaagagctgtgtattgtcacatcgggtatggtacccctgcattccagggttctctgtgtttgcagccgctgacctggcatgagccccactgtccttcggaaggagatgctaaacagttccacctcccatctctcacttccccctcatcccttacagcaactcccagacagctgcaaagccccgcggctggtctcacagctgcacttcaccagctggcctgacttcggggtgccgtttacccccatcgggatgctcaagttcctgaagaaagtgaagacactcaacccctcacatgctgggcccattgtggttcactgtaggtatgtcagggaggggccagccacagtgtggggaatggccagtgcggcagtggtggggtgggcagagctagggctggggggaatgaagttttgaagcagctatacccaaagttgcgtgtggagaaaggaattctagcccctcttggtctctggggtacctgccccagtggtgtctggacagacccccaatatgtaaaactcttgaaggctgacaaggcccaggttgatggctggcatgggagctctgggcaagtccactgaccttgccctctgctctacctggtacctcaaggatcgtttagttcccatagcaggggacacacacacacacacacacacacacacaccccttcagtgtctctagtcctgagataaataaccagagcagcagtgccctctagtggctatgcatagatttgctccttgttcttccaagttgcaccctccttaattttgccctaggctgtgtcctttgtcccccaggttcaggcatcttcccaggcttgccatttacttcaggggaatgtgactcacgaggtggcatctttctcctccctgaagcgcgggcgtgggtcggactggcaccttcattgtgatcgatgccatgatggacatgatacactcggagcagaaggttgacgnnnnnnnnnnnnnnnnnnnntgacgtctttgagtttgtgtctagaatccgcaatcagcgccctcagatggtccagacggatgtgagtggcacctctttctgccctggcctaagcatcacagagcactcaggtgccttcgcaccactccacaggcccatttaaaaatattttttgactgtgtgttgttgttgttgttgttttgcacctggtctgtcatgcggatagattctaccactgagctgtaatctcagccacccctttacttcctggaactcagtcttagtgagtagcccagcctgcttttgacctggctctgtagcttgggcagcccttgaacatatcctctttatgtctcagctttccaaataactggaattttgaactattgccaccaggccccgcttgcaggtctgggttttgctgttattggttttatttatttatttatttatatctcaaatgcttcatcccatccctcctcacagagtctctcctctcattccccctccccttcacctctgggccctcccaggtccgccctgctagaatcccacccacccacaaccctggtgcatcaagtctctgcaggattaggcacatcctctcctgctggtcagatgggttttaataggcaggtggccacaggctatgagcatgcccattgtcagacctggtatacctcccactctgtcattacctcccatggagtcacaaaggctggtgaccctgatccttagcatgttcatatgccatggtggtgattctaagcagctgacatagcccctggagccctcggaggtagtggtcattactgtcatcttattttaccctagacgaccagtccacatgatcactcttgctcctcggccttgctttaccagcgatggggcagtcttgagtggcaccccctgtctccctacaggttcagtatacattcatctaccaagccttactggaatactacctctatggggacacagagctggatgtgtcctccctggagaggcacctgcagacgctccatagcacagccacccattttgacaagatcgggctggaggaagagttcagggtgagtgctgcaaagcaacttccacaccctgaggggctgagagggcctggggagccaaggaaaatggtgccaacttaaatgacgcctcctgagctcagaaagtttggtgggtatcaggttgttagctcttagggaagctacatgtaggatcacttcatcttccaatatcaaggcgacttctggaggcaaacttgggagcaggtctcctgctgcaggtctgtctgtcatgtttggctctaactacattccttggctgcagaagctgaccaacgtgcgaatcatgaaggagaacatgaggacgggcaacctgcctgccaacatgaagaaggcccgcgtcatccagatcattccatgtaaggcagtgggcatgtgggcctcatgccctggaccacctaccttcgtacatcatgctagggggcaagcgcctctgggtgacttggagctgtgtccgaagctaggaagaaaggactctcctgggggcactctgagggatctccatggacccatagggtctcaagtggtacctagaatatagctcaaacgcaagacaccagagcttctgtatagggagggttccctgggacctgaaaagcttgcctcagatgagacctgggacctcactagcgctctctggagaccccttctcccttacacagtgggaagtgagttgcatggccaagaatatatacataaaaagaactaaatcagaccaaaggtgaattctgctgagcccttggagtgtggggtgaggggtggggtggggagaacttgccttggaaatttcataacacttagcctgaggtagagtcaattctagtcttccattgaggaccaggataactgaggcaaagacccatagtcagcaggaacccacatctgcccctgctagcaaggcatgaagaggtatctaggcaaacacagctgtcgaagcctgtgggatgctcaggcttgaagagagggcagttcatgtctcacactgctttttcatgccctccgtggagccgaggcttagtaactgcccaccaagtcgacagcccacctcttctccggaagcagagagttctaggcggctgggcaattcagccccagtctccattacttggttctctgtgacctcagtgtctcctttggcagctgcaggtcttatctggttaccctatccttgttcttaaatgcagtatgtttagtgcttatatttggggatacattattactgatgattggataacgaaaaagataattagattgttttcagagcatccccgaaccacattatgaagctatttgataacggaggcttccctaagagatggctttattaatattcttggtctgtgacttaattccttttcctgttgctgtgataaaataccttgcccaaaagaaaaaagaaaagaaaagaaagaaagagtgagagagagagagtgagaaagaaagaaagaaagaaagagagagagagagagagagagagagagagagagaaaggaaggaaggaagaaagaaagaaaggaagaaagcaagcaagctagcctggctcggggttcaagggaacagtccactgtggtggggaagtcagggcagggaagcttgaagcccctgggtcacatcatgtccacagtcaggaagctgagagcagtgaatgcaagcgtgcggccactcagctcactttctctgttctacacagtccaggattccctggccagagaatggccctgccctcaattaagatgggtcttcacatcaattaacttaaccaggatagtcccccccacccccgtttatccagaggcccatctccttgtgagtctagatcttgtcaagttcacaattaacgtggaccatcacagtctataaggcatgctcatatctacactaacaaagaaaatcctgctttgcagatgacttcaatcgggtcatcctgtccatgaaaagagggcaagagttcacagactatatcaacgcatccttcatagatgtatgtaccgcagtcctgtgtgtgtgtgctcattgcaacatgtgactccttcctgtgtaaatatgtgcccttgagtgtgagcgttgctttccacccaataaggagcactggcatgccatttttcttggcagaattactttgcttttaaaataataaatagtgagccaagtgtggtggtatacacctgtaattccagctgttgggaattaggagtctaaagctagcctcagctacatagggactttgaagccggcctgtactacatgagaccttgcttcaaaaaagtcacaataagggaaagatgacttatcaactaagagcacttgctgctcttgcagaggacctaggtttaattctcagcacccacatagtggttcaaaactactggaactccattgtcaagggaaccaaagctctcttttcatctccacagacacaaggcatatacatggtatacatacatgaatgcatacatacatacatataaacatacatgcaggcaaacactcatgcacattaaattaaaaagcaataaaacctttaaaaggacaaaaaaaatcaacaaatactgagctttggaaatgaggcctagccttgctgctgaataattgtctgtttccacatgacaatggaaagctcctctacatttgcatattgtgacaccacagttttatgtgaagagcacgtgttggctcttgagtgatgtctgtgacttgaacccatatagactgggcaattatctgtctggcacacagctggatccagtctccatgcacggtggagttggcagagaaagagacaagagagaactttgtgaccatatggctattagcacttctgtctgcactggagtgaactaatggacgtgttgagaccagaggtccctgctctagcttcacactcagcaccactgagataggaatctagctggggcacagagcccatgagaatcaaggccactgtgtgctgtgctggtaaccttgggcctctaatagctcttagagatgacttcagctactgaggtgggatgtgtagagaagcaccctgataaaaaggcagttcctgcttggtgggtacatccgtgggctgtggcatgcacctgtgacagcaggcctctgttaaggccatctaggatatgcacctgtgtcaggccatctaggacatgcacctgtgacagcaggcctctgttcaggccatctaggacatgcacctgtgacagcaggcctctgttaaggccatctaggacatgcacctgtgacagcaggcctctgttcaggccatctagggcatgcgcctgtgtcagcaggcctctgttcaggctatggaacattggattgctgacatcagcctagggctttcctgagtgcctgtggagatggaggctctggtgacaagtagccctcccctaacctctgcttctctcaagggctacaggcagaaggactacttcatggccacacaggggcctctggctcacacagttgaggacttctggaggatggtatgggagtggaagtctcacacaatcgtcatgctgacggaggtgcaggagcgggaacaggtgaacaggctggggcaggggctctctgtgtgctgggtgtataagaggcaggtagctaatggtgtggtgcctcagcagtgtggaaacctgagaacacatggatgaggccaagccaggaggcctgaggaagaagagaaggaggagggaggttggaatgattcagatcttactccatctttgcttcagataggtggaagggttgttgtctgtccctaaatcgtctttgacttggctatctttactctgcctcaatgttctaccattttttaaatgtcaaggtcacagcctgtgaatgcaacggactgttgcttactgttagcaagatgtaaaggcaggcattgatctatgcccctggttcctgtcctaatgaatgaattcgaagacttacacatttccattttttcccagagatccacccatggcctagtaacatcacaaactcaggaaagtgggagtcaccggtacacagcatctctttaagtgctaacctaaggcatggccacaaccctgaatctttgttttggtttctttgctttaaaaaacaaaactttattgagctgcttttttaatcacccaaaaggcatccttaaatccttaggatttaatgtgttcatagtgctgggcaaatgtgtcttctgtctaactccaaatcatggtcaccacctcaaaacgaaattctgttccattagcagtccccacatcccctcccagccccagacagccactcaccagctccctgactctgactagatttttctggacactggagtaaatgtagttgcacagcgtgtgttgtttcaggagtgaatccccatttaccatcatgtcctcaaggctcaccggtttgtagtgtaaacttggagttttttcttttccttaaccacccatttgtagtgtaaacttggaattttttcttttccttaacaacttagcgtatgtcaacaatatatcttggtcataaccccccccccatcatctctccctcttccctcaggtacctcggaacgcgtccccctctcctctcctttcctttttccttgtaacccactgagtcctgactagtggcgctgcctgtgagaatgttgactggttttcttagcttgctcttgagtgggtctagagccagttctgtggctgcagtgagttcctcgactgcagtggccacaccatgtcgggaaggccctcctccccatcttctgcctcttctatttctgccccagctttcctgagccttcgtgaggctgggacggggctagaggttgatagagatgtcccatttagggctgagcactggttgcagactttgttatttttgttgttgttgttgttgttgttgttgttcacattattccatcgtgtgaatggttgtgcaatttgcacttcccagtccaccggctgatggacacttgtgctgtttccgctctgctgctgtggacatctctttttgtgcaggaataacttctgagttcctccactacatacctacaagtgaaatcactttcttatgatcactactccataatataaactctaaatcacaaactttgatggttcgataatttaaagattttttaaattatgcacttgcagggagggggtgcacaggggtgcagctgcacacgaagaccagaagaaagaaccaggtcccctagagctggagctataggcaactgacaattgcctgatatgggtgctgagaaccaaattctggtcctcggaagaaaagcagtgcctgctcttagcctctgcttccccacctctattacagtcccagtttcagcgttcaggggctctggcttctccacattcttgacaacactgctgttctgtcctcttgactaaagctctacgagtggatgatggcatttgttttgttggggggaggcattaaatcagctgaacgtggtacaggaacctataacctcagcccttgggacgaggcagcaggagagttaggggatttctctcaacctcctctaagaggaaagctcaaggccaggttataaaaccccagagggggcacctttaagtcatatgtatttgtggctggagaaatggctcagaggttaggagtgcgagtgctcctctagaggaccggggttcaatttccagcacccacatggcagcttacaactgtctgtatcttcagttccaggggatccatggcacaaggcgtgcagatggtacacacacacacacacacacacacacacacacacagaggcaaaatacccatacacataaaataaataaatctgaaaacaatcatatattcatgcctaaagaaacagttaccttattttacttgtgttgcaactttatataaagatttccattgtatacaatcttctgggatgtcgtctttctaaacagaatagtggatttgttgtttttctaagcttatgtccgttactgtgactcagccccctttccactgtattcctctccacagaacacacatcctgcatccacttcttcagtcctttttccacccttgaccgtggtgccaattccatcctgtcgtgtgataagcgctgatgacaggcttctggctgccaggggttagcaggtgccaagcagacaaactgtcagattgcagagtttgtccaagagtgaggattcctggttgctgtccaaagtagtttttaaagtgaatatcagcaatgaataagacatattcatcggtctgcccgatgctttcggagtgtctggagttccccaggcaccctgatgcttcctaagagggtgttaatttagctttctgtggccttgattggcatttatcacattcctacaaggtgaaacatcacaatacatacccatggatgtcttctttctcgtataaaaggctttcccttgctctttacctattgcctttctcactgctgtgataaaataccacacaagagcagcttagggaaggaagggtttatttggcttgtgatttgagagtaagtctgttgtggcagccagagcacagggcatctggtcacatggcatcaacagtcaagaagcagacagctgggcacatgtgatttgtttcctcctgtttattcactccaggactccagcccaaggaatggtatcaccaggtagtcaaagtatgtttctctgtcagttgaatctctctggaaaccctgagaacagtctaggtgtgtccctgaagcgattctaaatcccaccaatgtgtcaatcaagattaaccaacaagcaacaaagcgcctgtttttctactgagcactttgtttccttcttgttgctttaagagttctttacatatggtggatactcatcctgggctgttttcatatggctagcatcttactgtagtcagcaggctccattttactctttggatgaagctattgatgaagcaaagaaatatcattgcagtctgatatttctgtcctttgcctcagggacaccccagtcttttatgccttcttttttttttttttagtaagactcaaaaaatgttcttcaaagtaaaagaatattcaaagacaagattgcaatatagggtagtgagattgttcactggcctgattctaggagaggctgaggcatttatgtcaaccttgcatagtgattctgagatttgatgccatcttccagttccatccattgactaaatcctcctttctctcatggatcaacgtttcaaatatcagggtcttcccaggcctcttctctgctcaatggtcagcagatataggatttatatccacgttcacataagattttctgggcatgtgaaatcgccctacatcaactctttaccctaagtggcaacaaccagacattttccctttttcctcctaggataaatgctaccagtattggccaacggagggctcggtgactcatggagatataactatagagataaagagcgacaccctgtctgaagcaatcagcgtacgagactttctggttaccttcaaacaggtaccatcactgggatcccccaaactctagtgaacccgcagaagcgtcccttggaatgtacttacttatataccaaggtgggccctgaacttgtcaccacccatccaagtcccagggaaccctgagagagaggccactggagcatctggcggtaggcatcctatgaattctggcttctgtggccatatgcctcctgctggagcatgagattgatagcaaagaggtaatttcctggctcttgcaatcactggggagagtgatcttagctgggggtggagaaacaatagatctgaaggaaggtagagaggcctcctggaccccttccagaacctctcactgtcccggtccatactgggccttgacctctgaccacacaacatctgtgccttctggctcagtaagagatacaagcgctcataagcttgaccaattctgagctgaagatagtcatttcaggaagctgctacttgttccctccgggccagcagtggattgcctgaaccactgggcttacctatagcccctgatgggaactaagagcttaacttcccaagcaacgtgagtcttagctgtgaataaagccaccaagagtcctaaaagggctgagccagaatgaatgggggtccagaaggaagcagagtcactggccaggcccctggactgtctaggaggggcttcaagacccagaaggacccatgggcaaggcaagcagattcctggcaggatgtgggcagtctttggagtctcgtctttcatctgcagcccctggcccgccaggaagagcaggtccgcatggtgagacaattccatttccatggctggcctgaggttggcatccccgctgaaggcaaaggcatgattgacctgattgcagcagtgcagaagcagcagcagcagacgggcaaccaccccatcaccgtgcactgcaggtgagccgcccctcccccacggggccctggcttgggggcacagcaacagagggccagaggtttctggagacccactctacagctagggagagctcaatagcgcctctgggggattgcttacctagactgcgtgtcatcttccctttcacacacacacacacacacacacacacacacagatgggcacaagagtcacttcattacccatgatgcagaatgtacatacattcaaggaggagccagagtagacacaggggacaatatcctgttaaagtcacacaaacctcccaggcaaagctcctaaacatcggcttagctgtgttcactgtgaagggcagctctgacgctggctgcccctccccacattgcccaccctctctcctggctttggaaacattcaatgcagaacaaccaaaacacaggatggaatataaggacctcacaaaaaccggtctagcctggaatctctgtgtgtgtgattatgagattacataaatgtaacccacaaaggtcagaggtcaggctcatgtgtcactcctcaggtgtaagccattcactgggttctgtctttgtggatggagctgtgctgggtggccagggagctccagggatcctcctggtctccactgttctgtccctgggattacgagcactcactaccatgcccggcttttaaaagaagtatctgggacttgaaactcaagtcctcatgcgtgcacagcaagtgctgtaccgactgagccttctttccagaccccagtctgaaatctctaaagtaaacccgatccaacactcatgtacccagtcagcctcaagggtggacacgttcctggtgtccctggagacggcaacaaccaggctcatggcaagaagcatgtggagaaagagtgaatgtatggcagatgtacagtttccctccatccctggatctgcaggtcctgccctacatgatgttacctgcctcggcagtcctgttcacacttgccaagccctggcgagcagcagtttagaatgcttttattcttgggtgaatctcactagctgccggagctgtggctgtttcatttcctgaacatttgactcccaccttggaacaccctttatttttattcactatcctatcccttgtgtctaaggggcctctgtttaacaagagagatggacactctccctgtgtggatagcccacctagtgtagtccatgcctggccagtaggtggcgctcacaccttggttttcagtcccagaagcctttcccgaggtccctgagaatgaactagaaaaaagttgagcaggcttgttgttctgcaaagcagaagatgagttctgcaagcctggggcaccaggtggcagtcatggggatgaacaacaacaataggtcctcaacttcagagtagaaccattcgtagagattccgagagatccaaggacagctgtgtccctccagaggatactagaaaaggctggtctcgtgtctcctttagcctctcccagccctcttctgtgaggctgagatcaagccaagtgccatcttcaggagaatccactattcctagcagagagcatcttactatactatccccaactgtagccttgatgtgtcaatatcccaaaatccaggctttggcactggccagggtctcttctccctatacctaaaagaaaagcttgcatatctgatgcattgtaggtactgctgagctgatggtcagtcagggaatcatactattcatagccactatgtcaaagcacctaagttgtccccatccgtttctaatatccgtaggaaaggaagcagctttctgcttgctggatcttgctgcattatgtatataagtgatcttataagctacagtcaagggggttgggagatggctcagtcaacatagtattttgctgtatgatcgtctttatccacataaaaagccaggtgcagtaatgcaggtctgtaatctttggtgcaagttaggcacagacaaactagtccctgggggcctggtaaccaaccagcctagccaagacagtgagctctaggtgcagtgaaagagcctatcaaaaaggaaaatgcaaagcaataaggaaaggcaacatacatagacctctggcctctacatgcactcagacacacgtacatgtacaggcatacgaacatacacagcaccacgcacaaagatgcaggcagacatgggtgcctttcagttctcccccggggttggggagtaaatgcccaggtctcctcctccctgtgtgtgtcttgcttgctttgccttcactaagcatcttccctccacagcgcgggagcagggcggacaggtacattcatagcactcagtaacattttggaacgagtgaaagccgagggactcctagacgtgtttcaagctgtgaagagcttaagacttcagagaccacacatggtgcagaccctggtaagaatctgatcagcctgatgttccagaagagtcaagaattgtttcatgtgtttgatgtctgtttcatgaaaaggagcgcctggtgtaaggggaggctgggagggttcttgtcccagagtacctgacccagctgcaggcattcacaataaagccctcccctggtcttaaggggagtcttcccagcaagactcaagagggggggctcgtgcacagattgtatttccatttaaaaacggggtgacagagttcaaaagcagccctgaagttcaaagcccggatgcttgttactttccgtgttccgccatagcacttgcttggcctgtttgcctttggaaggtctccctcaacctcaaggctccttcaagggtcttgtctggggggtgggggtgggtctcctaacatccaatagctctacattttctctttcattagtcagagcacacttcctggttagagagagagagtctgcactgaattccaaaacgtttcatgttggaggggcaagggcagtcttaaaggctgagttcatcatttcccagagcctcctaatgaggacctctctcccacctgctgtctctacacactcttgacaggtggcctgacgcatgtgcaaggacaggtgggctgtggctgtgactatggaaagacttcacgggaacctaagacctttagtcttgtaaatcctaatggtgtctatattaatatggaagcatgtgattttcatctgattaacagttataaattaggcagtgtgagctttattcttcagtattagaaccctggtagtttccttttctccacttcagaaatagtttccattcaggtgtggtggtacatgcctataatcccaatacttgggaggtagaggcaggaagatcaagagtttgaggtcatcctaggctacagtaggaagtcaggctaggatgagcaacaaacatctctctctctctctctctctctctctctccctctcacacacacacacacacacacacacacacacactaatgggcccaatggcatgtatttgtgatccttcacctgggaaatagagacaggcttcctggagctcacaagcagccagcctaacctacttggcaatttctgggccaagtgagagatgctgtctccaaaaatcaagcagacagtgcctgaggaagggcacctgaggttaccctctgtcctccacatgcaagctaacacatgtgtacctgcacacatacacacaaaaaaaaaatattttccaatgtcaatatgaaaagcagagttgttttccaaagaccatactgaaaacacactagtgtgaacctaaaaattgatgttttctgcatggacaaacagcttggtttagaacatggctcatgcctaaaaggcccgctgtgtaacagaaactgatgtgtgggagggagccccggactttgatgcatcagcagactgactgacaactgggcttctagctcatcttctgattacatgcatcaggtatgtgtgaagctgcttagtattaatatattactaatatactctcattctcttttcaggagcaatatgaattctgctacaaagtggtacaagattttatcgatatattttctgattatgctaatttcaaatgaagattcctgccttaaaatattttttaatttaatggtcagtatattttgtaaaaaaaaaaaaagagatcatgttaatttatttcctagtggatattaatatccttcctaattcctttgtatatattttgttatgttctaaaggctacctgctgtaaggttattaaattgtaaatgccctttttaaaaattggaataacatgttaaggtcaaatactatctggaaagatatatatttctgctaacaccagtcagtatcttagttctattagattcatgttatgtggtgtcccacatcaggtgtcacatggtgtcacacatcatgcatctgtaaatgtagttcttaacatgtcaaatgtgtttgtgagaagacactaacccctgaaaccccctgtggagaaaccagtagaggactccgagtcagagcacatttactctccccaccaactgtcgcacccagggcatcggaatgtggcaaacagtgtgcatgggggctttggtagagtcctgggtctcagccatgtggtccatccttgcatttgaaagatcagagtggaagcagacacggcagtgcatcactgcactgctagcacgtgggaggctggggcataaggatttggtccaggtcaggccaggccagcttgggctacagtgagactctgtaacacaacaaacaacaaacacccagagggttttgaaacccaaatccaggtctcagatgtacaaggtgtagatggtggtgactttcctatgagttttaaaaggcattcatgagaggctgtgtagtgccactgtaggcttgataaagagatgtgttataccaggccatctattctcacaggcctccagtaccctccaaactagccatctgagctgtgttcctggaaccacttgctgcctgcctgtgtgcctggctcagaatccactcaagctcattcccaacggcccgcccactgacacagctgcctgtactgaccctaattgggcctacaggctcaaccacagctgcacacacacacacacacacacacacacacggtagaatggccacaaactgttgcactgtcaatttgctgatactcaaccacagctgcacacacacacacacacacacacacacacacacacacacacacacacacacacacggtagaatggccacaaactgttgcactgtcaatttgctgatagccatttcaggatgtcagattttctttgtaaaaagttaagatggtttgtaagaaaggaattcttaaaaatctagatttgtacagtttttttcttaaatgtcccacctcttggtgtttaatttttaaaaatgagagggggggaagatcctaatctaacttacctttggaggaaaggctgctgagacctctgagttcaggtggcagtgacaggcgcactgcctgagagggtaggttaggaggagggagaggaggaggaggaatgtagaaacattgacttcaataaaaattatcttcctatggcatttagatacctagcaaatgagcacaatgtaaaaaaaaaaaaaaaaagacatctggtctaactcattgaaggctttgaacacagtttgggaactttttttttaaactttttaaaagagaaatgaaaatacaaaggccttatctccatggaggactgatcatgctcgcctattgcacagtttgttcttgttcgtgtacaagggacaaccccagggtctgtcactgcttcatacaggtgaacgggtcaccacgcttatctcaagccccgcagctctgagtgtcccatccagaggcacaagctggcactcagcatgcaggatgaaagcagacagtggccactgtcaccaccaccaccagctgcaggcagggctggctgcctgtgctttgtgggagctccccttctctgagcagccttggagcacaggcagaagatggaagatggaggagctttccctggccagtggtctcatttgtctccatcttagacccaagctcaacgccttgctgtaactgaagcgggacagagggcagtaagcccactagaattaaggtgacctcacatgggtcccaagccaaagttcggccacgcaccttggcaccccaacttagttactggtccttagaatcccaggcatctcttgtatcaagaaatgccttagggtagatcttttcaggatgtctagaaaagtattctaatgagtgtttttcctcaccttggggctgccccaggttctcctgcaggcagagaccctgcctgtttctaaacagcttgtctcattccagagaaaaacagaagccacgctcctgtgggcacagttggggcagcacttgtactttggaggggccaatccctctagtctcttgactaatgccatagcaaaattcagcctccgtaagacacagagcctctgtgtacaaggggtctcctagggggaggagggcggtctcagcatcttctctgtgtacctggcatgtccttttcttcttccttcaaagaagctccggtgtttatgacaccgacaaccttcttagttctctgttgcatgcggttgtgctcaacgccaaacagtcatcagagctgagcgttctgatcaggtgcgtctcttggtcactgtgtgacttgctttactctctctccatgggctggatgaacgaggaatgcacacctgtgttttccaaggtagttttatgtgtttttaaaacctttttaaatgagcctgatacctgtgtttcagcatttggccacgttgttggtttttgtttttcatgtatatttactgatatatttttgtttgtaaccaagtcatgtttaatttatgtgcaatctttataatatgtgtatgtgttatggttccaactctcatatattattccttgatcacatttatcgtttgatcttgctctgattatgccagtgtatgtcgctgaattcttgagacatgtgaactgcaagattgaaaacatccggattcgagaataaatctctgactaccagcctgtacctgtgcttctgtcttcccatttaagtgtgtgtgtgtgtgtgtgtgtgtgtgtgtgtgcacagaaaacatgtggaggccataggacaatggtgagtgtcagctttaggaatactgcccaccctctttaagaaagggattttcactggtcccgcagctgaccaactgggcaaggctggccagccagtgagcaccagagattttcttatctgaactccccagtgctaggattacagaagtgtgacactattcccattttctttatgaggatttgggagactgaacttggtcctcatgctcacaagccaaacactttaccaaacaaactattccagtcccactggaggtctttaaaatgtaggtctgagccgggcggtggtggcgcacgcctttaatcccagcacttgggaggcagaggcaggcggatttctgagttcaaggccagcctggtctacaaagtgaggttcaagacagccagggctaaacagagaaaacctgtctcggggaaaaacaaaaacaaaaaacaataaataaataaataaaataaaatgtaggtctgacttggcccagaaacagcttctaaggggaggtgagcgctggagccaaagaggcattaggtcttaatggtctatggtaggcaggtatcatacaagaggcacagactttgactaccagttcaaagagttcatgttctgtcagggtccagggaggaccaagcctggaaagctgagaaattagctgtgatgaagagcccggaatgactgaggtggaatctttgtctgagtcctggcctggaagttccctgttcaggacatcatataaaatctagtgctgagacttcggtgctccaaatcttccttctaccttctcagtggagaaagccctcatgacccagcttgactccaagcactggccaaaggctacaggagctgcaagcagtattctattctgttcatcttaactaccctgagatggagcactgagaacatcattctatagaccagaaaactgcctgttaaagatttgccccaagtcacattgcaatcatcaggcaagctgagattacatgctattaaactaaatcagtttagtcaaggggatgaaaattgcatttaggatgctgtagtggctattcccagctgtcaacttgactatatttggaatgaactacaatccagaattggaaggctcaccagtgaccctaatctggaggctgggagatggaagtttctgatctggatcttggtatggagatcttgaggcatagtggctatggattccagaagattaagacagggagatctctgagttcaaggtcatctgggattaaaggtgtggtgggacagacctttaatctgggctacaccttctgctggagaccatataaggacattggaagaagggagtctggctcttgctccttcgcctgcttgccgtgtgggactgagtaactgctagatctttggacttccattcacagcttctactgaaccattgttgggaattggactactataaatcatcaataaattcctttactatatagagactattcctaagttctgtgactctagagaaccctgactaatacagatgccgattctcactaggtgcctagatgctgctgacaactaaggacctgccgttcctaacccgggacagtggctgcagtggagaggccaggaagcttcttggagctaagttcatcattccaatgaatacaattgatgaagtgcggggctgggtcaagttccaggcagggaaaacagtagctgtttatgagaagggcaggagcaaatgacaacaaaacaggaagagtcacagatctgggaggcaaaaagtacagcactcctttcttgggaatctcccatcatgctttctgctgggaaactgacattgctagggaccatagctaaacacttgaggaatgggtggatatttgttacaatcaaccaacaagtgggtctttctcagatgtgcacacagagataaatagaggatgtgttctaagaatgtcttggcaatggtatcaccctcaaatgagcgttttaggttacatggtggctgcatgtgtgtgcatatatacataccaagtgcacacatcagcccacacaagcagacatgtatgtaggctgatttgggacatctttctactggatcctctttggctagggtggctggctagcaagcctcgggcactcatatacctgactccatatcccaatgctggggttgcagacctatgtcaccaggcccagctcagacataggttctgctaatctgctcttgccttcttgcctgcatagcagctgcttcagagccgtcacatctgtcctaagtgagaaaatgtgctaacatggctcagacagaatttcctataactgagcaggcctttcccttatcacccagttccattcaatcagcatgcagttgactacaatttcccacatacatgtgatatttctaattctacatcagagcaattcatagtcaaggttcctgttacttcaaagactttgactttaggatttaagtcaattaagggcactttcatgcctcacaccctctaacaggtaaaaagggcgctcttttcctgtgccttctgctctacacaatctcctttgccagttccactgttacccaccctatgaagcttttgcccccttattaataaccagttgccattccttgattacagaattcctgaggtagatgaaatggcagaactcccagactcacccaaaatgctaaatcccggcctccactcagtgtttctcacctgcgtacccagtgttcttcacctgtatctcagacaggagatggagaagtgaagaggttagggcaatggctgaccagggcacactctaggctctcttccagcaccagcagatatgttactgctggaaaacagaaaggggactagcaggcagagtgaaaagcacaaagttgcatatgcaaatgcgcagtggtttccaacagaaaagagtttagggttaaagtgaaacttggaagataagcatctcataccagacaccaggatggccttgtgctgccaggcaagaggtcagagaaagcccgtgataaaagcagacgctaggacaggagactggagtggagactccagtggggacaggagactccccagcagcaaaggttccacaggcaaggcagccaatccactcaatacagaggcctaatgaaaagcacagacatcaaccgctctttaacatagcgacccgtgcccctgaagggagctcggcagccatccttgtcagatgtttctcccaaaggtcacaggcccagaggattaggctgacttgcgtaagtgactaatggtgtagcctacaaaccaaccactccaccgtacagtcatcctgtgtaaggttggctgatataactgcacaaccaatgtctaatgaatggaggggcaccaccttcccctccttcatgagggcagaggggagcagctgcagttgtcagagaggccaaaggaggcagcgaatttcagagctttattggataggacagagggccacatttctgcctgctcacccctaaactgtaattgcgctgagatccctggtgatcttcctcatgacctccattggcgtctgaagagagtatgaccaggaaagctcaaagcttccttccttaaactcaggcagtagcagtagtatttacagttcatctttacactggaggtgaaaaccacactggaacttatcactaagtcaaatttacttttccttcttaaatgtctttgctacatagtttcacttttctggtaacttcttgttcttaacttcttgttcttaacttcttggtgcatacaatgtcttcatcctgtttgggaaaaaaaaaaccacactcctaaataatatgaaggaacaatttttgtgatcacctcaactcaatgagccccttgtccttactaggtgtcattcaggtctctcatctataaattaacattgaaggtctggaaagatggctcagtgtctaggggcactttctgcacttacagaggacctaagtttaactcccagcatccacatggtggctcacaaccatccagggaaccagatgcccttttctgactgacctccgcaggcaagcacatgatacacacacacacacacacacacacacacacacacacacacacacggcaaaatactcagtatacattaaaaaaaaaaacccacaaaacaaaaacaaagtgtttttcttttttgtttgtttggtttatcaagacagggttcctctgtatagccctggctgtcctggaactcactctgtaggccaggctggcctcgaactcagaaatccacctgcctctgcctcccaagtgctgggattaaaggtgtgcaccaccactgcctggctacaaagtgtttttaaaaagaaaaaaattaaagttggaaatccttttacaatgcttaccataaggttgtttcttcctaaatgtttttttttaacttagtttttaaaactcaaactctgtgctctttcacaagtttctaaagcatacacggtctctatcactgtatgtggttcactaattaaaaaacatcattcacaaaatttgactgtggcctagatgaaaacttaagtatcctaaagccaacttcccacagacaaaggacagtcactgtgtcctgaggtctcctatgtggctgcaaaaggatagtgggtcctctaaggcagtggggagatagaggcaggcccatctacctggaagcggggatccaatctacagaaagcaaaaggtcacaatagcctcttagagcaaatgacccaaagttctggtacctgataaacacaaggcccatccaacaaaaattagaaaaagccgagggtgatgctgggcatactttagacacagttttatgagtgattatggacagttaagaaagggagacggaaaacaggaactcttaagtgtgaggctcagtatggacaagaagatcttggtatgtgaatgctgttgaattctagaaaataacaggtagatggatctactgtacacatgttagaaaggcacacacaccagataagaggcttgcttctccagcatacttgcaggatggaccgccaggaagcacccacccctcccacacacacatatgtagaatctgggcctatggacaacagaacagacaagaaagatatagtcctgggaaaactcgtcagtgtatgacatccgctgggcaccagtgaggagaagagacctgagtgtctatgacacgatgacctggcctgatcaccctcaggccttgcctgttgtgttcaggatcatttgactaaaaaaacctgggttttattccttctatttccttctgataaagtactactttcaaggtgatgaagctgtgcttagagctctgaggaaagataagatacttgttaagcctatgaggctgagttcctggtgtgtcttggtgtctgtaatgaaggcttgccaccatgagatagtttctgcttccggacagccacctccacttcctgggtattgctctcctttcctgagcctcgcttccatggttctcaagccctttgtgggggtcaaacaaccctttcacaggttgtttcatatatcagatatcatgcataccagatatttacattatgattcataacagtagcaacattagtgatcaagtagcaataaaataattttatggttggggatcaccacagaagaactgtattaaagagtcacagcattgggaggttgagagccgccattctgggtgctttagctgcaccttcgcactagacttccatgcctcttgctccatccctcagctatatgggatgtttcatgacctctggaaagcctgggtcttcttgtgctgtgccagtcacatgtaggactgccagctcagcacacctctgcctcgagcggctgtcaatacctttatctcccatcagctgtttcagaatgttcagagtatgttcaggttcaacttgaatgtccagaacaattatgtgtcactcctgcccaccccatctttacctggtcctagactactgcttaatgcaagcacgccactgggaatgatgcaaagcacggacagcacatgggtttacagtctactagcttagtactgtgagcttgggatgctgaaacaacacacttcccactgaggagaatttacctattttcacttatttgcttaggagatagacaatactgggcttattctgcctttttatttattttttttaaatcatatttattccttttaatttttatgttttttgccttcacctatgcatatgcctgcttggtgtttaaggaggtcagaagagaccatcaaatcccctggaactggagttacagatagttgtgagccatgtgagtcctaggaataacaactggctcctttgaaagagtatttggtgctctcaactgctgagccaactcattctgctattttaaaggaaatcttttgaggtcctgacatgcccacctttgttttagttaagtgttgccaacatagagaggctgaaaatgtcatctataaccaagataagccacatcacaaacatcagaaaatggtattagatataaatagctagctcttctggaatgaaaccctcaataggtaaattcactattcaaagtggaattaccaaaacagacacaagaaagtaagtggcccgaatgatggctttcccactagcatagcaggagctgctggcatgtccttatttgcctttgtaacctgggcataaagattagaatgttctgggtctcacacaatataagacagcaagggtccttacctccttcagagtttttgcatctttcttggttccacgagttacccttggcttaggttcactgtccaaagcgactctagtttttctggacctcaaacacctaacatcagactctccagagactcctttctcttcctgaggctttatcaagatttctgcagctggtttgcttgttttctcttctgcttcacaaggctggggcatctcagtcgttcctctagacctcaagcatgttcttttcccactgacttggccccgagatgtagatttcttggctccatcatctggattctg

SEQ ID NO: 1016 - DNA, 2391 bp, Mus musculus
  misc_feature (1)...(2391): n = A,T,C or G
cgggctacggactgcgggctgcgagagaagtcaccggcggcgcaggtacctcactgcctacgcgcgtccccacgaccctccctcgcgccggcggggacagcggacgccccggagcggagcgcgtcgggcgggcgcccgggagatgcggagtcgccgcggcggagcgatcggggctacagcaccggtccctgggagactatagccctcatttccccttggtgcaccatggagcccttctgtccactcctgctggcaagttttagcttgtcgctcgccagagctggccagggcaacgacaccaccccaacagagagcaactggaccagcacaactgcaggccctccggaccctggtgcatcccagccgctgctcacctggctgctgctgcccctgctcctcctcctgttcctgcttgcagcctacttcttcaggttccggaagcagaggaaggccgtggtcagcagcaacgacaagaaaatgcctaacgggatcttagaagagcaagagcagcagagagtgatgctgctgagcagatctccatcaggccccaagaagttcttccccatccccgtggagcacctggaggaggagatccgggtgagatctgcggatgactgcaagcgattccgagaggagttcaattcattgccatctggacacatacaaggaacctttgaactagcaaataaagaagaaaacagagaaaaaaacagataccccaacattctgcccaatgatcattgcagagtgattttgagccaagtggatggaatcccctgctctgactacattaatgcttcctacatcgatggctacaaagaaaagaacaaattcatagcagctcaaggccctaagcaggagacagtgaatgacttctggagaatggtctgggagcaaaggtcagccaccatcgtcatgttgacgaacctgaaggagaggaaggaggagaagtgctaccagtactggccagaccagggctgttggacctacggcaacatccgggtgtgtgtagaggactgcgtggtcctggtggattacacgatccgaaagttctgcatccatccgcaactcccagacagctgcaaagccccgcggctggtctcacagctgcacttcaccagctggcctgacttcggggtgccgtttacccccatcgggatgctcaagttcctgaagaaagtgaagacactcaacccctcacatgctgggcccattgtggttcactgtagcgcgggcgtgggtcggactggcaccttcattgtgatcgatgccatgatggacatgatacactcggagcagaaggntgacgtctttgagtttgtgtctagaatccgcaatcagcgccctcagatggtccagacggatgttcagtatacattcatctaccaagccttactggaatactacctctatggggacacagagctggatgtgtcctccctggagaggcacctgcagacgctccatagcacagccacccattttgacaagatcgggctggaggaagagttcaggaagctgaccaacgtgcgaatcatgaaggagaacatgaggacgggcaacctgcctgccaacatgaagaaggcccgcgtcatccagatcattccatatgacttcaatcgggtcatcctgtccatgaaaagagggcaagagttcacagactatatcaacgcatccttcatagatggctacaggcagaaggactacttcatggccacacaggggcctctggctcacacagttgaggacttctggaggatggtatgggagtggaagtctcacacaatcgtcatgctgacggaggtgcaggagcgggaacaggataaatgctaccagtattggccaacggagggctcggtgactcatggagatataactatagagataaagagcgacaccctgtctgaagcaatcagcgtacgagactttctggttaccttcaaacagcccctggcccgccaggaagagcaggtccgcatggtgagacaattccatttccatggctggcctgaggttggcatccccgctgaaggcaaaggcatgattgacctgattgcagcagtgcagaagcagcagcagcagacgggcaaccaccccatcaccgtgcactgcagcgcgggagcagggcggacaggtacattcatagcactcagtaacattttggaacgagtgaaagccgagggactcctagacgtgtttcaagctgtgaagagcttaagacttcagagaccacacatggtgcagaccctggagcaatatgaattctgctacaaagtggtacaagattttatcgatatattttctgattatgctaatttcaaatgaagattcctgccttaaaatattttttaatttaatggtcagtatattttgtaaaaaaaaaaaaagaga

SEQ ID NO: 1017 - protein, 774 aa, Mus musculus
  VARIANT (1)...(774): Xaa = Any Amino Acid
RATDCGLREKSPAAQVPHCLRASPRPSLAPAGTADAPERSASGGRPGDAESPRRSDRGYSTGPWETIALISPWCTMEPFCPLLLASFSLSLARAGQGNDTTPTESNWTSTTAGPPDPGASQPLLTWLLLPLLLLLFLLAAYFFRFRKQRKAVVSSNDKKMPNGILEEQEQQRVMLLSRSPSGPKKFFPIPVEHLEEEIRVRSADDCKRFREEFNSLPSGHIQGTFELANKEENREKNRYPNILPNDHCRVILSQVDGIPCSDYINASYIDGYKEKNKFIAAQGPKQETVNDFWRMVWEQRSATIVMLTNLKERKEEKCYQYWPDQGCWTYGNIRVCVEDCVVLVDYTIRKFCIHPQLPDSCKAPRLVSQLHFTSWPDFGVPFTPIGMLKFLKKVKTLNPSHAGPIVVHCSAGVGRTGTFIVIDAMMDMIHSEQKXDVFEFVSRIRNQRPQMVQTDVQYTFIYQALLEYYLYGDTELDVSSLERHLQTLHSTATHFDKIGLEEEFRKLTNVRIMKENMRTGNLPANMKKARVIQIIPYDFNRVILSMKRGQEFTDYINASFIDGYRQKDYFMATQGPLAHTVEDFWRMVWEWKSHTIVMLTEVQEREQDKCYQYWPTEGSVTHGDITIEIKSDTLSEAISVRDFLVTFKQPLARQEEQVRMVRQFHFHGWPEVGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 1018 - DNA, 46846 bp, Homo sapiens
  misc_feature (1)...(46846): n = A,T,C or G
ttatgagaaacgatggtgcggaccactcatagggtgccagagtcagtgccaggcctgggagggtaggggatgagggaggaaaagccacaccttccctggggagtttataacctagggtgcaaggcggaaggcatgagggtcccttttagaatccagatgaggggtgtgaggtgagcggagcctctggggctgcggagccctcccagtgcccggagcaccctcgggaggccgtgccagccctcaggaggaagcgcatggaccctgcgctgggctcagggcaagtgattggtgcttctgggaacttaaagagttggaagcccggtcgttgccttcgaggggcttccccagaaacccgggagccaaggcagtcatgctgaggcctgttcactcatggcagagcgaggtttgcgctttgaggcatccagggcccctctgggtccacaagagaggagtccagtgggcttcttggaggtgggggcctttgagattgtcctcgaggagtgggaacattttggtgatgagggggctgtgtggccagcgggggaggagcaggaacaaagtgcgacgttgggagagtgggtggggtccaaaggtggcagcgaggccaccagtgtcccttggaatttgggctgatgagccaggggtgggtcctgagcagcaacaaagccacttagctgggcctggggctgtgggtctctttctgggtgaggaaggtcaacctgtcaggtacaaaggacacagtaagaggccggtggtggctgggcactcggcctctgacaggtggaatcgggacctggaggctctgaaaggtggggtcacagtgcgccagggccacaggcctctgcccagccccagggccaggccgcctccctgtgcctgagctcctgcccaagcccaaggggccctaagagctgagctacgccgagtcagcctcccgcgctgtcctaggaccctgcagtggacaccggccccttcacccttctccagcttcttagcaggagagccaggcagccaggccgtgtgggggtctggggaactcacccctgtcatgcctgccccagggatcttggacaagtcacctcacccactcctcagtcccggattctttctctgagtcaacagcaacaactaaagtcgcttctctgttacctcgtggggccttttcaggatgatggatccactttacaaactatagtttggggttctggtgtccaggaagaagggcttatggagggagactcttttgcaaactgtgaagtgaggtcaggggttagggtctttctgcttctcctgcaggccctccggacccgggcgcctcccagccgctgctggcctggctgctactgccgctgctgctcctcctcctcgtgctccttctcgccgcctacttcttcaggtaggagtgtcccggggcactgacttgccccaaccagctcagaggaggaaatgagccttctgatgctgtgggcgtgggctgtgcagcagagggcagctgagaggctgggtggctgggcctgggagacacacagaggccaggccttagcgtggctcagccatgagcaacaggagtagcttttcccggctcacctggtgggtatcactgtgccgagcgctgttggctctcggggaacctagaagtgtggaaacctaacgcatcctgtgtctctaaggttcaggaagcagaggaaagctgtggtcagcaccagcgacaagaagatgcccaacggaatcttggaggagcaaggtacagaagctgctctctggctggggcttgggggaaaatgtgttcttttttagcagacactgaggtgctttctgcctttaacgttcaaagtaaattttgaggtgtgccttgccactttcatctcacttctacctggtatgatgctgtcatttagaatttcactatttcaaaactttaaggatcatttttctctcgggtgtgacatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgatcttaaagaggatagattttcagcaggattgctaactggtcctggctatgcctgttgcgtgctggccctggcacatcagttaatttccttgaagctgtcttccaccacctaggaaggggcaatggagatgggcctgtcttaattaccttgaagttggaatgggaggctcagacaatggattttgtaaacaacagtgttgtgcagttgttatatctgaagatggcatgaattctgctgcagaaatgagactttacccagaagcaacgtgtgaaggcatgggaaggtggtggcccatgtaaactgtacattgcttgttttttggtgcaagcctcctctgcctttatcttacttcctttttattgtttccaaatgtgtccccttttttggagaaattaggtcatattgaaagacagcttgaagcactattgtgttgcaatctctcagcctgacaacagaccttaattctcattttcaaaataactatccaagttttcagctagcagatcccctcccccacccttctcatcccatttccccttgcacttttgtttccccaagtgacaggggctgggcttgctgatgggggtgtctgagtcagaaccagctcaaaagagggggccactcccagggagggagtccaggaatagggtggggcaggtgagacactcaccccaggcacataatttaagacagcaccaaaagctcagcagtgggataaattatattttaacataacacttaaaatatcaaaattatcagcaccacaggaaaggtaacaaatacaatatcaaaatgaatacaggcagtccctggtgaagaaaataacacgaccataaaggaagacaggcttgggccgactgattttccctgttgccctgggccctgatacatacggcttgtcaccacacagctactcatcctgccattagttaaaagtttcatattttggtcatcatagattttgtgccttgatttggacttttaaaaatattgcattcgaatattatttcccctggtttctgaattttgggggcaccccattaaattttgcacccagaggaagttcctcattctcttctgccactgggtggcccttggctgaacattggagtccttgtgctcagtgacaggcagggtagagacgcggtggaggggaagaacactggacccaaagtcaggatcacggagcctgatcctgtgtctggggaaccctgggggagctgcttttttgtcatatttttgttttatttgtttgtttgagatggggtctcgctgtgtctcccaggctggagtgcaggggcctgatcacagttcactgaagactcaacctcccagctcaagtgatcctcccacctcagcctcccaagtagctgggactacaggcatgtgccaccatgcccactggcttttttactttttttgtagagatggggtcccactgtgatgtccaggctgtgcttttctgctcatctgtccagtgaagggctggccatgtcctgagtccacgttgatgcagcacccgtcctctgagagcactggagcctgccatggccagctctctcttgggtcctcagagggacatgctcccaaccccatctttcttttctcttgccgtctgatctgagctcctctccccaaaatcatgaaagggagacaccagagtctcaaagtggccgatccagttgagttttgacatgtgtgcattgccaattcaaagtgcaggcaaacttggtggggatgaaaaggatttgatattggggtcagtacagtgaatgctggagtcggcctgagtgtttgtcccggctcagagagcttgggcaattaacctctgcctgtttcctcatctatgaaatgaggatactccctgccccccataggattgtgataacatggacatgaggttggataacctggacatgcaactgaatccttacgagaccgcactctgcaatctccaccctgcactggtagaacaccatcctaggaaagtctgcttccaggccccagagtaagtcctggaaagtgagcaccactgggccaaggaaaatcccccgcttcagacaggctcgtccctacctccatcctagcaagttatgtcaagccaagtgcctaggactaacacactgatacgtgctgtaaaagtgcagagggaggtgtcaaccgcaaagcttccagcacaacaaacaaaccagaaccattccctggagctccatagagcagctggggcctcttgcagaactgcccacacctagcttcttgtacactctcctgctgcctgcccgacactaccgagcggagagagaaaggaacgtggctcatgagttcattgaaatgaaatctctaggccgggtgtggtggctcatgcctgtactctcagcactttgagaggccaaggtgggcagatcatttgagcccagtagttccagaccagcctgtccaacatggtgaaaccccatctctaccaaaaaactacaaaaattagctaggcgtggtggtgtgcacctgtaatcccagctactcaggaggctgaggtgggagaatcacttgaacccgggaggcagaggttgcagtgagtcgagatcgcgccactgcccctccaagcctaggtaacagagtgagaccctgtctcaaaaataaaaatgttaaaaaaggaaagaaatgaaatgaaatctcacctcaaacagacaaaccacaaacaatttggacaatttacataatgggacagccaatcacacgatatttattggccagttactatgagcaagccccaagcaagacactgcagggctcatccaggtgtgcagacccctccaggtgctctcctttcccctgggccacctgagcagctcagagatttgagaccccagtagactgacagccagagaaagggctgcagagtcccatgtgggtggttattctgtgcacttggatccaggatacatacgtgtgcggtgcacagggcccgatgcccctccccacttcaactttgaccctctgtgcatctgggtggctacgccccatctccatggtctggatctctgcagctgccaggaacacgcaaccgtggggtgtcagagcttggtccatcctcgccatccaatccctccaggggagccttctcaatttcttttaatttatttatttatttatttattttttgagagagagtctcgctctgtcccccaggctggagtgcagtggtgaaatcttggctcacggcaacctccgcctcccaggttcaagcgattttactgcctcagcctcccaagtagctgagattacaggcgcccaccaccatgcccagctaatttttgtatttttagtagagacggggtttcaccatgttggccaggctggtcttgaactcctgacctcaggtgatccacccgcctcgacttccaaagtgctgggattacaggtgtgagtcaccacacctggcctaatttatcttttaacagactttattttagagcagttttagctatacagaataattgcacagaaagtacagagttcccatatgcccccttcctcccctgtgagcagtttctcctattattaacttcctgcatttgtgtgtttcaactgctgcaattgatgaaccaacactgctctgttgttactagcagaagtccacacgtcagggtttgtgtgttgcgcattctgtgggttttgacgaatgcacagtatcatgtacccaccatccggtatcatgcctcccgtgtattttcagtgctggggccaaaaaaagcttttgcgggtagaaaaagagaaggctctagaattttaccacagatgtcaggcttagattaggtcaagaaggtcagtattaagatagccctgatgaagaatcaggaactacaggcggcgtaggtgctggtggctggggatgaggccaagaaccacctatcacccttgccacagtgccgccagacaggtccctccacataggccaccctcttgcctctgctttgggaccaacaaaccccatggcctggaagggcctcaacctgtggccatggggtttggtggccccaaagcagaggaaagagggcggcctacggtgccccaccatgagctccagctggtcagatctgagtctgcaattggagaagcttcctgccctcaggagaggaagactcgggacacctgtgggtggcaggtcaggctgtgctctgcattgtgagcaagcccaggcctgcacggcttggatccaaagctacgcagtgaggcctgctctgctctcctgggtagttgcagcgggacccctcacattctcctacatttgaagaagtgaacatcctcctggtagtctgggtgccgctccaggctcctgccccttgcttgctgggtgaccctggacaaatctataacacctcgctttggctttcagtttcctcacccataaaacggggaccatcctagtatcacctaatgataggtgagttgcaaaggctggggcagatgacccagctccttccaccgtacctggcgcactgagacactcagtgcatattcatgcatgttactggaatcccagtggccccgggtccagccgctggtcgggtgtaatgtcaaaggacaggactcagggcttcaagaggctcttcacactgtgcattgtggggagctcacctgagcagcgagcagacgcaggagacagctggagatgaccaggaatcagagatggcggctgcaggcggcagaaagaactagaatgcaggccaccagagttcacgctcggttatgctgctcagaggggataggggccccgcggcattccttgcacacctgacttccctgactgggacaaaggagttggttagcgtggtgcttcccaaagacgtatgcactgaagccctggggatcatggtaatgttcgtgctgattctgtgggtctggggtgtggacagagcatctgcatttctaacaagcaccctcccgggagtgcccaagccactggtccacagagcacacctggagtcttaagcaagatcaggactgtatctaaggctgtttcccgccccttgcctcccaggaccgctctattcatccttcagccccaaagtcacagcatcccgctgtaaaccctccgcatgcctgtcctcgctcccccatctcccggttcacagttctgtcgtagtcagttcttaccaaatcataggcacctgctctaggccagggtccatgggccctgagataccatggaaatgcaaaggcaagtctccgccttcatgcagcataggatctggctgatgagatcatcactttggccacaccactgttcaccccacatgaaagagcaccctggggaaagccagggtctgtgtctccttcattctctgccccatgcctggtgcaaggtctgaggcagagacggactatggacagcaggtagtttgctccacgtgttttcattaattcctgtgctcagtagggaaactgacatgagcatggtgcttgaatccatcacatttcatactaacgctacattttcttccagtcattgccatctggacacatacaaggaacttttgaactggcaaataaagaagaaaacagagaaaaaaacagatatcccaacatccttcccagtaagattttattttatgttttgcatgatcaatggtgtttgcactaaactcagctttgccttgcagctccccgtgactgcaggccattcctggtgctcagaggccccaaatcagtctaactgctcagcatttgcacctaggactccagaacgttcctctttaggtgcccatctccctgcacaggccctgggtaccttggttgctcgtgggtctggctgccaagcctgtgcttactgttgggacctgggctgcctggggcccagcgggtaagggtgctgcttcgtggccatgggtgccagctggcagggcccctcctgtggaactcaggcctggcacccagtctaggcctgccagtggccctgggcagctcccttccctcagactcagtgcttgtgaccacaagctgcaaatccctagagttgtctggggtcctggaccaatgacaaaaataatagaatacgaaatttgtaggtgggcagcagctttgtaggaaggctctgaatcgacctgatttaaccccagcagtacaagtgggcatgggctggggagcgtgggtgccaggaggtggcagggccagagagcagacggatgtgtgcgggggtgcgtctcggtgacctgctccagctggatgggtcgtgacctgggggcagctttcacagcctgtcttggtgccaagacaaaccctgtaggttctgaaccgcctttgtaagacctggcccgggccgggtgctgtggctcatgtctgtaatcccagcactctgggaggccgaggcaggtggatcacctgaagtcaggagttcaagaccagcctggccaagatggtgaaaccccgtctctactaaaaatacaaaatattagccgggcatggtggtggacgcctgtaattccagctacgtgggagactgaggcaggagaatctcttgaacctgggagacagaggttgccatgagccgagatcgcgccattgcactccagcctggggaacaagagcgaaactccatctcaaaaaaaaaaaaagatctggcccagcagcaggggggcggggcgtgcagttggggatccttcacctgggcccctcccatcatctgctttgcccatcaggctaacaaaatggcatcctcaaagggctccactaagttcaggtttaaatcccgaacctgcagcctccgcctggtccacaaagggagtccatcccaccctgccagggccttggtgggatggaggaaggcagcccatgtgggccccggaatgctgctccctgctgcatttttaggactagaattgagttcatctgctctgtatgtcagagcagctatgatctgtccgatctgtggtctgtccaaactgtgcactttttagaaataattctgtcccattttacatgcgtgggattgatatgtggttttcacaaaacccactgtgaacccatgatccaatgaaaactgggagaaattcatcaaatagtctttcattcaacacatatgtgtaggggtggccaaggcaacaccaggaagatgggtcaggaggtcatgtggtggccacacagctgagccttgacagtggctcagacatggctagatgctgcacactttggagaggatttgttgccaatgggtagaagatatcacagaaagaggggaggcaacttacatggcttgagcagctcaaaggaaaggaaggccgtggcaggaggaggtctgagatctttggaataatgtgtgtcaaatttgggatatttagaaattagtttcactgcttaatttattaccttaattgagtggttttaagttgtgccttgatttgccaaccatatgtgttaagaaaccgctcagtgctaagcacattcctgaattcctcatttctctcaatcactaaaccttcatcccttaaaggtaacatcacattgttaattaagactatttagctgggacctctgtggaagcagaatcatggccaagtgtgggcattacctacacccagtccccttctcaaagtgtgatggcccagggcagagcagtggcctcacctgggagtcccccacctggaagaggccgggcccacccactgcaagtcttctctgagccacgttctcaagtcttctctgagccgcgttctccaggttgtgctgctggagtcagttggcatttcctccaagcctgaaagtgtagtcagattcagaatgggcttttctagattcccctgtaagatctttcccctgctcctggcaggagcaccacaccatgggaaccccagggcccacgcagctgcccgggactgggggaccaggacatggcacttctcacatgggtggaaagatgggtttacagaatggtggcatggagacgctgtggcctggcaaggatcaatggggtggcatctggcattagccatcaggaagacttaaggctgaagggacattgggcagggagctctcagggctgctccacccgcccccagggtgacagcccatagtatcacttagggtgggactgagagtcacctgggggagaggagagaaggggcccaacttccccagcccctagtatcacttagggtgggactgagagtcacctgggggagaggagagaagggacccaacttccccagcccctggcaccttccctgcctttcccagtcttttaccagagtcataagatggtccttggctctgggcaggcatgtggccctggggagctctggggtcagaggtcaaggtgctttgcatgtcaggcaggcttgacttttgcctgtagaaagactatagaaagatggcaagctaggcctcttttctggaaaagtgccaacagctgataattttaggaaataatgttttgaatgtgaagtgtgactttttagaataaaaagacaggaagctcttagaaactgcaagattctaaatctaagcagaaggctatattttaccctgtgcttttctatagctgtcctcaaagcgtaaaccattccaaattattttcaactagtgttatatgtgttcagcagagctatttctgcctgggcattgccagtccctgagcaggagggtctcacagtgaggtctgcaggactgtaagtttggggtctgactccctggccaccctgtgtgggctgtgactgtctctcagagctatacccgccctttctctgctggcagcccgacagagctggctcaaccatcggaggtcgcaggccaccagcccgtggcccacctggcagccttccaggtgaaggtgagacaaacaaggcatgacctgggggccgcccggctccccatcacaaacgccacaaacaccacaaacacaacccaccctgatcagagactaagcagagaaagcagggagaggacctagagttactcagtaatgactcaggaaggagaccctaagcttctaccacatgccagactctgtgcccagtgcagcataaacgtcctcagaaccagcctggtcccagcctggccgagccggacgttcctgggaaaggttacaggaggagcagggccaggcccacagcacttttagaagcccatgaaaatgtcttcatttctcttcaaatcacaaacaaaacgtgcaaaacccattctggagtgcatcttttcactggcgaccaacccagtcctaagataaccttcttaatagttctatggaggaagctgcaaaggcagaagtgactacaacccacaaaagtcatgatggagccctgacgtgtgtgtacacacacactacatgcacacacacacacacaacacacacactacacacccaccgcacataacacacacacatacacactccacacacacaccacacactccacacaaacatatcacacacataccacacacatacacaccacacacataccacacactacacacacacacacacactacacatacacaccaaacccacatgcacacattcacacagcatacacactacacacatgcacaccacacatacaccacacacactacacacatgcaccatacacaccacacacacaccacacattacacacatacacaaccacacacaccacacacacaatacacacacaccacactcactacacacacaccccacacacagagcactccacggtcagccttctaccccggaaaactgcttgtgcaacaggctggatctaccagacgctcctcactgtgctcgccttccagctctggggcagactccggtggtgggactgagggtcagagtccccaatcctagacccccacatccacttgtcctcatggggctggtgctcatttccctgggaagcctgggagagtggacccagttctcctgtcctggggctcttttaagtgcacccacacttggcaacactggggctgggcccagtgcagggttcataaaatacagcccttgcactgccaggggcctggcacattctgccattcttgctatgtaatgacccagcagcccccatcctggatgctgaaatcctacccttgtcgtcatgccacagctgagacagtcagtgttcaccaaagcaggtgcattctctctcaggacactagtgttctccatgggaacgctgaggaagaacatctctgccacccccggtgtcgctgtgaagctgcttttgcccttcccaggagctgacactgcagatgaagagacagcactgtgatttctggaagagacagcactgtgattcctggtcctaatatcttggctttgtttgggttttttttccagatgaccattctagggtgattctgagccaactggatggaattccctgttcagactacatcaatgcttcctacatagatgtaagtgggcagaggtttcttgttcccctggcccagctggggcatgagcagtaagcactttcttgtctggtgcccggagtgtaaattgtcacaacctttctgggcagtttggccacaagcacaaagggtacggaactgcccgtactttacacactggcatcagcatctgggaatttgatttcaagagacagagatgatcacagaggatgttcactacagcattatgtatattcctgaccaaatagaacagggagcatgggtagttaaacagattgtggtaaaaccatgtgcagtggactattagaacttgatttgtattaatctttaaaagatcatttaatatcaattataaaattcccattaaaaatacaacataaaataaattgtacatgttcacccaattagaggacagaaatgtctgcatgtctgcttgtgggtgagtctgggaaaggtttggcagaaaaacagactagagaggggacgtatgaagtaggatttgttatttctggaattgctggtgagttttctttccttcttaaccttttcctgtgttttgcaaattttccatggtgaatatgtactgctttcctaacagcaacaccaacaaatcctttcagcaaagataattctgaaaaaatataaatctgatgttattttttctagggttacaaagagaagaataaattcatagcagctcaaggtaagctttttactaatttctcaacgtatttttggtaacgtgaatagctcttatttccttctctgtatgccaacaagaccaaggacttatactggatttgtgtgtgtgtgtttacacctaacagacacgttagatatccattcacacaacggatatgtgtagtcagagaaacacacacttattcccacacctatatggtgtgaacacagggcacgcagtggccccggctgccattccagcttgttaatacttgcatcagataaccttgaatttctctcagctggctgagccctacatggcacccaagtttgggcgaggggttagtggggtgaatagcttttcagatcaaggccataactaagaatatacttcagctgtgaaaacgtgcccttcaccttgcacagggctaccttgtgtgttgagtactgaatccagcatcactccgttccaccagaggttgtcatctgcaggacctggtgtacgtgcggttagatatcagtggagctgaaaccagattcctcagacttcctcactcttaggccaggagtctttagggcaatgagctctgaaagtcagcgtccatcaaaatcacctgggaagttgttacaaatgcagaatctctaagaaaaaaggacacacatgtgcacacgcagaggccatcaggaatgtgcccagctggaaacctcaggaaacctgacgatcctggctgaagcagatgaaagcatgtgtttctctcttgccagcagacacccacagggagctagcccacggcaggacagcagcagggccaggggcttccttatctccccgcccatccccctcagcacgtagcgcttagctcgggactgcaaaatagccgcagctcagacaggaagtggataggggcagaggactttctcctagtgacactttgtctgttgttcacatccccctcccgagggactttagctcatatcgtattggacagcaccatgctgagagtaagattttgacaaagaggaggggattgggaatgcagggtgaggctggccagtctctgcctctcgcaaggctttcaccagctctcccacacttggctgtagacccagccctcatctgaaccctgcttcttacctgtgaacgtcataactcaacctgggcccaattatcttgcccactgaggagttcctagctggagtgggtgagtggcaggacaggcagcccctaccggttccggaacgcttcagggcatgacgtgtgtgtccccaacaagcctgagaagggagtgaacagctgtccaggggccaacggccagggtgccggggctgggaccccaaagggacttcccttcatgccttttgacttcgaaattgtcctctacacacaggtcccaaacaggaaacggttaacgacttctggagaatggtctgggagcaaaagtctgcgaccatcgtcatgttaacaaacttgaaagaaaggaaagaggtgagttccaggcatctggccccggtatcacttcctttcagctgctgctgccgggctggggatgttcttaccacttccttttcctacttccctcccctcctcccactatcactgcagaaaaaaacccaaacacatgcagtggcttacagcattttcttcacgaaacaaatcccctgtgtccccagcatctcactgttatctaatctgtgataacacaatgacacaagagtttcctttttttcccaagtaagagtggcccccggctggccccatggctctgcctgcctgatgagagacatgaatcttagagttttaggatgttgagcgtgtcatgcggcagagctcagactagaaatgaacatgatttcgcgcttattatccagactagagaaatgcttttggaaaacgttggtatattgaagaaatgttgatttgtcatccgaatatatttaattagctgtttctaattcaaaaaaggatgcatgtacgttataagaatttgaatcattgacaaagaagaaaagttgaactgattcgtttcctaatgtaacaagtactcattagcatctgctgtgctgggccagctctgtcccaggtgcaaggagtaggggctcaaattcagggctgagaagtggtggctgtggggagcctgggtgcgggggtggggttgagtgacaggcagggagccatgccataggcagtgagctcactctccagaatgaaagaagaactgggagcctgagggacacttaccacaggtggggcgaagttaggaggctgtgcttctggcgtgttctggcatgaaggcccggttcagtgggagccgtgtgtcctgcccggccctgctcagggcctgctgtgtcctgagctcctcagtcatctgctggcctggccccagcagttcccaggcattgtagcgaggactgtggggaagggctgccatttttagatgggagtaccaggccttggggagctcagctggggcagaagatgggtggcaggagcccacaggaagggcaggctgggaggtgctctggtccccgcagtgccagcttactaattgccacccaaaacacaggaagcagcctccagccaccgtttctggtcaggaataggatggaggctttcattctgctctggggggagctgaaacaggactgtggagggccacccctttgcccttgcaaatcttgcccttgtcatgctttgtcatggggaagagggaagagtgacagagggaagtaggggattcccagcccaggactcttcactctgcctgcgctgtagcggccatggaggaggacacccacgcgagggaaaaggaggctgacccttcatcaggagcctcagggtcccccgtgacccatggcccatagggaccagtcttcctggggttggtgctccaagcatgagaccagcacagaagcagtggggctcaaggacgccctcacttccctctttcagtcattctgctgaaagtgtcactggcattttctctccatcttcccccacaacctcctactggatttttccactcctgtgactcagtgctgggctgctgccgcgtcctcattctcaccaattcagatgaaatcatttctcaatagagttccctttttcttaattgctcacacttctgttgtggtttccttggcttccacatcctgggctctgcattgcaaaacacagctgccctggcatctcatgatcgggtgggagggaggcagagggagggggtataaaaccagccaccaacactgagcccttgagaggctgacacatgttctcagttcctactggagagccttcaaggtgagaagctcaggagggaccccagggctccccatagggccaagactcacccaaaccgggacatgtaggcatttgcaattcccctgggctgcatcagagatggcctgtgacccgcagccccgcagccccgcccggagccaggtgtaaggagggggaagttgtcggtagccgtcataacacaatgatgctgctctctactaaataccagatgctgtttgtttcataagactgttaatcctggaggcttgaccacgagctgtgctgctcaggggccattccctggatatactctctgactactggcaggcttgttccattccagacatgtttctctggcagatgaagtagatcttttcccccttgaggtgggtcctcattcactcgcgaagtgatggaggacaccaccgggcaggtgctgcgggcggtgctgcaaaatgaaagggctcctggaacgtgtattttgggtcattcttgcttcagaggtcgggaaggtaaagaaatgggcctgtctgtagcaatgcaccctcttctgcagactccacggcagcctcgtccctgctagagaaaaatgaagatcgttagaccaatcataggttcatcactcttgaatggcagactggcagtggtgcaaattaactttgtccttagtgaactgagcaggaaaaacacaaattgctgaatccagtgggaaatgtctggggggagcaccgtccttgccctctagcctgagggtcacttggagttaggtgcccagctctgaaggctacaggctcagcataactggttgatggtcagttaataaaatgtatgggattcgtgaatgaatgaagaaatgagacattgttgctgtctacatcagaaagccttggggcatcctagtcatagtttcaaggctgctgttcaccagttacgcagcctcagtttccccattcaagaggtcgacacacgtgaacttgtttctcagctgtgggagctgtgtgactccagctggtgtgtgtgaggccttctgtagttgggtggggggatgtcatgatgcattgcacccacagatctatttgcttctattaaattgttccgtgcaggaaaagtgccatcagtactggcccgaccaaggctgctggacctatggaaacatccgggtgtgcgtggaggactgcgtggttttggtcgactacaccatccggaagttctgcatacagccagtaagcatctctagttgctgcccttccagaaagatcattttcagagagcatcatgcccagagttaacatccttctgcatttatgaagtgctttgctcccagcccggcactgtcgcagccctggctgagagggtgcagtggccaggctgtgataggcagacatgcaagagggccaagacaccagaggccggtgcacaagggtctgcaggcagtgctgggggctcctaattcctagtgactcctctgggcctctccaggaggaagaccagtcattggaggggcctgggggtgaggtcctccctcagtagcacagtgacatttcacacactgactgggaggtggggtttttttctaacactttccgaattctgtctgaaacctcctcgttattttccacacttgggttctgctagttccaccaccccaaaaggtttaagagagagatcagtaaaaatatgtgtatgcaaagcagatgaaatcaagatatagaagaaagtttaaaaccatagagaaaagacagaagaccattttgtcaggatttaaagatagagtcattggcataattaggtcacaaaataagtgtctgaggttccaagaagccacagcaaaaaaggaaaaggatgagctgattattcttatcctatcccctgctggcatctctcccagaaatgtgcacacaggcgcacacaggcactcacatgcacacgcacacacatactcccacacacaggcacacacatgcacacatgcacatacacccacacacaggcatacacatgcacacacacccacacacaggcacacacacgtacacctacccacacacaggcacgcacatgcacatactcccacacacatgcatgcacatgcacacgtacacccacacacaggcacacacatgcacacacacgcacacaaccgtacaatgcatgcacgttcacacacacatgtgcacacacacaccccactcacatgcacacatgcacacattcacacatgtgcacacacatacacccatacacattcacatgcacacacatgcacacatgcacacacattcatgcacatgcatacatgtgcacacacacgcacccacacacgcacagatgcacacatgcacattcacacatgtgcacacacacgcacccacacacgcacagatgcacacatgcacattcacacatgtgcacacacatacatccacacacattcacacacgcacacgtgcacacatgcacacattcacacatgtgcacacatacacacatacacgcacatgggtgcacacgtgtacgcacccacattcacacatgcacacacatgcatacatgtgcacacattcacacgtgcgcacatacacacattcacccacacatacatgcgcacacatgcacacatacacatgcatacatgtgcacacacatgcacacacatctacttccaaatacgctgtgtatcaccttccgtgatctgggcaagggaattaaactcatgggctctgggtccaaaagctgagagaggctctgagggcaggtctgggagactccaaagagcaggccgactgcatcatctgtcctcccaaatgtaagacagctttgcccaaggaaggatgtgctgttggtgattactcagcaccaccggcctgaggtgggactgtccaggcaagatgggccatggccgccctgcttgcacgggggtctgtgagcacacagaccaactttggggatgtgtctggctgcttgggccctgcctgacctgggcatagacggttgctgcgggccctgttctgtggccccaaaagcagcacatgttcagagtcggcaggggtaaggtccaggctgtctggctcaggcaggccctctgtggatgggcccctcccctacgcagccccagcacaggggagcccacggcggcgtcctcagaatgagatgctgggggagcagggggaggattgtttcacccactcttgtctccccgcgtcccccgcagcagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtaggtacgctgtgggggccacggggcgggaccctcaagggcaggccacagtgggatgactcatcctcatgggcaatgccaggggaccaatatcagggtgggcagaggtttgggcagggctgatgtgaacacaaatgtcagtgactgagccaggccccaagaaccctacaggagaatgttcagagagccccctcttcatcccagtcgataaaacccaccaaagccaggaggctccggttgatggtgggaatggagttctgggcaggtctgcttggccgccctcacctctccccgggaatcccaagtcacctctgggaaccaagatggaaatgagagaaagccccctggtttctacaggaagccccccaacaacacacaagtcgttatggaagagcacaccatgctcagatgggcccccacagcagagtcttccagaacacgctgtcctggagaccagggtccgaggaccaggctgcccctcgccagctgccacttcagcctcggtttcctcacctgtgatgggaaggacagcctcggcggagcctgtgactggcatctgggtgggctttgcacaacatgaagaattactcaaatgtacagccaaggccaccccacaaccccctgtccacagagagccccacttgttcctggcagtgattggcctcaccagggtatcactttgattagatactaagtttccatctgttacagacaggttcattctgagtatcacagcactgccagggacaaaagccacctgcacgcagtgatgcaggcgctctgcacctgtcatgcaggtgttcacgagaagccgtccaggaacccccgaagaacgggctttccccaagtctgagcaacactcgcttgctggggccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgtgcatagttgatctgaggtccctctgctcccagggggacagatctaggatgccaatcacacatataagaagaagacactgtttggtaagtgagaaaaattctccacacagcctaatccgaggcttactgcaccagctgttaatgtgcctcttagtagagtgtcggtggctatcagaggaccggcctgagatcactttactgagaccacagctccctctggtggccgcactgtagctttgctcctaattaaccaaaaaaacaaaaagttgcatccagtgacctgggtgcgcaggccccttcggggcctttcatttacttcgggaggagtgtgactcacgacgcagcatctttctctttccccaaagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatgtgagtcatgccttcctcttgccctgatctagcttcccaaagcaaacccgatgccttcgccacacaggtgtgcagggccctggctctgatgggcacgtggcaaccagcctgggcctggcctggcttcgctccccatagccttccctgcccacgcgtgggacctcagggactccctcgtcctcatctttccctcgtatcctcatgtgagatggggcaatcctactcccccaaacggtgcatgtacacagtgcgtggcgtgctcaccaatgtgaggctctgctgctaccgttctccttactcaagggcataaatggtcgttatccgtggccggtactctgactcttgcctcacacctccttgtgttggcaaaaagagaaaaagaagaaagccgccctctttggtctgccaagctccacgtgggccaagactgcagggcagagttgagggtgtgggcacccctggcctctctgcagatgcagtacacgttcatctaccaagccttactcgagtactacctctacggggacacagagctggacgtgtcctccctggagaagcacctgcagaccatgcacggcaccaccacccacttcgacaagatcgggctggaggaggagttcagggtgagtacagctgaccctcctctccatcctggtgtaagcagccaagggcacgaggaaaacaggtgaccatttaaaggaagcctctttcaatcacttgccccttaactgacctcagaaaaagcaggggcaatacctgagccatgatttacaagggaagaaggatcaggtggctttcagagcctcatagcagccctactaggcacacatttgtatttcccaatgctaaggaggcttcctgggttggagagtggtttcctttgagcaggcgtccttgccagcagcactagtcctcggctgagcaatgtgctcaggagtgtcagaggtttaactgtgtcattatatccttctctgctgcagaaattgacaaatgtccggatcatgaaggagaacatgaggacgggcaacttgccggcaaacatgaagaaggccagggtcatccagatcatcccgtgtaaggcacccgtggcgtggcttgggcagggctggggcggggctggtgccggaggctttcatcctggagaagccattgaccgcttacccctgtgcaccagggtcaaaagcagggtgtcctctggcctcaggctaagggctcctgtgtgctgtaccaaatgtcaggtagaaaagacacctgtgaagcaccagctgacccagacagtcctgcatgggtctcaggcaagctgcttgggatatgagcttgcagatgcgggagggcagccgaggctgatttcaggggagggcttcacagaagctggagatttgcggcaggcacgacttgggattccttgtctcattccttgtctccccaagcctgggcagaggcccgcctcccccttacacagaggggcctgagccacccagccgaggccatgcaggtgaactcagctgagaccacctaggaaaaggctgtggccttgaggaggacaagaaatgggcctagggtagagtcaggacactggtctgccacccaggtcatgggagagggaaggaggacctggcaggtgtgggaggagtggaggcaaagctggcaagaagacagggccacatgcagtgggcaggggagtgggaatcgggaggctcaccaagtgggaaaaagagaaacttgagaaacccggccccaaagcagactccacagggatccgaggaactagggagggaggtgggagatgccccgcttgggaggagggtgtgcctcgttatagacttgtcctcgacagagtcacagctcaacaaacaccatctggaaacagctgggagcaggcctgctgcagcagggtctccccgagcactgcaggcgagtagagctccccggggtgctgccatcttcagactctggcccttggttttctggggccccggtgtcctgctggccactctagattgcttgcctggccacattccatttactccttcagcgcaatatttttagtgcttgtattttggtatgtattatatcgattcctgaaaaatgaaaatgataattgggtggttttcagagttttccttcaaaaagaaaaatacccctgagccactttaattatcgtctctcataacgtaaactttccaaagagttggctttacgtagtgattttattaataggatctatattttgcaagcttgtagcaatggattaaagttagcaaggtgggaccctttttgtaataactaaaggaagataatgctttgcagatgacttcaaccgagtgatcctttccatgaaaaggggtcaagaatacacagactacatcaacgcatccttcatagacgtacgtatgctggcctgggttgtgtttatgcagatgtgtttccttcacatgtgaccacagacttgattagcttgttttcacaatgagaaagaattgacatgtttccagaaactcagccatttttgttagcagaattacttgcttaaaaaaaaaagtggcaaggcacgatggctcacacctgtaatcccaacactttgggaagctaaggcgggcagatcacttggggtcaggagtttgaaactagcctggccaatatggcaaaacccgtctctactaaaaatacaaaaattagctgggcgtgatggcaggtgcctgtaatcccagctacttgggaagctgaggcaggagaattgcttgaatccgggaggctgaggttgcagtgagctgagattacaccactgtactccaacctgggcaacagagtgagagcgagaccccctctcaaaaaaaaaaaaaaaaaaaaaaaagtggactttggaaatagaaggacatagactcgctgctaagtaattggctcttttttcattctgcttttaatatatagttatttttcttttacatatctgttacacaccaattatatatccactgcctctgtgctctttctcttgtgtgatttctgcaatgtgtacccacgtggacaatacaattatgtgttcagggcacacagaggctgtcttcatgcacagtggagttcgcagaagaagggcaaaagggggaatggcagccaagtgtgtgttcatattgccatttgcagatgagaaaattgtaccagaatccggtgggctccatgctgatctagctgaaacacacagaaacatgttagaatctaagccaccaggtgctgttcaggtggccacaggcaactaccagttcataatacccatttgttgatgacctcaggggctgacggtggccgttatggtttcagataagcgagcttcttgacctgcttgtcaggtgtgtgcctgagtgctcgtgccaactggggtctggtgcagaccatggaggatgagagagttttcctcattaggccttaggctgtcctaaacttagggagcaggtaatggagccaggatggaaggaagtcagactctaacctctgcgcctccatttgaagggctaccgacagaaggactatttcatcgccacccaggggccactggcacacacggttgaggacttctggaggatgatctgggaatggaaatcccacactatcgtgatgctgacggaggtgcaggagagagagcaggtgaggagtgccgcccagcccggtccctccagggcagcctgtgcacctgaggcactgtccccgttcattacaaatgtcccacctgccatcactgcaaacacatgggtgagaccaagccaggaccactagggaaggagagagattggaaatgaaaaaggtttcatttcaccctttccctttttgggagtgaggtttaaccatagctacccgctgccctttatccttagcctacatgttatttaacctgccctgaaattctgccatttggtattggccaagatcataacctgttgaagaaaaagacatttattgacttttttcaagacatgaagacaacagtaaacccaaggtttaccaacaatgtacatctatctgggttctcccccaagacataactactgctgtgtatttgtgtttttatttctttgctctaaaaaggaacagctttattgtgatataattcacctataattcatgcaattcatctttttaaagggtacaattcagtgaattggagtatattcacagagttgtgcaaccaccaccactatctaatctgtgatcattttcatcaacccaaaaggaaacctcgtaccattaacagtcactccccattccttccttcccctaacccctggcaaccactaatctgcttcctgactatgggtttgtctattctggacattattataaatggaatcatacagtatgtggtcttccgtgattgggttctttcacttagcatcatgctttcaaggttcatctatgttgtagcatgaatcagtaaatcattcttttttactggcaaatagtatttgcttgtgtggatatactacactctgcatatccattcatcagttgatggacatttaggttgtttccactttggagctattataaatagtgctgctttgcttggtgcggttgctcacacctgtaatcccagccctttgggagtccaaggcgggcagatcacctgaggtcaggagttcgcggccagcctggccaacatggcaaaaccccgcttctactaaaaatacaaaaattagctgggcatggtggcgggaacctgcaatcccagctacttgggaggctgaggcagggagaatcgcttgaacctgggaggcagaggttgcattgagctgagatcgcgccattgcactccagcctgggggacagaacaagactctgtctcaaaaaaaaaaaaaaagtttcttgaacattcaggtagtagtttttgtatggacatgctttttcacttcccttgggtatacgcctaggagtgtatatactaggagcggaattgctaggtcacgtcataactctatgtcataaacttactgtttaacatttttgaggacctgccagactgttttcctcagtagctgccccattttacattcctaccagcaatatataaggttctaatttctccacatcctcaccaacattgtcattgtctttttgattaaagccatcctagtggatatgttctttgcttttttaaaacatcttttaaaatcacatctgtttatgcctacgtagactgttgtttagttttacttgtgtttgaactttatagaaagagcatcattacagcatgttgtcttctgagacttgcttcttccactcaaaattgtgcttttgatattctatgttgatgcttatgctgtggttcattcgtcatcattatttcattatattccactgcacaaactatatcctgcattagctcaggtattccttctcctgtcatgggcacttgagttggtttcatttcgttgttttacaaacagtgctacctgtacattctttttttaaaactttaagttctggagacaagtgcagaatgtatagttttgttacataggtatacatgtgcatggtagtttgctgcacctgtcaacccatcatctaggttttaagccctgtatgcattagctatttgtcctaatgctctccctcccctcaccctccaccccccaactggccccagtgtgtgttgttcccctccctgtgtccttgtgttctccctacctgtatattcttgtacatgtcttatgctgcactaggactaagatgtatcaaagagccaaaatgcttcattgaagagtatgtgaaagtttgaatttgcaagataattcctaattgctttccaaagtggacatcaacaatgtataagagatatcattcatctacatacctagtatggtattctcaaggtgtcctaattattgttaattgaaaattaacaaaatattgttcattgtataattattgtataaatactatctttttgtggctctgatttgcatcattctgattccaaggtcaaccccatcacttcatatatttgtggatgacatatttcctcttgtgtcaaatgcctgttcctgcctttcactgatttttctattgtttgtcctttcttattgatttataggagctctttacgtaatcttgatactaattctttattggttttatgtattgcaaacatcttattgcaatctgtggcgtgtcttttcactctgttaatgatgtttgttgatgaagagaagtgaatgttactgtaatccaatgtttcaaattgttgcatcgtgattggttagctgtttgggctcttgtctagtaatccttgtgtacctcaaagtgaaaagatatttcttcttccaagagtttcacagttttgttttttaccttaaaccttactccatctgggtgtatttttattaaggttcaaggccatgacacgtggaagtgcagggtgtacactgcccagttctaggaagagctgggggcactcacatcaaccctggtagggaatgagtcagggatccaatttcattttccccaggtagaaaaccaatttttccagccccacatattgaagaatctctcctttctgccatatgttaaggtttcatatatatatgtgtctgtttctagactctgttctgttccctgggtcaacaagcattaacaggcatttatattcatattcatatgtttttttttttggtcagatgaaatacattaactggtttgagaacaattctgtgttataaactcaaaatcgccagcagcaaattatttattacaagacttaaatttttattttatcccctaaggataaatgctaccagtattggccaaccgagggctcagttactcatggagaaataacgattgagataaagaatgataccctttcagaagccatcagtatacgagactttctggtcactctcaatcaggtattgttgaagtagctctttaaacgcttgtgaatttagtgaaccacgccctccctctgggttctgcttgtcattgaaccagaatgtggccctgcacctgtcctgctccttcacctagtcccattggctatgaatggccaatgggtttcagagacagtggcaggcctcctgtacaattcccatctccctagctgcctacctcccatttatctctcaggagaattacattagccattagctgtaagaggaagaacaaaggggactaatgaagccacaggggcctctctggggccctcctccaggtgccttctcagagccccccactgtccccatttccactgggtccttggttctgctcatcctctctccttggcaaagaatgagaactcggggtcagctgtaggtaggatgactcacttgtacacaggtcttgatgctgagctccaaacagtcagtatcacgtaatgcacctgccactgtctcctccatgccagccacagagccaccctggccaccagactcagatgctgctcatttgagctctgaagggaaatgcagggccctggtttcttgagaaagtgattcccttctctccagcagagctgccaaggatcccgtaggggttgggcagtcctcacagggatccaggggatgtcctctggacggctcgctcccccttgcagaaggaagcacagccagccacctgccttcttctttaggacaagcaggtttcagccttctccttcaggctgcctcggtggggatgttggcagcacagaaggctcagggagggctcccagccttggccaatccctgagagggcagatggggctggggcctgttccccggcaggcaggcgacgctgagaccccctctcctccctgcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcaggtgagcccccagcccgaagccctccaggtggggtggacacaggctgcacccccccagtacccgcagctgtgggcagcagagcctggtcgctgcccctggccatggtattccctagagtctcctctctacctctccttacacacatgcacacacgacttcacttaagtacatacatgtcatcgtatcatacataagatgcatgtgtgtcatcttaacataaatgcagaatgcacttcagagggtggagttgggaaaccactcaaacacacatttccatgtgcttttgaagtcatcaaaaaattgccaggcagggctcggaggaacacactcctggacttcaagttcctgggtgggttttgagagactgccttactgggctgcattggcctacacccgccctctcccatgggctgggattcctggccatatgaggagtcccaactgggattgtagccacgctggtcctgcagcctcagcctggctcccaagtcaggcccaaaggcagagggacaccctgggcaggtgggacatgcttagtccgcaggtgaaggcgtgaaacacagcacgcccaggggcagatacgcaaatctggtcaagcccaccggccacccacttgcctgccttctgtgcctctgtagttctgatcctgctgcacacttctgctggcagggacctcgacacccggcaaggttcttccaagcaggagcttggggtgtttctatccttgggtggtgctaatgtgctcctgaaactgcagttccatggcttgtctcacactggtggcgcccactctttgtgactgcctttcacccccacccactgtcccaccccttatagctggcagagctctctccctgcctggaccccaccggggtgcactcctggcctggccagtaggtggagcacacacctcggtttttggttttcctggtgccttccaagaaatcatttaggataaacttgaaatgagttccatagggcactggagatgcagaggtgaacaagatcccacctgtgagaacgcagatgcggggccgatcattgcggcaggacaggagccttggaataagcccacatgtgagattatggagcacagagggcagccaggcatctccagaagacctgctggaagaggccggtccaccccacctcctccagcccagtacacctgggctctcctacgagggcctgggctctgctcttgtggggtttatcagcaaatgaccatggtaaatggagatgactcaaatcggccttgctgggaagtgtcagttgactgttcctggttgtgaatgtccttaaactgcccctccctttcagcatcacctgtttcagaagacacccctggcacagtaaggagagggtatgccaagattacctccttcctagacctgaactgggagggtttgcatttctggcaagttcccaggtgccaactgtgctgctggtccagggaccacactttgagaaccattgccctacacaaggaagaggggaaatggtgatacttgcttaaaaacttgtcactggtcctgtctcattttataaaatatcggtctcctgtaattagggaggtgttttaggaattttacatttgctaaatcttgctcataagttacactacatacaaatgatcaaaaaaaaattcagtcaaactcagatcattttcagcgattgttgcttcagtgctgatatgcaggggttggctgtcagctctccatttctcatccccaagtgcaagtcggatgatctgcattaagcgctttttctctgcagtgccggagctgggcgaacaggtacattcatagccctcagcaacattttggagcgagtaaaagccgagggacttttagatgtatttcaagctgtgaagagtttacgacttcagagaccacatatggtgcaaaccctggtaagaatctgaataaggatgttaccagaagagtggagaattatttcatgttgtatttgatgtatgtttcattaaaggaccttaagtacatgggggaggtgggaaggtaaaattcccaaggaaaagagccagctgcaatgtttcgcagtaaacctctgcagagccctccttccttgggtctgtgacgtgggtgtcttctgggcaagacccgggaggaggggcctgtccgccagtttcaatgtctgagaccactcggagagacgcactgaggataggagcttttgtgtcaaagtgaactattctacgagagtcctgtgtgcactgaaaaacatactcttatcaagttcaaaagcagcactgaaatttaaaatcctggtccttctcatttcaatgttatactcgtccatgtggcttgttttccctggcggggtctcactcagcctcaagataccgtccacgggctgcaggaatccctaatgtattagtagttttccccgtacattctttcatttcaaggactcctgctttctggttttcagaagcgattcctcctcaccaaatactatggctcgtgctgctaacccagcgagtacaattttaaagcctgttacaatgcatcctttttaccaaagcttcccacttcgcacctgtcctccctgcctgctcactctccacgctgacaatcctggctcacgcagcgccctgtgcatagagaggcaggaaggaggcccttctacgtccccctcacagcaaggcgcagcaggagcgaggacacctgagctgagggcgggtctgtccatccacacccaacgacctacagcaaagaccatctctctaagcagtagcatacagagcttcccctagtctttttagggactcacagctctcattaatctgcctggtctggccaatatattctatcttcgagagcatctgtcatccaggtgtcctcccgtctcagctgtgctcttcctgaccgcagcttgcccctccatgctccctgactgagaagctgccctcagatgttgtgtggctgtcatctgtgctctcttgcctggtaacagcttgacagagcactttgtagcctgacttttagagtaaagggtctagtccaatgcctggcccgtggcgagggctccagagcaagtggtgaatcagcaaacgaatgagggagaagagtcactaaataaccatcaggcgttgggcgcagtgcaaccaggtgccttacagatgtctttctcatttcatcttcaccatctgcttgcccttgtgcctgcttctgttcacaaggagtgttctgcaggtgcctccagttaggacggttgaggggcctgcctgagatcttcaggtattaagtgtcagaatgagattcaaactctatctgattccagaagggaaaggcttaactagtactgtatgctgccagatctaacatttggcagggagattttggcaaaaaaaaacacaggcacaaaaatattattgagtaaagagatgattgctgacctgcaggttgatttagccctgcaggtgagcacagtggcccaagaaccagtttccaattgctgagcactcagggaagacttgcttccagcatcctaggtaggctttggttggaactgacatttcaaaggccacaagtacatctgttctcctggagtctgtggattgaccagaaatgtctgtctgtgacctgaggtgtggcttgtatcatccgagcacactccaaagtacacttcatccatcactggccccaatcacttgtactcgagactacgtgggatggtcagcagttagctgctgtgttagctatgaaaacagagtaattagtgatcgtctccatttccatcccagactgagccagctttgatattcagtcaatgttgctttaagttggaaaagtcaatgttgctttaagctgtttgcctctttaaagagagcctgtatatttattgagaattccttctaagaattcaattccctttccttctgaaggctgggtgatcagctgcgtgtcttagtagccagaagtgaggaccctacaatgtggtcttggctcttccaacaacttcatgcaaattcagaagcaaagtttcaggctcaccttttccttctctggaaaactcagctccttcccatcctggccagaccgggactcaggaagggctaagctagctgtttggcatctttccacccaaaagcatttagatatttgttcactgtgtgctgagaagagcccaagtgcaatgtgttggaaagaagcagggaggtgctgaggacagctcttggcctctccggctttccaagcccctgtcccggccccaaactcacatatcccacccaggggtctgggaggaccagcctatatataaaacaatgtcccttttgtacagtaaatgtaggctttaaaataatctagatatgcattttatttaacttttatagatcgctttatgaaatttatctggcaatgttagtactctgatttttttctctttctctctttttttttttttttttttttttttttgagacagggtctcactctgtcacctaggctggagtgcagtggtgcagtggcacaatcttggctcactgcaatctgcctcctgggctcaaggaatcctcctgtctccgcttcccaagtagctgggactatgggtgtgcaccactatgcccagctaatttttgtatcttttttgatagagatggggtttcaccatgttgcccaggctggtctggaactcctgggctcaagtgatcctcctgcctcagcctctcaaagtgctcttattacagacgttgagccattgcacctggcctggttttttgtttttttttttaaattcaaaaatagttgttttccagtttcaatgtgaaagccacagacatttaactcagcccattaaatacactaagttgaaatgttaatacactaactgacacattctacgtagaaaaacagctttatttggaattctgcatgtgcctaaaaactaaattacgatgtgcataaaggtatatggtattttaatgaatagtcacacttatttatgtcttgtttttgagtatttctcctgattaatcaaatatatttttgggaatatcattttaatgtgtccttgtttgtcttttcaggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttgaagatcaaagaagtctttacaacctgaatccaggtctaaaacacactagagtagctggtgactataaataatatttaaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattgggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacgttattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttgagagttcgaagtcaaagccgaggggcacaggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtttccactgcaggggttctgcctgttcccaaactttttccattccaggaacaaaggagaagccactttccccaggacgcaggactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccaatgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactaccagcctgtgtttttgtctttaaatctcttaatttcattcctctgcaaaaaaaaaaaaaaaaaaaaaaaaaaaatcgcctgctgtgagatggtgtttgctgttgtgggcccttttgttaccagtttctctctatgggtctgtgggtcccaatgttccatcctagacaagcagcatccactctgctgtggatgtggtcttggcccttcccctggggtaagcagacctggatacatgaaggtgcaggcacagctggacacagtggggaggggcagagggatccaaggaaaaggaggtatggaagaggcataaaggaagtcaccaactgggcctccaccaggggccaatgaacccaaatagccctgcctgagcccaacgcctctgaaggagctgaggtctgcaaaagtacgcttgccagaccagcctcaaaggcagctactatcaacagaaatacacagataggacgctgagtgctgagggacctcaggagagacagacaggtagccaggggcaccgattagtgtgtgtgtctgagcaagccactcagaggagcattactgagaccacactgggaactctactctgcagagatgtgcgaggggcctccccacatcttctgcatgaaggagcaggatgctgcagcactgacccacagctctcgcccaccaggtggaaagtttgttccagggctgtcagctccctggcacatgcatgtcccacgtgtgggcctactgttgccaaaatcagaggaacacccagggacagtggcgcacaacatcaaggcatctgctgtggtcaccaagctcccaagcttggcctctaacagcttgcatattgggcgtggcagctgtgtgtcagtcgggagcaatgttcatccctgggggccctcaggccatctgctggtttgctgggagggcagcttcagggcccaagacagccatgccccagccagggctcacattgccacttccacattcagtgcccacagctggtctcccacttggcccagggtctaacagagccaactgcccctcgtctcaaaggacggggcaataccagcaatatagggagacatgtttgttacaaacattcaaaccaaacagaaacacaccaagagcatttagcccttttcctaattcctctccccatctcaatccattggtaactttggagtacatctccaaacagacaacactctgcaatttaaatctgtatagttacagaaacatatacattgtttgcttttatgaacaacagtcaaactcctggtatatcatcaaatccaggactaccattgtcaaaatcactttatgctctgctaagaaagcaaaaatactgccatttattcctgtaagatcccaccaattttgtgataatcctgatgttagggaggttaatatgtgaaagtactgtgtcttagaagtgactaaatctgccacatatgggcagttttgcagatggccctctttggtcaacattctgcctggacatgtcagcacgtacacagcttcctacttctgtttaatggctgcttggcattccacagtataaacataacaaagtctggagagtcacctccacctccccagtgacagacattaacttctttccacatgctgcaattctataattcaactgtataatgaatactcctgcatgtgtgtatgtttgctaacgtgcaaactagttctatgggagaattccctagaagtgaagtttctaggtcaaagggcacattttaaatttaagtagaaaccaccaaattgtcacctccaaaggaccttcccgggcaccaactcaccaatagggcatgatggcgctgtctccctagaagtcactcacccgggacgttgcacacctgagaggcaaaaaaaaaaaaaaaaaaaaaaaatcagacttcatgttaatttgcatgtcccagagttctattgggctgagcatgttttcacaagtgggttgtgtttcatcagtgaagcatcattcatagtttcatccattttcctcattgcaccaactgagttttcctcgttggtttattgtcaatctttttttattattattattttgtttgtttattgtcaatcttttgaaaacacgggtactaaccctttgtctttcctattataactatgccccttctgttcctttatcagagtgtctctgaagcctgtttaatgcactttccaggaagcagcacatgtgatgcctcgacacctgtcacccagcacattgtggcaacatactagtctcatctcaaataagactctgggcttcttccaggaatcagacgaagtttcaagaaacacttcacaggatcaggttcccctccagaattctaggctaaaggagcccgtctgtgccttagaaaccaagacctgtttccctcttgcatatggaccagcagcctttgctataagcactcagcggccccagcggaggctggaccgaggtgtgagcttcacatttggctctgctctggatgctgaggttacatgacagtgccctccttctgaaagtaacacacccccactctgtccatggtaatattatcagccagcaattttgtttccaaataaactgaaaagccccatggatgaaagtgatgtcatcctgatggtgcctgcattgccacctacaggagtgtctgccaatgaccgtgcacctggaggtttgtgtcactgagcggccagcatgtggctgaggtattaggctgccgctcctttcccaaccactgaatcctgtccaaggttgcctagggcatcccgccctcactgataaccctttcctgagcaaaacctccctcaaggatgcaaacagatgccattcagaacagaggccaacaaacgcaacaccagttctttggggcccttgtgtggtgagcactaatgcttgtgattaaagaggatatctgaatgagcatggaaaatcccagtgctttctcagtaatcactattaagatgaaagcataatgagcacattataacaactagcccagaacaactatgatagtaacaatcaacatattcacttcgtttctcttttcttattttcaaaatatgtatttcaggtttataaagtgagccatatacacagatagttctcgttccatgagcacctatgtgctgggccctttatatgggtattatctgcacaatatcccctcaagggctgagaaacagaagcttccggaggatatgaaactagaccaaagttaggttggaggtagcagaagagacagaattccaacccagaacacccctatgctgctgtggcccctctaaattcagccactctgcataccttgccctttgagctgttattaaacaacagtgtggcacgttaaaaatacttgagaaggccaggcacggtggctcacgcctgtaatcccagaactttggaaggcagagctgggcaggtcaggagttcgagaccagactgggaaacacggcaaaaccttgtctctactaaaaatacaaaaattaactgggcatggttgcaagagcttctaatcccagctactctggagactgaggcatgagaattgcttgaacctgggaggcagaggttgcagtgagtggagaccgcaccactgcactccagcctgagaggcagagtgagactgtttccaagagaaaaatcaccgcgtaattgatttaaatgtgcaggtgggtttaatacaactccaaagatgcagaattcctagtttaatataactttcctcagcatgagaatcatgttgatcctcctcctctccagacaccaagtgagctgatactctggagacagagcatgatcgcttggtgtgatggagccacggagttttgtagtgcaagaaaaagggctgcaggtgattgttccagttaaagggaccccagtcccaccccactgtcaggagtctgttttgtgtggttcttgctagaagaggtcagtaataccctctcagtgctgtggtcacttgtcttaggaaagcttacacatgtagccagtatgcattcaaaacgaatcagcacaaaactgccacgtacccatccacctgttaaggaaaaggctcagcactggggaagctctgaggacacataaatatgttggaggacacccactccctgcccccaaggaggtcagcactgcccatgggatatacacatcctctacgtttctattctgttgatagccaatatcttgcattttgtaattataaacagaaccttgatttttaatagttttaccacctatatttgcatctctaaacagcagtttatttttgcctatttttgagcattttataaatgaagttaactttatgtattaaggctcaggttttgaacgtacaaactgtaccacactgattcaaatagacatagttcatgttgtgtttactaatatttcaagtaaaataatgtaattacaggtataatgtttcttcaaatcatgcagctctcagtagagtctatttatagcaaagatgcttcacatttgaaaccaacagtgactggcaaatagaatccaccagaaacctgggcactcaaaatgtaacaggcatgcaatccattgcaagcctggttagggaggggctgtatcgcctagcattactccctaaaaagtggcctcaaaacctcagtgataggcaacaggggcccactttgggcatcttcgcagccgttgtcataaaaagtttacattcagaaactggtctcaccacttcactgctctcgccgcaagcacagagcaccattatctccagcaattcccaagaccctcactcgccctgcaccttacatttctttggctctgtatggcagtcacagctctaaagcttctagttgcagaagttactccagtgggaatactccaagtatgcctcgtcctcgcttgccttggcttctgcataaggttagtaagaagcaaagcatggccaggactccagggaaatgaatggacgaagaccaagaaagccagatggcataaccagatagcaaaaccaagacatcatgggccactttgatgctcaagccaccacccactgtcattaaccgggacagggagggggtggtgtgttttatgaatggacttggtgccttccataattccctcatcctcagaatcatgaaccgagacacatactttgggttctcctttctgggatgagagacgtgcagatctgtgtggtccaagtttgaatactagggccatcctgcctctttagaattctgggacgacctctcttgccagatgctgttcctctgccctaatggaatgtggcgtcacagtgcagggctgaggtcagatccactcttcttagtggacacgaccttcagttttatagagcaagagggtctcatcttagaatacgtctttaagtgactgatttttaatcatttacttatttgtttgtttatttatttattgagatggagtctcgctcagtcgccaggctggagtgcaatggcacgatctcggctcactgcaacctccgcctcccgggttcaagcgattctcctgcctcagcctcctgagtagccgggactacaggcaccagccaccacacccagctaattttcgtatttttagtagagacagggtttcaccatgttggccaggatggtctcgatctcttgacctcatgatccacctgcctcggcctcccaaagtgctgggattacaggcgtgagccaccatgcccggcctaaatgaatgattttaaaccatatcccttttcaagtcacagcagtgcaacgccttaaaatccaaggcccgtttccctcttgctttgattggtgggcacaacccttagttcttaggaacccaggggaacagaggttgggaagagaactgccgtgagaaacccaaattgtttaggtggcatctggggtcagctagacattgacgaggcagctctgtgatgctggctgggcttattcacattcacgtctggggattggctggtagttgggtaaccccaactagcctgggctggggggccggggtagctcagcggtcttccgtatggctgtcgtcttccaacaggctcgtgtgggtgaaggcaggcacagacggtgcacacacatggcccattgcttccccgaccaacctggaatccaaaggaagaggcaggcgagcaaagcgggctgtacagatgagggggcagaggtgcttctgagaggggtattggacggtgctcagggagcctcaggggccacctagcgttgtgttacctccaaagcagtgctttctcggagtaacagagggcgggcccagagccaaatagctggattctgaaacacaaagagctaccacgagactagtttttattacactaaaaattcttcattaagtttttatcattgccaacctaaatctatataaacatataatatattttatgtatatattatttttacttaaatatgtatgtatatatttataacattttatgtacatatttgtgtataaattttcatagataatatttatatatttatatagaacttaggttgccaatgatgaaaacctagtgaataatatttagtatatttatatattttatatagttatgaatatataatatacttaagttatatacattacattaaatatatttaatttatattatacacaatatattagattatatctatagttatcatatttatatataaatacatacgcttatatataaatataggtaacttttcccctaagttgctcctatagttgtttttggctctaggggacatggaagcaagcaggcagatgaggggcccaggaataagtgactcacttcagcacaagctgcatctcccgagccagggtggaaatttaggaatttgctgatacacagtcatgcccctcctccctcccaacatcaaaattgacagtgctgcctggcctgacccgcctccccttgctcatatcagcctggcctggatctgagacccctgcccaagaggggccttggatataattgcacttctccttttccagaccccacacaagaaataagaaaagcctggagtcgtgtccagtcctgactgctcctttcccagagttctaggcctctcgaaggctga

SEQ ID NO: 1019 - DNA, 1689 bp, Homo sapiens
tcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattc

SEQ ID NO: 1020 - protein, 560 aa, Homo sapiens
SLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 1021 - DNA, 49806 bp, Mus musculus
  misc_feature (1)...(49806): n = A,T,C or G
tttcgagacagagtttctctgtgtagccttggctgtcctggaactcactctgtagaccaggctggcctcgaactcagaaatctgcctgcctctgcctcccaagtgctgggattaaaggcatgcaccaccatgcccggctctagtcttagattttttaaaaaatatttgtttgtttgtttatttatttattatatgtaagtacactgtagctgtcctcagacactccagaagagagagtcagatctcgttatggatggttgtgagccaccatgtggttgctgggatttgaactcctgaccttcggaagaacagtcgggtgctcttacctgctgagccatctcaccagccctctagtcttagatttttataagctatagatttctataatgatacaccatataaaggtcaaaaagttcccagttctccttatggagtatgttgatagattgaagggttttgttctgatgctcgaggagcttcaattcaaaattgtgatttttaaggctcaaacctaacaggttctagtctcaaaagctactgtaacagttttagtctcatcaaagctactgtacttaagaaatgcaagttggtagtcagtaaccttataaataagcatatcctttaatgtgctcaaaattatatttaaagtcatgttgagaactgatgcaattaattttttagctttatttttaagatttatttatttatttaatgtatatgagtacactgtagttgtcttcagacacaccagaaagggtgtcagatcacattgcacatggttgtgagccaccatatggttgctgggaattgaactcaagacctttggaagagcagtcagtgctcttaaccgctgagccatctctccagcccctatttcgctttatttaaccttttactttatgtttactaggtacagtttagaacagataactagaaataaacacatattatctaacccagatatacttagtaggtattagctctcaaacgtgtcagagatctgttgagtattgcattaaatgtttaaaattactatgacagacagaaactcctagattctaacctaaaagtgacccccacacacacacaaggtctccaagaagatatgaacacagccacaaaggactccacctggattgtggtatgtcaactactaggaaagactgcctcaatgtcttgaccactgccagggcccagcctgaacaatggacagaggacaactggagaactgaatgtctcatgttgcctaagacacaatgaggtcatctctcccatgttcctgccccacagaaaaagacttcgcatcttctggtcctgatggccagacagcctctggccacaatgcaatggagaccacaggaacctgggagaacttcctgggtagtagaccgtggattaatctccgtcattttaattaatatatgacacttaggttattatttatccttctctgttctctgatcacatgacggctaagctgtcataacagctagagaataggcaactagctccttaccccaagggttaagttaacaccatgttagttcattagtcgatccatcagctaggtaacctaccagctctctcattagaaatgtgaacaggtttgtcttgctcacaggcttcatgatannnnnnnnnnnnnnnnnnnnatcgccttacctgtgtctataaatattggataggaaaaggtgtaaagcttattaaggtctgaggcttgaaagcttctacaaaagtctctggagggcctaagaaagtgtttgaaggtttaggaaggtgctttgaggttgataaatgcaagttaggaaggatttatcttttttaaagttaaaaaaaaaaattcttgtaagcttcactcaaatctgcctcccacagtcaaatggactccagatgagtcctgttttccttccccacctgcatattcctgagggagggatctattctgcttgctctggttctgagaccccactagtacccctcctccaactaccaagaccacgggcctaagagtttcagatgagctgggcagtggtggcacatgccttaaatcccagcacttggaaggcagaagcaggcggatttctgagttcgaggccagcctggtctacaaagtgagttctaggacagccagggctacacagagaaaccctgtctcaaataaccaaaaaaaaaaaaaaaaaaaaaaaaaagagtttcagatgcacacccaagaaaatggctgtctccctaaactccttagctttctcttctgctcctgacatccagctgttctctcataacctgcatccagaacagctccaaaacagttacccacaggtgctctggcccagcctcacactgcttctgctgtgcctgcactcgcctaccctcagacggtcccacagcctggacagcagagaaacaaccagctcttctcggacttggccaacatcccagcttttggcccacacctcaaaactgtaccccaatgtcagcaggaagtagccatagacgattacatcgccccttattcatttattatcaacaaaggctaggatatttggtttcagaccaagggactgaggtacatattttacgtatcaaaacagacctggcttccagactctcccagcatcccttggcccctacgcagcataaatctaaggctaaattatagctttacaacattagcaaaaacatggcagtgatctttaagtttttaatgttgtaaacctctaaaactttaagaatttaaaatctctccattttgtctttagtactattaaagagtaaagaaaaacatagagagtgcaacaaattatcaagacaggacagaaatagtttggagacctgctttcctgatatgctcatgtcatgtgttgctgcccttaggcaagatggcagtcaaaccataatttcccataagagatggctgccagcgtatgactgcccttaaccaagatggcggtgaaactctgaccacaccatcttcatctcaaagccaagatggccaccagccttgtgctgcttacccactgtgtaaactttcctgctgccaaaatggcaggagacttaaaatgagctgcttagtcattcagtaacactgttgcaaagagagatggttactatattaagggcaggtttattgggaagcaggcaaggaagttcagtggtctcaaggaaggaagccaaggaaattgccatgctaagggaaagagaagagaggaggaagggaaagaaagaaagagtgtgtgcgcaggggggagaggagagagaaagcacaaagagaccaaatgtctggattctatagggagagcccctgcaggaagggcagcccaaccagccactgggctgggaagtttagggtttgggcagggtatgctaaacagggcctggaggatcctgggaggacctggaggccagatctgttgatatgtaaattttgttcttagggcccctaatcccaatctgaaaacaattactttaaaaaaaaaaaaaatccaattcccagcaaccatgtggtgggctgacaaccatctgtaatgggatccaaggcccttttctggtgtgtctgaagataacagtgtactcacacagaataaataaaacttgttttaaaaatttctggaatataaactaactacagccactccatccaaacattagtatcaatcttcgagtgggtcctcccctgaacagcaccaaggatgctccctacattggagtagtgaaaaggtggcccacctaaaggagaggccacaaggagctagcacagggctctccgctgggtacaatggccaaggtcactggagttgctggaggtggttggtttccagctgcaaaggaaaatggtgcacaggccaaggagacttggttgggggtctggttggaattggtaatagttgtcccagtgtctggcttgatgttagttatttctgtacactcctgtttgtgcccttttaggacacgggagctagctgcggaacatcactgtaaccacactgatggctaccagctccagcatcattgctatggcaaacctatgatgttctatcttataggtcggaccatttgaaggatcacaagaaagttcaacattcatcagtgaaagcatgggacatgtgtgtcttagttgtgaagagacactgtgacctaagcaattctttaaaaacaaaaaaccatttcattggggctggcttacagtttcagagagttagtccattatcatcatggagggatacatgcaacgtgaaggtagatatggtgctggaggagccaagaaatccgcctacctctgcctcctaagtgctgggattaaaggcttgcaccaccactgtccagcctacatctttatctacatcttgatcctaaggcatcaaggaagagacttgtgttccacactgggtggagctcaaacataggagacctcaaagcccacccccatagtgacatacttcctccaacaaggccacacctcctcatagtgccactccccgtgggccaaagtttcaaacccctgattctatggggagccatttctatcaaaccaccacatgcttggttgttgatctttttagtgaaatgtttatactggatgttaatggaagagtgtttcagaagtagtttgtcatcttccacagccttcccgtgctagcccacctctcacctgatggtgctcactaaagataaaacaatgtagtcaataaaagggcctaaccaagtgcccagagtcacttcaagcatcaactctgacatgaaaagatgcgtctgtgtgtctgttaagggacaggcaactccatttttctttttagttaaacaatgttagactttgatcatgtctttagctaggggtcacctccatccccagaccaataatactgtgaatcacacactttaaagtgtttccattgttctgagaattgactaaccataaaatatttcatgatatgttaatggtctgatcataaacccataacgcgttctttttccatgatcatagaaaataactgcaaaattctgggtttttggtttttgtcttgttttttttctttcttctttcttgatcacttcctcgttttccatagagagacctttgtttctgatccgggccacttcatatccttgccagtggagggtgtaagtctgtccaagccatgaaaataaaattttaccttgaaacatctgtgtcagctcctggtttttgacactgtaacagtgtccactggaaccagactgagttctcatggcagcctccggcacatactgagcgaggtatgatggtaccacacctgtaagctttgccttggggatgctggggcagaaagattgcacgtttgaggttaacctggactacgtagtgagacactatctcaaaaataaccaaaaccagataataaccatactaataataaccaagctagcatttggcaactagaagttctgtgatgtggcattatggactcttttctaaaacttcctcgcctatgttttctattttaagagagcagcacacagcaagcagcacagcagctgtggctcacagcagtaggatgtgctgagaagctggggcaggaggattgcaaccctgaggcgcaggctggcgagcttgcgcagtggaccagggcttgtggtgaaagctggtggacggggcgtggagaccatttgtaaatccagcaggaaggtggaatcctgagatcccactaagccacctgcaggctgtcctctgacctccagggttaagagaatgtgaaagaaaggggaatctaactgttccttgaaccctgggagcagacctagattaaccggaagtgtttctcggaagtctgaaatgaaaccggaagtttgcccagtctcattgttatgcaaaaaatacacaaaggggattctctccgctttgtagccatttgttttcattttaaattcctgaatatgcacatgcccttttgtgtatctataaaaccgttttttagtgcacaaataagaaaaaagcgaaaccggtcccagcgatcggttcctgggagaggatctggggtcccagtcagaataatacagggaaacgggtagaggggtgtggggatgggactgagaaaggttggagaagaaatgtgtcctttcattgtgtgccccatggtaaggtttggaggtttccatgtccctttagctatgcaagagacgcaaacgtgtgtgcgtttgctctgtgtgaagttattcctgagcactcaagagagccccaggtgtgtgtgtgtcaccctgcgtgtggtgccaggtgggactccaggccagctctcaggaaaggaaatggttgtggccacccagtccccagcaggttcggtcttgaacattcccattacagaggtttagccaggattttaagtctcaagacccgtctttgctgacacttaggtttacacaaaagattccaagccattgctaaacattagtaaacccattttagaatgggaattccccttggtcccagtccaagataacagctcgagtcacctggggcatgtctggaccacagccctggcattctgttccagcacatctgggtggtacccgaaccatgtgtggccttggaaagttccctgggaaagtgagaaacacccatccaggttaacaccacttgtggtggggatctagatgcaaaagcaaaatgaaaactccagcatgccatgccctcctcccagctatgtccttcagggtccagcagagaaaagagaagcagctcagaggatggcagtcctcaaaaggtggaaaaactgatactgagtgacaagatagcccagagacaaatgacacccaggagctgctgccctccctcccctagaaattgaggaaaatggagataaagggagatgatggcgttttttctgaaaccattgaccaaagttatgtgggagcagtgaggctaccgtgggtccatcctggaggaaagggagagatgcagctgtggagaccagactagagataaagaaatcatcatagacttctcccgttctccccactagacaaacccagcaggaaggtggaagcctgggtcgcagacatgagcataggatccccaagatgccaaggacccagctggctcaccagccatggctcaagcgagcaatgaaacattagaccaccatttggccacagctagtcatcactgatagccttcatctagaaaaacaagggacatttaaaagcaacagctatatttttaactgctgagacatgttagccaggggctttgatgctgactccctcttctgggcatctctgggcacacatgaggtacacagatatgcatgcaaacaaaacacccatacacataattaattaaaaataagaacaagagctgccatcaacgttaaatgggatctccagtgctccgacgctgtcccgaggcagttttgctctttacgagaagtgaaacgagcttccgcagaacaaaggcttgctgcttcagttattgctgattttctcattgctgtggcagaatgacagacagaagcaacttgaggaccaggattgctcctggctcgggatttccaatggtttagcccactgtggtggagaaggcaggtcagctctgtgaagctctcttcatggcaccaactatgggagcttgggctgtgttgtagcatcagagaggtctgtccccagtggtctcttttccagctaggcctcatttttcaggagttccaatctcccaaaataaaagcactagtgggtaagggaagggtcaaactggggactgagcattcaaaatgacctctgagctcatgtaccggttctgactccgtctttcatccataccctccctatcccactccctccattggaactctgacatatggagattcagactcaagacaccctcacttatagcaaagtccctccaaatagggtcaggaaattgtttcatagcaggctctcaggagccagttagaattcccatcacccccatatccaccttctccttcattttaatgatgtttttgtctgctccctctatggccaggccaaaaaaaaaagttattgtaaagagtggccaggcagatatggaggccacccatactattcatcatatatacaagctcatcctgattccctcagccatctacaagatgggnnnnnnnnnnnnnnnnnnnnaattaaacactcctccaagtgtgtttgacatctttgatgtgccttctcctaaataatacaaacctgtctcctgcttcagatctggcctcagcctactgactccttaatgtcacccaatgtggcagctttggagatggctggctgtggagacggcctcctgggactagctcacaactgcctcttatagcttctcctgtgaccctgtcaaataaccctccctccccattcaccaaattcactgagcctggggtcactctgactcccttttttcatatcatcctctttggtgtgacaaactgtcttatggcacctgggacacgttccctagactgcaacaaaaccgtaaccttgctacctcatctcagccccagtgcctgcccattcatatcccctcgattctttgtggcactctggcctaccaccctagttggtcaggagtttgcatgctaatatttctcttccccaagttgggggtgacacacggagaagagctcttaccaattcctgttgcacgcaatagctgccagacatgatgaaagggcagttcaaatcttgcccctcctggctgtcatcgaaccctcttttatcaatttcttctcctctggcatttcttcaacaacaaactcaaaaaactctctaatcaaacaactaatttactgttacgggactacgggctgctagccacaaagcctgagtctcatggttaccgagtgtgccctgatggtgaggatcagcaatgcccgaacatgcgacaaccccggacaacaggaaatagtccaaattgctctccggcctcaacatcaccccttcttagttcctcctcttttatattgaacgaaagggagggatggtagttactagacatcttccacaacctacccagggaccctgagacggcaattacgtcatcagtaggagccaagttgagccacattcctcccctgcgcatgtgctatagtccctaaaaggcggactttcttcccgcctctttttgaacaacgcccttgctcacctccacccttcccagaggcagccactctaagcccctccccaataaagctctcagagtctgacccttggagtgactttgtggcttagatcataacaggaaataaaaaggggctgtggaaccttctgggtaagctcaaggttagagctaaggtcagttcttcagtgcaggattctcggggaagagttgcaaatagttgtgagtcacctaatgtgggcgctgggattcgttgcaagagcagcacagactcttagccactatgccttctttccagttcaccatccccaagcaattctaacaaaccctccatgctgaaatactgaagcccccgtggagcagagccccaatgaattctcccatctactacacactaatctctttttattttttttaagttacttatattgtacatgcagatgcttgagtctgtttccaccatgtgagctggctggcaggaaaccaggcttggtgacgtgtgccctacccctgctgagccatctcaccggctcaacccagcagcagggcaaaggccccgccccggtgttacgctgccggatctgccctaggggagcaccccgggatttggggctccactctcccaggccggcagcgcatcctcctggcatctgcgaaggaatgagcgtctccaggagggcaagatgcaaaggcgcaaggcgaccacagagtccctggcatgcctgggatagggtggagggatcggtgtactcgggtcttagactccacgacctttcccggttcctcgggagagcaccgcctgggagtcgggctgggtgcaaggggccagcgccctctaggcagcggaagtggcgctggttgtacatccgtccccgcctcacagagttgggagaagactggctggtgcgggaaatatgcaggagaaaagtctttgcataatgtagagcgagccgtggggctccgggagcggcgccccaaggtctggggccatgaacgcgagcgtggaaggagacaccttttctggatcgatgcaaagtaagtactgaacagacgcagctggggcctggcccggacagagccagcaggccccgggatcggggtgacggcgcaccttgcatgcctgtccccgccagcccagtcggcgtgtcaggtcgggagccgcctggaactcttgcagtaccccaggggaggcaagaccaggggaggccacgcggcgaggagactgtcaccacctcccctgccccgccgggtggagtttggggcgcagaggagaggagaaagtggggtgatccaggccaactggtagggaaacttctgcttcagtggctcaggttggagcatccctgaggggctcgcggacaggtttgcagagccatcctggcactcagggtaggggatgatatgggtgtgaaagacctggctgggggtgacttgcagtgagtttgaggttctgctattttcctgacatcctataagctattgctatctccatgtgcctttgttccccaaagtacgggccacggactgaaccgtggaccggccacctggagcgcatgtgttcaaaacaggctgcttggtccatcccctgcaggtctccgagggagggtggggccggaatcccaggtctttccttgtgcctggagcctcagatgtttgaaaagctgtggacaaggttcgcaaacacctgagtcactttgctaactgcagatattatagccattggctccccaaacttgcctgagtgtcctctgaactctgaacccagtccccacccaccccatgtgtctcagtgtcttccagtgctgtggacttcgggttgtgttttaaagagggacgaccccaccagatgacttactctggaatgggaaatcagtccccacatcagagaattttatctataaggatcctaaggaaagatctgtctttgttttgttgttgttgttgtttgtttttgtttttttggttattcgacagggtttctctgtgaagccctggctgtcctggaactcactctatagagcaggctggctcaggaagagatcatctgtcttgtccccattttgcagatgagaaagccaggggtaaagtgcctgttgactgtgacagtttcagggtgctgagaaaggtccccattgcgacttgttccttttgtgaataccagagcataacttagcaccgaactccttcactctggaccccagtctcccaccaccacgaagacacccttagctatgcaaatatggcttccttcctccgtgtttctctagtcctggggctattcttgcagccacctggcagcagcagtcccgagcaggaaggccttctgttgctttctaacgcccattgcaaggtgacttacaaaatgtcggccctagcatctttgtccttggtatgtctaccacaggacaccataacacgcagatgccatgtcttagtccgggaggaaacgggacagaatcaaaggagtctacagaaaatcacattgtacgcccagccccatcgtgttacacgaatgtggttctgtagtatttaatttcacgggttacagacgttaccttatgatgtgtagataccgtggagtgatacggtgtggcacacgcctgtgtggtactatgtaggagaaagattagcttcagaattttaagcataaatagtagaaagtgtttttgcaatgtccatgaaagatacaatggaaatattataatgaggggtttttttttctggcaattcttaccatttctcccagatgtttctacaagtgtcagaaacctatactgtttctttttttttggggggggggggtaagttttattatacaataggaaaaaaatccagtttttattttcaattatttgtagctagagatgggcaattgtttgcggttacaagtgctcatggaggccagaagagggtgtcagatgccctggagctagagttgggagtgcttggttatgagccgcctactgtgggttctggggccagaacccagatcttctacaagatcagtacatactcctaaccactgagccacccctacatactcctaaccactgagccacccctacaactccacaaaagaaaattttaagaataaaagttaaatttctcacattgagactcactaattgttatctatttaacaaaccttttcacagtactttctacagtactttcttttgctgttggtctgagacggggcctgggtgctttgaactgtccaagacccaggagaaatcttaagattcagtctttgagcctctacctctggagtgactggaattgtgttactggcctgcatgcccccactggcccatttttagaaggttctgggcgtcggactcagggcctttgagtatgcaaagccagtgctctacccactgagcagcatctgaaactatattactttccgatagagaaccaggcacggtgttagatgctttgacagtctcaatgctgtattgagcttagttcgtgtttctgacacttgtagactgaattcatccttacctgactggggtaccattttcctacagcaatgaaacagcattgctcaattccttggtccctgttgtgttcagggaccaaggaagtgagaataagaatcagggattctggaattttccccgtagttatgaaatggctgcagaagcgccagcgttatatctgcatccacatgaaaaagcagaggaaggtacagctggccttctttgcttcctttgtggtgtgtgtgctgaaagagttcacgcacgcgaatcactgttgtacctagtaggtcaggagatggcctcgggcctgtgaggggctacgcaccctgtacttcaaaggcactctctttttctactgattgtgggaacatggacacaccagtgtgtacagccctgagaacacgcatgtggaggccagaggacaacctccgggttgttcttcaggcaccatccaccttgtgttttgagacaggctccctccctggcctggagcttgccgagtaggctaggccacttggccagcaagccctgggaccctcctgcctcctcttcctcttcctcccctatgctgagattacagacactcctcacatacaacgtgttacatgggttctaaggattgaactcagggcctccctcacgttgcaaggcaaacaatttgtggactgtctccccagcccctgtaaaataaaccccaagctctcagtggtccttgggagcaacactgccttgtaggacgtgactcacatctcgggacacagctgctaggacggaatttggagtaggtttgcaagaagaagcaacatagaccatccattagccatgtatgccccctgccaggaagctgggctgtttggaattaatctgtaacttttcctttgtctcggcgaagtcccaggaggcaccacggtgctggtggagctggcaccggacatccacatctgcggcctctgtaagcagcacttcagcaatctggatgcctttgtggcccacaaacagagcggctgccagctgactaccacgccggtgacagcccccagcacggtccagtttgtggcagaggagacagagcctgccacccagaccaccacaacgaccatcagttcagagactcagactatcacaggtacagtgcggggagcggggagggtggtgaggggtggacagaggaggctggctatatcccccacctcttcggggccggttaggaaggcctgctcagggtcccttggttactcgtcactattattgaggatgttgggacagtgtttctccatgtagccctggctgtcctagaactctcttaatgtagaccaggctggccttgaactcagagatctgcctgtctctgcctctgcctcctggtggctgagactaattatttttaaccagcacctctgggaaacagctgctgtagaaacagctgctggaccaggcccggaagctgctagttcagatcgtgtgagtaatgagaaatgtcacatgtttaagcaaaacaaaagccaggtttctttttttcttttttttttttaaagatttatttttttaattcatgtatgtgagtacattgtagctatcttcagacacatcagcagagggcataagatcccattacagatggttgtgagccaccatgttgttgctgggaatcgaactcagacctctggaagggcagtcagtgctcttaaccactgagccatctctctagccccaaagaccaggtttctaagccaaacctctggattccaagaagcaggtccttgcagctgtctgggggcggggcacacatgtgagccctgtcaatcaggtcctcgcagctgtctaggggtggggtacgcatgtgagccctgtctgtattggcattggtgtgtgacaaaacaaaaacattgtgtggatttcggccttcatctcgtcttgatttttaaatctgtaaatgaacatctgtctgcccccctttaaacaccctcttttctccatgcagacaacattaattatataattaaagtcatcaaaaagttgaatatagacagtctagagggggcaggcatgtaatcccagcgttcagaggcagagacaggaggattgagagttcaaggtcatctctgaccacacagtgaattcagggccagcctgggggggaaattaattaagaaaaaaatgtacagaatgaaaccatgaagagtttggggtctggggctgaagcgatgcctcagtgcttagaagtggtagatgctcctacagagcgcccactatgggctgtttacaaatgcctgtaattccagctcctggggatccaatcccctctcctagccgttgagggcatctgcacacacgtgtgcatacacacacattgacacacatgtatttgtaaataataaagtaagtctgttatgttctagagtgcatgttatccacatagtgacagatacacacctatctacacacacttaacacatctataaccttcataaagtgaacagcacagcagctttataaatgtatagatctccaatatggcgggtgctgtcggaattggatggtacaatccttcctgactggcctaccctccccagaggaagaaaatcagaagtggactgcaactgaggtttctttctctccagaaaaacaaaagtctaaagatgagcatgttaagaaaaagttggccgctcacagctctaagcattcttcctatataaagaccatctaaaaaccaacaaaagtggcagaaaagaagcaagtggaagagtcaatacaagatagcagatggcttataagggtgtactgagcacatgggggggaggggggaggggggcacagggtgaaagccagacggatttaaaccgggcatatgtgttctgcatacaaaaaacgcctgtgccctgagcctcagaaagcggaccaggtctgtgtgaatggcaagacagatgtgtgcgtgtggaacagtgttaatagaagcttctagaacaggaagtgaaatcaatgaaagcctatagggggctattagggcatagcaggggactgtggtaaagtaggaaaatcatgcgcaaagcggctgttctttgggtctgccaagtatgtgccccaacatgtatgctgtatcacacaggcagaggtaagagttggttctctccaccatgtaagtcttgggaattgaactcgggtcatcagactcggcagcaagcatctttaccagccgagccatctccacagcccaaatgttctcagtgtttgagaggtcactggctaaacaccatcactgagcctgactgtgcctacaggcttcttctagccttctctcagagagcgttgaccagctagatccactcaagtggacaggcagccagcttgcactttataagcatccatgtgctgtttagaactgggccatgagggctggagagagagcttggtggttagaagcactggctgctcttgcagaggacctgagttcagtttccagcacccacgtggcgcctcacaactgtctgaaatagttccggaagatccagtgccttctctctggctttccgaaggcattgctggaacatcatacacaaactacactcgggcccacccacatgcacgaaaaacattttggggcaatagcagaatttcaggggtatttttaatgctcccaacgtttgtgtccggatagtgcaccaaaaataaatctttaaggaagagatcaagaaaatgtagaggcaagaagtcaccttggaggtggcctcctgagacctgctgtgaccagtttggatctccgctagacaaggagaaactgcctgttgggaagagaaatgtccaggaaggccccacagatccagcctgccctgggctgagggctttgtcccttctcaagggcatctccctgaagagatttttgacctcaaaatacaaagccccagtaagaattgaaaaagggaattgtgagggactcctccacatggaggctctgagctgcgtactgccaaaggccttggcaactctgatgtctgacaggcagacgtctgctccctctgctggaagtgcctttcccagctttgcctggctgacgccacccgttgacaagagacagtctacacacacaggctctggcttctctagcacacgcatgccctctgagtgtgcagcagggtgaactccttgcagtttctccggtgaaccccatttcttagcactctagagccctggcaggaggtattcctctgcctggaactcaaaattaattcttatgcttatatctgagcttagcttggaggcattttctcaaagagcacttcacacacacacacacacacacacacacacacacgtgcacgcgcacacacacacacgcgcgcacacacgcgcacacacacacacacacacacacacacacacgcacgcacacgggcttcctcagggcaggtcatttcccctggtgcactgatcactggagaggcagagttcaggtccctgtctgccctgtgaggtcaaggttgacgtcttagactttgcacacccattgtcgacagtgacagtggcctctgatgggagaatttgttactttttgggtccaaacagcttataatgccccatccatgggaagccggccccacaaccaaatagcaggcttctcttcaccctgccctgtagccctgtgggtttgcccaacaggccagccctggggtcctcttggtactcagttcaggaatggtgcagacatcaatctaaaccccagagacagactccaagtgtcatatcccaccacagtctgatgactggccacaggcagacctcttcatgcctgggctgccacaggaattctgtgataggccactagagggcaagaatgtctgctgagggcattgttcaaggtgcagagtctaacgtgtgctaatctcaggtgtctagcctcaagtgtctaagtgacttagctgcccctcttcaaacaaccaaacaggtagagtcctgcccaccatctttggactctgcactgacccccacccccagtttggacttagctgctcgggtagctgtcagctctgagacccacttgtagatcagggtccttgggggaacttgttaaacaccagcactcagacagcatcccagaaggaatcgccagcatcagtgtgatatcgtcagtgtgatcagagctcccaggccacccaagtctctggcaggttggaaagtcactcacttgcccagggcctcaagaccataacccctgatggctcccaggtctgacattgcccctgatggagccaggccttctctcaggcagtcctgtgaaaagtggcgagtacattagcagctttccgcacctcatctctaaccctcacagcctctccagagacagggaggaaaagccccatttcccagacgaagaaactgaggccagagccagcaaaatggctccgtaggtaaagcctgacagcctgaatttaatcctgtggaggacccatgtggcagaaggagaaaacaaatgcccacaagctgacctctgacctccccatatgtgctatggcgcacacataaataagaaatgtaacaaagaaagaaaccaagatatggggtggggggtgaagatttgctcctcagtgcgcactttctctgacctgtgattctgcctcagggtgactcaatgatcccaggtgattagcactgtccctagaatgaccccagctagtacctgggcgtccctgctgggtttcacttacccacccacccaccttgacgttcagagcagcaatggccacaaaaaaaaaaaaaaaatgaaaaagagagagaagatactccaagatgggggatcgtagcaagaatatcgccatgtctctcagtgggatgcttctgaagaggatacgggcaggatgggaggcagtcaggagaagcccactagaagtctgactcaggaggcccatgcttgcctttcaagatggttgtaggcattgagtgagctgacctgtggaggtcggacagacactaccctgcttttctaccacaggagcctcccggttaggacagctgtggaacaggacatggaaggtcacgttttcaaaccccaccaacctggtttgagttccatgtctcagggaaaccctctgtgccaccaatgggcatcatgaccccttttgatcctgagtgtgacagtcgagagttcagtgtgtaggggatttcaagtccaggtcaggccagctttagtggctggagtactggtcaacccagagccactacatttcctccttcagctttgtaactttatgaggtagacatagaggtgatcccactgacaggagaggaaactggggtcactgtcatagttagggtcactattgctgccaaaacaacttgaagagaaaggggtttattggcttacacttgcacatcactgtttgtcatcaaaggaagtcaggacaggaactcaaacagggcagaaacctggtgcagaggccatggaggggtgctgcttactggcttgctcctcatggcttgctcagcctgctttcctttagaacagtgattctcagcctgtgtgtcacgacccctttggggattaaacagcctttacaggggttgcctaagatcatcggaaaacacatatttacattactgttcacaactagcaaaattacagctgtgaagtagcaatgaaaataatttcatggttgggggtcaccacacctcgaggaacggtattaaagggtcacagccttaggaagggtgagagccgctgttatagaacctaggaggagctgggctctctcacatcattctccaattaggaaactgcccaacgggcttgcccaccgcacagtcttacagaagcccgttctcaggtgacgctccttgtcctgatgactacagcttgtgttgagttgacataaaacttgccagtacaaccggcccctcgccagcgtgacaaggtcatcacttgtcacttagaaccttgcatttaccatttatccccaagatgacatgctaatattataccatataatataatataataccacagtataaaacacaaattactttaaaagtcctgtagtccttatgaattcaaacacgataaatgttctgtccattctctttaaaataaccaatgtctttgaaaaaaatcccaaatcgcttttaaaaaggtaacatctttcagctgtgggctcctgtaaatcaaagttaagttaaatactttaagagggaagaaccaagccgggtaaggtggcgcacacctttaatcccagcacttgggaggcagaggcaggcggatttctgagttcgaggccagcctggtctacaaagtgagttccaggacagccagggctatacagagaaaccctgccttgaaaaaccaaaaaaaattaaaaaataaaaattttttaaaaaatagggaaggaccagtacgtagtcacaatctgaacggagcaaacccaaactccaacagtgtcaactgctcagcgttcaataatctggggttcactcacgatctgactcctccagggggtttcggtggcttctcagctccgccctctgcagcacacacagcttgtcttccaggctccgactggctccactccgctgctgctgctggtcttggtggtcattccgtgacactggcatctccaaaatcttggaccccttgtgcgcagcactgtcaccaatagcctctcccagagtctcttcagggactcgagccctgccagacagtgccaagcctcaggtgctctccaagagccctttattccttcaaacaagaaccatctggtgacgcttacaccaccaagtccaggtgccagcacaaagcacaaccttggccgggtctggagcacagcatctatgtgctgactcttgagaaacatcttccggaagactttacctcagtgatgctggcctcttggtaatcaccgctaacttctcagctccagccaaccagcatccactgccccagcagagcgaaggtctcatgctagtggttctggtctcttgcggatcacagctgattcttcagcctcagctgaccagaaccacaggttcttcacgcaaatggcccgggagagtctttgcttccctctgagactccacaagccaggcctccatcttctgcactgctcccaacattgttatcctccaagctcccacagaacagctcattgaactctcaacaggaatggctttcctagcccagagctccaaagtccttccacagtcctcccaaaagcatggtcaggtctgtcacagcaataccccattatcatggtaccaatttatcttagggttactcgttctgtcgtcacagagcaccacgaccaaaacatcttagggaggagaggtttatttggcttacacttccatatcgatgctcatcatagaaggaagtcaggacaagaacctggaggcaggagctgatgcagaagtatggcgtgtacccagacaggctgttccaagcaatgactcatacccagcaggtgtcatttaggatgctttttagaacccagatccatggagacaccacaaatgtctgatccagtaggtctggcattcaggctgagaatctgccatggtcatgagtcctgaggccccctctgcttccagctgggactgggccctgaacatgcgcctgtgagcaggagcacacaggcaggtgagctgcccagagactggccttgcagaggagtgcttgtcagaaccaggcagctgattttgagcggtgagacatctcaggacattttttttttccattgagaaaagtggaggctgggtttggtttgctcacttgccaaaagccatcagaagtcaggtgtcatctgatgcaaatcagtgacgatcctgaggatgctagaaaggtgcaggtgggtacacctgggcaaaccagagatcagagtgtgggtttaagaagtgtgatagagggctgaagatatggctcagcggttaagagcactgactgctcttcccagggattcagagttcaattcccagcaaccacatggtggctcacaaccatgtgtaatgggatctgatgccctcttctggtgtctctgaagacagctacagtgtactaataacattaaataaataaaacttaaaaaaataaaaaaagaagtgtgatagtagaagaatttgaagaaatgcctgctgttgttaaacctggttcattctcccagccccatgctctcagaaataagactcagactcaaaatagattttcagataccttggccttatagctaggctctattctgaatagatcataaccaaaataacccaattattttaacctacattctgccacatggtaccattctgtgctcaggtaccatgcgtgcctcttgtcacctcttttcagtgagtgaccctcctgccttctctctcccacaattctttctcctctcagataccccacctctctttcctgcctaagccataggccacaggctttttaatggacacgtgatgcatccatacagtacacaggatattctctgtacaatagcatggtagtaggtgattcctgcgtgctcggtctttactcgtttttcatttgtttatgtgcacctatgtgtgcctgtgtgagtttataccctgtgcatacctctggagttacgaatggttgtgagctgcctcgtggttgatgagaaccaaacccagggccttggcaagaacagccagtgctcttaatcatggggacatctctccaacccctctcatgattagttttaaaggggttcacatgggctccatatggataattggtcttcccccgtgaggaacccagaatgggatgggatgctgtgggcactggaggtgagggtgtggactttgacgtgatgtaaagacaaaaatcaagccaaggcagctgctcttcaaaaacaaaaaaacaaaaaacaaacaagggggagggtgaggaggaaaccacatgttaaaatcaatgtgtaaggggctggagagatggctcagtggttaagagcccttgctgcccttacaggggacccgagttcaagtcccagcacccacatggtggttcacagtcatctgtaattcccatcccaggggtccaatgccttcttctgacccacaagagttccaggcacacatatgatgcccagacagacacatccaggcaaaactctctcacgcatagaatataaataaatctttaacaggacaccaccctccttactgtgacagtttctcaggcttcatgtttgatgacctggatggtttctggggtgaagtcttctcagctgggatttgtctactgtgagttagctgggtctgtgggttggcgggaaatgacttgtggcgcagatttctttggcagcgcagagctaagtagggctagcaggtcagggagggtggctgctgcgtgcttgaggtctgaggcttagagcagacaatgatggctctcaagaccatcacggggcctttccaccttgcctgttcctcatgaacatagatttgcattccctctcatctggaactaggcctcccatgggcaagtgctgtcttagtgaaggagacaagacctttgcaaaccccaaaccaagaacatagttcacaaagtgagcacaaatatgtatagtgtataaatatatatatatatatatatataatatacaataaatacatattatataattattatgtaattatgtgtaatgtgtatgatatattctataatatattgatatatagataaatattaaatgtataattatatgtaatttttagatttatttatttattttatgtatatgagtacactgtagctgtactgatggttgtgagccttcatgtggttgttgggaattgaatttttaggccctctgcttgctctagtcaaccccactcgctctggtcagccccactcgatccagtcaactcctctcattcagtccctgctcgctccagcccaaagatttattattatacacaagaacactgaagctgtcttcagatgctccagaagagggcgtcagatctcattccgagtggttgtgagccaccacgtggttgctgggatttgaactcagaacctttggaagagcagttagtattcttacctgctgagccatcctgacagcctgttcttatatgtaattatatatatgcaaaaaattcaagacgacttctgtcttactttttatgatatcttatttgatattttggttgtgtttacgtttttttcgtttccttttacctcctaattgcagagagacaacagggatgtctctgccatactcaggggagttttgagagaagtctaagacccaaggaaagtgccttgtgcctacagttagcattgtctacatgggatcagtttttaaaacctttactgccaagagatctgaaggcagggcttgggcgatggctcagcacttaagagtacttgctgctaagccatgaggacgggagtttggaccccagcacactccaactcttagtgatgacctctggcctctgcatgcgcgagcacgcacgcacaggcacacgcacacgcgcacacacacacacacacacacacacacgtgcgcatgtgcactgctagtgctcttaactgtcaagccatctctccaggtcaggcacttgattttcgaatgagaaaggaagttctttccacagacgttctctcgcgcctcattggctggggtgaattatgtccgtcatcctgtggagattcataagctctgtactcttcagtttcagctccagagttcgtctttgaacatggctaccaaacttacctgcccacggagagcactgacaaccagacagccaccgtgatctctctccccaccaagtcacgcaccaaaaagcccacagcaccccctgctcagaagagactcggctgctgctatccaggtaaagggagcgccatgcatcgcatgtgcagaaaggggttcttcataggatttgttttaatggtggggagacggaggcccgacagtgtagatgaaacagacctggaattcactatatatctttggtaggctctgaacttatgattgccctgcctcagcctccaagtgctggaatcagggccagcatgcccggactctttgaaaattctttgtttgttttttctgaagatttatgaatgctttgcttacacacaatctacacctcgagtgtgtctggtgcccatcgggtcaaaagagggcatcagatcccctggcgttagagttacaggtggttgtgagcctctgtggatgctggcaactgaacctgggtcctcgggaggagcagccagtggtctaactgccaccccatctccacccctcagtatcctagttttcccaagtcgttagtttcctgtaaacaggagagtcaggcattgtctgtctcggtctttcatgacagcatctttctagcctacgggccatgttgtaaagtgtgagtctgtgcgtccctctgctggtccctgtgttttttgaggttgtgccaaagcaatgttgttgtgtgtcgggcacaaggcatcgtgtccttcctgtgttgctagacatctccatatggtgagggaagtctgccatttccatctgaatttcttcccttggccttttcaggttgccagttcaagaccgcctatggcatgaaggacatggagcgacacctgaagatccacaccggtaagcagcagatggccattagctaggttaccctgaacagccagccagtgaggagctggggatgtcagatatgtgacaaggcccaagactcacagagagcaaaggaacatgggaacaaagtaaactaagatactgtttgtacatgtgattcgggcagaaacatatctaaagcaatgggtaagcgctcagccgggggagagggggtggggaactgccgtggccgtgtgagaactcatcacgatcgtaattcattagcatcagatccagatggcttccatgctggagatgaggtgaatgtctgtgtctgcaaatcacattaagagagagaagagtctttgtcaatgctggggatcaaatgagagggtacacacggtacagcaactttagattgattttgcacatcttctgaaggcaccactggctgcacagctggcctgagggtgcccttactggccacttaaaggagggtacttaatagccagcccccaggggttggtggcagggaggcaccaatgtggctcctgcccagcactgccactggaaaccagccaccgcagcaccagcaagaaacaccagttggtgcaaactgacaatcctgtaggcacagggaacaccagacagctgagagatgacccagccaggaatttataacctgactgctaacagtttcagtaaaatgattttatttttgccatgttgagggtcaaactcacaagtcctctgcccactgagttatagcccagcttaataaaattatgttttcttggtttttgttgttgttgttttgggtttgtttgtttgtttgtttttggtgacagggtttctctgtagccctggctatcctggaacttgctgtgtacaagactaggctggtctcgaactcagaaatctgtctgcagatatattttttaatcatttattatatgtatatgagtacactgtcactgcctttacacatatcagaagagggcatcggatcccattacagatggttgtgagccaccatgtggttgctgggatttgaactcaggacctttggaagagcagtcagtgctcttaaccactgagccagctctccagctcctgatacagtcttaactgcctaaccttactctcacataatggtgatcagctttggctgacagtgtgccagctcgaggctcgttatgtacttggtctacagagtacaaagtgaaaatctcactggagtggtaacacacaaaaactgtaatccctgcactcaggaggcagaggcagtagggtcaggagttcaaggccaaccctgactaggtagcaagttcaagactaacctgagttacgtgaggcactatctcaaaaaaaaagaaagaaagaaagaaagaaagaaagaaagaaagaaagaaagaaagaaagaaagaagaaaaaaagaaaagaaaggaaggaagaaaggcaggcaggctaggcttggtgactcatgcctttaactcaggaggcagaggcaggtggatctctgtgagttcaaggttggcctggtctacagagtgagttccaggacagtcagggctatgtaaaaagatcctgtctcaggggagaaaagaaaaaggcaggatagaagtcaaagtccctatgtataacatcccaaagtcatgatggtccactacgcagccttctgaattttttgcatgcagatataaggcctaagacagacacacctttttgttcctgtttttgtttttgagacaccatctcactatatagctctggctgtcctggaaacagccaggcctcctactcacatagatcttcctgcatgcacctccgaaatgctgggattaaaggccactacacccagctccaggcatgcagttttatcatctcttactaagtaaataaggtgtgcatcttcctatttaacattgtccttattttaaattttagcgtgtatgtgtgtgtgtgtgtgtgtgtgtgtgtacactactgagtccttgtgtaggtcagaggtcaactgtcatactcccatggtcctgccacgtgtgggtccaagaattggactcgggttataacaggcgcctttaaccatttgtcttagtcagggtctctattcctgcacaaacatcatgaccaagaagcaagttggggaggaaagggtttattctgcttacacttccactttgctgttcatcaccaaggaagtcaggactggaactcgagcagggcaggaagcaggagctgatgcagaggccatggagggatgttctttactggcttgcttcccctggcttgctcagcttgctctcttatagaacccaagactaccagcccagggatggctccacccacaaggggcctttcccccttgatcactaattgagaaaatgccttacagttggatctcatagaggcatttcctcaactgaagctcctttctctgtgataactccagctgtgtcaagttgacacaaaactagccaatacacccttagagccctctcatcttaagattgcatgtctttgtgctgttgtgtgtgtgtctctctgcttcattcttcttagtggtcaactgggaaactgattcagtcttttatggctcatctataaagtgaaatcgctcaaccttagctgtttaatgacgtggaaaagacagaaataactatataaaacgaagtcaacggggaatggtgtagaaccttttggaaaagccggagagttctggatcctagtcccagacttatttggctttaatatgtatttatgtatttatttatttatttattatgtagacagcattctgcctgcatgtatgcctgcaggccagaagagggcaccagatctcattatacttataagccaccatgttgtcgctgagaataggaactcaggacctctggaagagcagccagtgctcttaacctctgagccatctctccagccccctagtcccagctttgtaaagaggatgaaacaaaacaatcctcagataggaccttggatgtcaggggctgggggcgtggtacaggggcggggctcaggctgtttgtcgctaatttgatatggaggaggttctggcttccatccttagaaaggcatcaatgggactcgatggtccacgcctgaattcccaacgccctggagatagattcgggactgtcagaagttcagtgtcatttttggattcttagcaaattcagagccaacctgagactttgtctcaaaaaaataaaaagacataagctggcaaagttttttatactaaatgaaaaataagcccatatacaaaagttaattaattaaaaagaggtgggactgtagcccagttatagaacacttggctagcaatcccaagaccctagttcattccctaacaacacacacacctaccgcactgggctggtgagatggcttagtggggcttcctgacaagtctgaagacatgagttcgattacaagatccacactggtaaggggaaaagaaccaagttctgcgagttgccctctgacctccacacatgccctggtggtcgctctctctctctctctctctctctctctctctcacacacacacacacacacacacacacacacacacactaaatagggacgatacagatcatagccattgctcaagcaagggtcaatgtgttagattaagctgctgtaacagagaaacctaaacagcacctagacaagatggctgtttgtctgtccttcacataactgcacggagcgatcaggcagttgaggaaggcaggccactgtggctcagatctgggaaaagcgaatggatataaaagatggctgtttcccattgcattaacgtccttcagtgtgtgtgtttgtgtatggcaaaaaaaaaatagtactttaggatgggaaagaattaaatatcaaaatatgcagttaaaaactgtcaggtatggtggatgcacacatttaatcccagcacttgggaaggcaagtctctgtgagttcaggccagcctggtctacatggtgagatcctgtctgaaaacgggaaaaaggggggcagggaataatatgataaccaaagttaggaagatgataaacgttgagctaggtggacagaacatttataccagaccctgtaaggcttagggaacatcgagtatcgggggcagaaataccatccacgccagaagaggagcagaaagctgctttgttttaaagcctgggtagcgaggcacgcctgtaataccagaactctggactcgaaggcagggaaactaaagccagcctggattacataacaagtttgagacgtctggaaacaacaaaatatttttgcttatttatttagttgctgtgtgcttttaattaataaggaattcatactcatcttaggggggaagcttgaaaattctaataagcaatgcagcgtagccaccacccttgccccgtgcctgtgaggtctctaagcaacctcacagcctgcgggttagtccccttctaaggttgggaagcaaatattaacctttcggtcttgcttccccgccgctgcccgcggctcgcgcgtgcaccggaaggtgacaaaccccacaagtgtgaggtgtgcgggaagtgcttcagccggaaggacaagctgaagacgcacatgcgctgccacacgggcgtcaagccctacaagtgcaagacgtgcgactacgcggcggcggacagcagcagccttaacaagcacctgcgcatccactcggacgagcgacccttcaagtgccagatctgtccctacgccagccgcaactccagccagctcaccgtgcacctgcgctcgcacacgggtaagcagcggtgcgcttccagcgggctcctgcctgccagggggcagagggggaaggagctggggctggggctggggcctggtgggcagagcacttacccagcatgcaccgggccgcatcctcagcacctttaaaggcacaccgcctgtaaccgcaacactggagaagtggaggcaagaggatcgggggttttaggccgatctgcactatatgaatacctggtctccttttggaaaatatgatttttataattattattttttaattcacagcctggaggtgtgactgccttggcagtacaaagccctgggtgccatccctagttaccacataaaccaggcgtggccaacctgggctgtaagaaaaccctgtttctataaactacatttttaaaaatcactgttactgttgttactgttgttcaggggctggggatgtgactccgttggtggaacacttgtgtgaagccccgagttcagtccccaacaccacataagccaggcatggtggaaggagtctccctactcaagaggcgagggcaggaagatcaggagttcaaggctttccttggctgcatacagagcacaaggtcagcccgggccccctgagaccctgtctcaaagaaacaatttaaaaggagctatggtggtcgcccatcctcttccctaccacaccgtcccagtaacggcggagccgttgtcgagttgatagatttctgtgtgtttttatgtaattgtatagtgtggggttgagggactatatatagtctgtggaatagatacaaacaatgtgctgttaattcatagtcgtctgccttgcagtccgtcagttcaggcatttttagatgatgcgctcaggggttaagagcactgactgctcttctgaaggtcctgagttcaaatcccagcaaccacatggtggctcacaaccatccataatgaaatctgatgccctcttctgggtgtctgaagacagctaaaatgtacttagatataataataaagaagtctttaaaaaaaaaaaaaaaaagaatagttagtgcacctggatcgcaaagcatacaacgagggctgaggacggacgtcactccgtggtgacacttgcctgcctgtgagagaccccaggctgtgtagactcagctctgcaaaacacaaacacacacacacacagcaaagccagtagagccagaggctctgattacatagtagtgcttcttttggcttatgtatcagtaaggtaagctaatgagacagcgggccctcctcacaaccatgtctggatggtgggtcgcagcagatatcactcacctgcctcagggcagcaggagttgctattgatgttggctcagattagccacacaggtaagaaggctggcatgtctgcctgtctctgctggggggcagctggattgtgggctgggcaggtgtgtgttggtcttagctggggtgaccaggcagtggctggctcaggcttggcttcatcaccatcaccatcatcaccaccacagaggaacaagcaagcaagcccagtggggaagcccaatgaatcttgtggttgtatgtgttcacaagcaacacagtgggcctaaagcaggacacaggggtcagggacgggactgagctcagccatgggccaggccaccatcagatttacatggcaaaggccaggccgccatcagattacatgccaaaggccaggcgcatgagaggggtttggagccattcatgcgaacagtcatggtcacctttgtccccaccaccaggctcagctctgacatctattacatcttcaggacccccataaatctcaggcagccacaggatcaggccaagagatggagactgaccaagcttctcaggtcagaaaaggataaggagtctcattctgatacgccatgacacatggtgtcacatgacacactgagccccggcattgacagaaatcctgttcttaggaaaggggggatgagagccttagcaatgactggttctctcagggcgtatccccctgggagacaaggggcacttctccgttctgggggtggtctagctctggcgcataactcctcccccttggcccatgctttctggttccattccttgggaggcactgtctccccgtgcttgctgcctgcagaagggcatacgctgatgtacgtgtatgccaaggccagcgatgggtccttttctggttttgttttagtgtagatttgtgtccttttgctaccagagccatctttaaacttttgagtttactgagctggtagtagtggcacacacttttaatcccagcactggggaggcagaggcaggtggttctctgagttcgaggccagcctggtctacagagcgagttccaggataaccagagccacaagagaaaccctgtctcgaagaagaaaaaaaaaacatacacacactttgagtttcctgtatatttgtatgatttaagactatccgggcatccctcctttgtctgggctcagttgtagacatttcctctgacagtgacctcctggcatgagcttaattcttttggagatttgaccagaatcgtgtgtttccccttcttatttggtcttcatcagaggacatgatcttggttcccatgcttttttttttttttttttttttttttttgccttactttaaaaagctagttggaggggctggaaagatggctcaaaggtttaagggcactggctgctcttgcagaggtcctgggttcgattccagcatctacatggcagcccacagtcatctctgacaatatcctcttgtggtatgcatacctgcagacaaaacacccatatagatagaatacatacctaatatttatctttttttttttaagctagttaaagtagctggagagatggcttggtggttcagggcactcactgctcttccagaggcccaagatccagaacccacagcttacaacaaaccagctataactgtagctttggggtctccatagtcctcatctgagttccatgggttggtatatacacacccgcacacacttgtgtaaaaaacgtgtttcattttgtttggaagcaaggtctcaccgtgtagagacccacctctgcctcccaagttctgggactaaagatgtgagccagcacacctgaccaaagtgaaatgtttaaagagtcagtaggaggttttcacagatgctggctggacatggacggaccatgtctagaaaaccgttgtgtgtcctccgggctcttcttgggagctgctggctctttagtgaacttccccgctgtaccgccagccagacgccccctgcaagccctggctgcctggctgtgtgcaccagtgcgcagatggactgcgctaagtttagctggtacatgtttgcttttaagcgtgagttaccatctttggagtttgattcccaaacccatggtgaagattttggtcctctgcttgacagactcagttcccggaccccgatatcctcccctccccgaaaccctctttaatgtagcggcatcttttgttcttcatgcgctggggtccgctgaggcccctgtaagtaactctctgtcctcagctgggctttaatggagaagctgttggctgtgacgagaagtccctgtaccctgggctggagtggtctaacctgtgctccacatggccacatccttctgggaccaggggacaagccaggtgcgcagccttctcacgatgtgtgtctcacacaacactatcaaaggttggttttgccttacctggtaaacttggtcatattcgtggcatctttagatgctgtaaaggtggctctcctaacagtgtcacgtgtgtcatctccatgaaatgctcattttgtgttctagctgcttgtgacacttgtacgactttaagttagtagtactgtgcttcagctgccagtcggtctgacgctttatgccaggccaccgatcatcttaactgaaagctgtgagagctctgttggtttaaatacacccagcagcatttcgtaagctctgggatgctgggggcagagggtgcagtcattggctactgaagaattttgaccactaacgcttcatttaagaaatacactgaaggcaccagccagaaatacatttaggcggtggtggtgcacacccttaagtctcagtgcttgggaggcagaggcaggaggatctctgtgaggacagccaggtctacacaattagccctgtctcaaaaagacaaacaagagcaaatttaaaaaaaaaaaaacaaagaaaaacatttaggggtagagagagagctctgtgagtgaaaacactctcttcttgataccctgagtttagtcctcaggacccacatggtaaaaagagggactggcgcccacaagttgtcctccattcacacaccaaattaaccagttagttaatatacaataatcataaacaccgggatgtaattaaaagaaagttagacaaatatttacagggccagagtaatagcttggctcttcggagggcccttcagaggcctgagctttgatccacagcctgcacacgtacgatgtctctccaccatggaactcccggcctggggatctgtgggcactgcacacatgtgccgcacagacatacgtgtgagcaaaacacagaacagtcaaagtaatttcaaaaaagaaatgtttgccttggaaataagagggtagagggtcacattggtgtgtgtatgcctgtgatctcagcacttgggggagtgaaaacaggagttcatggccaccttcagctatatagggagttagaggctagcctgggctacaaaggagcttatctcaaaaacaaaaaacaacaacaaaactcctcaatctctaggaaatcaatgttaactttttttttttttttttttttttttttttttttttttttggttttttaaaaacagggtttctctgtgtagccctggctgtcctggaactcactctgtaaaccaggctggcctcgaactcaaaaatccgcctgtctctgcctcccaagtgctgggatcaaaggtgtgcgccaccacctcccagccgatgttaactcttcaacctagctgtgagattttgttatcgtttcttttcctcccccaaccccctacacctggatttttgtcgctaatggaattgattaaagaaaagaaaagaaaagaaaagaaaagaaaagaaaagaaaagaaaagaaaagaaaagaaaagaagagggggaggaaatgtttgccattctagtttgagcacgtggcatgaacttgtgacccaaggatctcagggtttcaaagcaatgggttgcaggttgtgcaaacctgtctagaagaagccgtagttccgagacccaccgctaggtggctacttactcaccgccgagaaacgtgttgccaaggacaattctttcagtggttttatttttaatacccgtctcagtataataggtttcttctggattcctgttgctttattttagtttgtgctatttatcttcctgtagaagggttctgtgagttttgccaaacgtttggaaaggtgggggacggggagtatgaaggcagggaagaggccaatgtttagcaaaaacaccagttaagggcccggaaatggctcagtccatgtctgccactcaagtacgaggacctgagttcgattcccagaactcacataaaaagctgggcatagcggcagatagtgagggtagacagctcctgagcaacgagactgacctctagccaccacatacacctgcacacctacatttttattaatgaaaaagacatcttaggaaatacattgggctgtaagggccaaatagctgcagacccagcagttcctctgtgcatagtcggtgttcattttctctcagttgccgtgtgagcaccataacctaaggcagtttgaaggaagaaagagcttacccttatccatcccaagtcactgaggaaagtcggggcaggaactgaagcagaaacctggagggatgctgctcgctggcacacctgctggcttgttcactgctggctttcttgtacagctcagactcaccggcctcgggatggtgatgccagggctggcccttccacatcaatcctcaatcaagatattcctcacaggaatggccacaggccagtctgagggaggcagctcttcaagtgagagccccaagtgtctctgggttgtgtcaagttgatgattaaaaactaagcaggggggctggtgagatagctcagtggttaaaaacattgactgctcttccagaggtcctgagttcaagtcccagcaaccacatggtgacgctcaacatctgtactgggatctggtaccctcttatggtgtgtctgaagagagcaacagggtactcccataaaataaataaatagtttttttttaaagctaagcagggacgtggccaggtttacacaactgtgctgcccggcatgcgtgagccctggcttcagttttcagcacaggaagagatagccctgacccaacaagctttatgaatcagcagtggtcggggtttgggccacaggctggtgctcccagctttcggctcagttagcttgcctgatgttagtagcattcaaccatgtgaagtattgtttggttcccaaattgctgttttctgaaatcgagttaacttgatccctgctgcctcttgtcgggtgcattaggcagctcagggtgacgttggccttctaccaaggagtgatgcatgatggtggtctcggaagcctgagagtgagcgtgggtcacaaaccaagccctggcacgtgctgctagatgaacatgaatgtgtcgtatgtgcaacctcaggacctgagccgtgtgtacagtactgctcagaggctgttgccagaagaccaccctgtattgtgcttggcatgactcctaccgtctcagaaccaaccttagacccctactggctgttagctcacttgcctaagcaatcgaagcagtcctggggaaatgcctcagctgatcctagattccacgtaaaaacgtcagccatggggcatagctgtgatcccagcacttggttggcagagacagacggatccttgggactcagtggccagtggggcccagtttgtgaccagattgttgagagatcccgtctcaagggaggtggtcctgggtgacccctgaggttgtcttttttgttttgagtttttttttttttttttccccttgagacagggtttctctgtgtagccctgtctgtcctgagaccaggctggccttgaactcagaaatcctcctgcttctgcctctgcctcccaagttctggaagtaaaggcgtgtgccaccactgcctggttctgagtttgtccttagacctgcacatacacacacttactgcatacatacacaggcgcacacgaaagtacaccgcgctggagaagaaggtccttgcttgatgaccgacctggcagcggttgagtgaataatttgggaaatcacacccactcagatgtttgcagtttcccttcatccttcaacaaacacaaattcaaaaaaaaaaaaaaaaaaccaccaagcagctggattttgtgacctctccccaagtagagaacacagctggcggtaaatgaaaaataaatcttgtgcaataaacacgtctctattaataaaaatctgcaagaattatcctcgggtgtagccatcatgtggggggtgagagggagcctcacgaatgcagcttggcactgacctgttggaaatgtgttactaagtctctgactgacactcagtcacaattcagaaggataaagttgtgcaaccctcagcccccagctagcaaactgtcttaactagaatacagagaaggggctggagaggtggctccgcgcataaaagcattggctgctcctctatggctgctcctctagaggacctgggtttaattcccagtacacaccccaggctgctcacaggagatccagtactctcttctggcccctatgcaaaattagaaatgacatcatttttaaaaaaacaaaaaaacaaaaaacaacgtggagtagatttgtacatcctatctaggacatctaaatggctcttttcaaaaattccgttttttccttctgggttttctaggggtaggggtgtgccagcactcggtgatggctcaggtttggggaccgaagagaatcccaagggctgctgggagctgcaccgaggagggggaccaccttcctgccttggtacaaggcattttctggtgtgcgctttggggggatcctctgtagttgttaacctacctgttcttatggaaactcaccttgtgttgacaggggacgcccccttccagtgctggctctgtagtgccaagttcaaaatcagctcggacttgaaaaggcacatgcgtgtgcactcgggggagaagcctttcaagtgcgaattctgcaatgtccgctgtaccatgaaggggaacctcaaatcgcacatccgcatcaagcacagtgggaataacttcaagtgtccgcactgcgacttcctgggtgacagcaaatccaccctgcggaagcacagtcgcctgcaccagtcggagcacccggagaagtgtcccgagtgcagctactcctgttccagcaaggccgcgctgcgcgtgcacgagcgcatccactgcaccgagcgcccgttcaagtgcagctactgcagcttcgataccaagcaacccagcaacctgagcaagcacatgaagaagttccacgccgacatgctcaagaacgaggctccggagaagaaggagagcggcaggcagagcagccggcaggtggccaggctggatgccaagaagacgttccactgcgacatctgtgacgcctcgtttatgcgggaggactcgctccgcagccacaaacggcagcacagtgagtaccacagtaagaactcggacgtgactgtagtacagcttcaccttgaacccagcaagcagccggctgcgcccctcaccgtagagcaaatccaggtccccctccagtccagccaggtgccccagttcagcgaggggagggtcaagatcatcgtggggcatcaggtgcctcagacgaacgccatagtccaagcggccgcagctgccgtcaacattgtgccccccaccctggtagcccagaccccagaggagatcccagggaacggccggctacagatccttcgccaggtcagtctcattgcccctcctcagtcctccgggtgtcccggcgaagcaggtgccctgagtcagccaactgtcctgctgaccacccatgatcagacggcaggggccgccctgcagcaggctctgatccccaccaccccggttgggacccaggaaggcacgggaaaccagacattcattgccagttcgggcatcacgtgctcggacttggaaggccttaacgctctgattcaggagggaacgacggaagtgactgtggtgagcgatggggaccagagcatcgcagtggccaccacggcaccctctatcttctctacccagcaggaactgcccaagcagacttactccatcatccacggggcggcacaccccgccctgctctgtcccgccgactccattcctgattagtctggagggaggggtgacagacaagacaaactgcgagaggagtactgtgagaggctcctggtcccgcataaataattgtattttatacagtttatgtaattttttaacagggtatcaacgtggagaccattctccctcaagctcttgttgattgtgtcttaatggttaccaaggctgattccaatgtggagttggaattcaccacagtaggactgaatacattcgtttgtttttccatgtttcggatttaatttttttcaactggaataaaggtgtttgggtttgggtttttcatcgtatagtttgtattgtatagtttgtatgtacacagtgtgtgtgtgtgtgtgtgagagagagagagagactgtgtgtgtgagttgggggagcgagagagactgtgtgtgtgtgtgtgtgtgtgtgtgagagagagagagagtgactgtgtgtgtgagttgggggagcgagagagactgtgtgtgtgtgtgtgtgtgagagagagagagagagagagactgggtgggtgtgtaagagagaatgtatgtgtgtgtgagagaaagagattgggtgtgtggagggagagagagtctgtgtgagagagactgagtgggtgtgtgtaagagagaatatatgtgtgtgtgtgtgagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtctaaaacaattgttcaaagctctgagttgtaggctctgtcagtaagtagtgcttgcctaatgtgcaagaagacctgggtcccatcatacacacacacacatacaacccccacggtgcatgcttgtattaaaaaaaaaaaaaaaaaaaaaaaaaaaaaaaaaaccccttccagtagtctgggactaaaggcaggaggatcagaagttcaaggttaacctcaactctgtagcaagttgaaggccaaacagggtcacagaaggaggctggggctaagggatcacactcaggtcttacctttggaaaatgtgaagttcaagaccctgggatcgctgccttctgaatctgtctccttcctctgttttcttttatcctttatctgagtgcaattcttatgatgtcactgtctccactcttggccagaaattctctcttttcatatgagcaaaaataatgactcgcttacttcaaattgggtaaaaatcagaaagccccacagcatacaaggttcgtgggaatccgtttgcctgcttggacctccacctctgggcttctgtcgtgtccctcccctgcacgtccagctgcgttgctgtttctgttttaggaagctgtttagaggagctgcaatccgggggctaaagctgtgttccctggtttttaagtagctcgaatttgggaaggcatattttgtctctgctctctaacgttaatggtttgagtctgaggatgtgacctggaaaatacatggcatttgtaatgacttattttgtgtgtatacaggtggttgttttgctttccaagatggggtttctctgcgtagctctgaccaggctattctcaaactcacatgatcgacctgcctctgtctcctgagtgctttgcaccaccacctccaactttactcagttttattttgtatgtgttctgactgcacgcatgtctgtgtaccatgtgtatgcagtgcctgtggagaccagaagagggcgctgcatcgcctggaactggaagctgtgaaccaccatgtgctgccaggaactaaactggggtcctctgcaaaagcaataagcatgttggtcactaaactgtctctccagcccccaaatctgtcttttataccaaagtgcttccaaagtattttcctgtatggtgattttatgcccactaaaatccatacaattcacaatcctttttctatttgaaaatagtcacaggaagtattatagtgcaggaagaggaggggttggtttcccacaaccagaatggcaaccaatattctgagttagttactgtccgttggtcctttacacacattttctcttaagcaatttatttgtatttttattttgtgtttgttttgcctgtgtatgtttgtatactgtgtgcgtgtagtgcccgtggagaccagaagagggcattggatgccctgggactagagttacaaatgattgccaactgccatgtgggtgctgggaacgaaacccagggcctctgaaagagaggccagtgctcttaatttctgagccacctctccagccagacacagttcctcttactatctggagaaacagctcacagcttaggaacctggggttcatggaggttgtgcgagagagctcagtggtcgaacccctgcctagaatgcacaaggtcctgggttcaatccccaccagcatcagacacacacactcactcatgcatacaaccaaagtggatgtttcaaaccagccttgctgggcatggtggtgcacgcctttaatcccagcactcgggaggcagaggcaggtggatttctgagttcgaggccagcctggtctacaaagtgagttccaggacagccagggctatacagagaaaccctgtctcgaaaaaacaaacaaacaaacaaaccagccttaacccacaatgagcctccataagtgttaactctttccatcctcataggcatgaccactctgacattgctaattagtcctgtccctcaggctaggggcgattgggtcaccttcccaaacctggtgagagcctatgtctagggttcagcaggagatgaatggtcgccttagtctgtttaggagctataatcaattgccatagatggggtgcttacagacaacagaaaatggtctcttgtcatcctaacgaccaggaagtcagagtttgaagcatcagaaggtggacttcggcacctgagccagaactttcctcgcagacatcttccagtgttgtcctcgccccatatttctgaagtctcgtatttattttaaatgattttttttatttattccttgaaaattccattcacgtttaaaatatgccttaagtatatccacacacacaccccctcccatggagtctcctttataagaacacaagcccatccatccagttggaccccatctttgtaacataaacacttccttctcaaaatacgatttttgaagggaaacaaacagatcaagacagacgggacagaagagaaggcagtttaatgacactgagccattgatccagccgcacaaagtgccacccatcccatgcctgctcctgactttgtcccttatccactaagactgttcctttctgctctgttagagtctgtgttgcttagggggtcccagggcaggcattttttgtgtctttttttttttttttttttttttttttttttttgagacaaggtctcaggtagcccaggttgactttgaattctctgtgtagctgagaataacgttgaactcacgatgtccagtgctgcatctcctctgtgctgggcttggactcacagctgtgaggctccgtttcacgggctgctggggactgaacccagggcttcgtgcgtgccaggctagcacgctgacgaccgcgctacatgcccagcccaagcagccacttttaaaaattctttgttattgtgtgggagtttggggtacacgtgtgctactgtgtgtgtgtggcgctcactggacacctttgtggggttggttcgctcctgttactgggtttcctggggcttgggtggcaaagactttttactaaactcctaactatcttgtcagcccccttccccgattattttctttttaatctaataataatgtgcagatgggaatgtagagtggtaaagcagagttctaagcgggtttaacgtttcctaggaaggctgagaaggacctcgcgatcctgccgatccgtgccaatgtggcgctctggggaacttgttaaaactcagattctgatctcagcgcttctcctgtttgaatcccctggggagctggttcagcgcaaactctgggtatggagaagctttctatacatggaccaagaaacctgttcaggaatgtacatacctgcattgctcataattaccaagctggagagcgagcgccctttggctgggcgcggcgcgactcccagtgcagtgtattcacgtactggattatggggggaacgaaaacagactagactgcctgtggcaacatgttgaatcacagacttccagattccggggaaggagggacactcagtgaagaggcaagactgtgcagtgtgtcgtgaggtgatgaaatttgtaagtaaagcttacctccccaccccacccgccccccaaaaaaggaggcagtggaagaggcgggcaaaggagggagaagccgatggatttgttaaatccaagaatgtgccacacctcaaggtaggcggcctctccagggaggtttagtttttgtttttagactgggggcaggggttgccctgaactgacgaagctatcatttttacatgttaccaagttttattgtttaaacttttgaaaataatgtagggcctaaagagatggctcttgagaggacctgagttcagttcccaggacccagatggtgtttctccctgcagcctgtaacttcaagcccagggactctgacaccttctcctgccctccatgggaacctaattcgtgtttgcataccctacacagacatatagacagacataggcgcacagttaaaaataaatatttttaattaaaattttttgaaaaatatttcctgcttgtggatgttttgcctctgcatatgtttgtcctgcacatgcacttggtgaccgtgggggacaggacagacaagggcatcagctctcctataactggagtcaccgatggtgtgagtaaccaaccatgtggatgctgggaactgaacagcagcccatgcccctgaccactgaaccatctctccagccacctctgccttttaaaaagttctttttaaaaacttaaaagattgtgaaacgatttatcccaacatgccagtcgtcagtcaatcacaccctgaatgtgtgtttttttttttttttttttggtctgtctttgtccccagagacaagtcacaggccacctctcgggcctcgcctgcagttcaaagtttcaaagtgtctctaaatacgcgtgcaaactctgtgttatgctgcatgccctattgcgtgtgtattgacatgcatacgtagggtcacagcagcgtcccacacgtcttgacctttggatatcccacttggtacaacctgaagcattttcagtatctgtgaatatagaaacctgctagttctgtgttctcctaaatgtatacgggctgcagctggtgcagaaataggtgagttctgccactcagaagattaatgtcatcccatgcttgtttgcttcgagtgtgtttccatgggaagacagtgtcttgtctagttagagtggactgagtgctcactattgctggagataagtgtaacacgaatcctatcgttatcaatagttagcaacatgtagaccacggcctcggtagcagacatcatctgtgcccacacataaggttgctcatcaccgtcccccaactgtagcgtcatcgctgtttcattgaggagaagtgggaagcaactggcggctttcaaaagaccacacagggctggagagatggcccagtgtgttgggtttggggtggaagccgagaaagtcgattcaggtgccgaaacttaaaaacgaaagcttcgttttctgagcactcagggagatggccagttctggatctgaagggagactgtacaatgtttttttaaaaggatggaaacacagagcgaggggtgagctgcagtgtttgccagttgtgttttgccatttatgggttaaacaagggagcacccattggagactgggctgtatccagggactgggctttagggtccttaattcattctcctagacattaggtccacagctcatagtgatatgcggacaagggatcgggtcagctatatgtagataattagggcatacaggtgattggctatgtattcttttataacttatgcaccttggtttagataatagcgatttctatattctttactggttaacggacaattaagaaaacatttggagaagtgggataggtgttccttcctaggcctgagaatatgagcttgtttaaccctgtcagcaggatggagaagctgtccctgagatgtcaggactcagacaaccgtttgcaacagacgccgttcagctgtaggggggtccccagctcccctaggtcctcggaccgtgagtttagtttctccctatgaggactggagtctgaaatgaaatagtagtatttagaataactttcttttgcttgttcctaacaagtggtaggagaggctgttctgcaagcagaagggttccctgtacccacataaaaagctaggacctgcaaccccaacactgggggagagaccgattgaccagatggacggttgtttgtttgttattaatttattgagagacccagtctcaagacaagattgtcaagggtgataaaggacgacactgggcatcctgttctggctccacgtgctcctgagtgcgtgtgaatagtcacacactaaggtgtatgcaaaacacatgcgcacgcatgcggcatcctgttctggctccacgtgctcctgagtgcgtgtgaatagtcacacactaaggtgtatgcaaaacacatgcgcatgcatgcgcacacccgcgcacacgccacagagggaccaggtacatcttctcgtgagtcagaggtgtactgtgtaacttggattttgaaaagtcataggatcccagcatttcactttgaccagctgctcattccacaagatgccttgactgactatgtgaaggaagtgggcaggcagcctgagagcctttgaagaggaaggcgatagatctgtcctggaggaagtaacccctgaagtggtccagagtgcgtaaatgcaggcttgggaagggaagagcacagtgtcaccttaaagaggacacccccacccccaccccacccctgcagcttggctgtcatctcaaaaccttcagggcttcaaagtgacttccttttcagttgaatttgcaaaagctcctaaggttcaaaacttacagtttctgaccggcctcagtggggaagagccgggaggggggcagggattgttccttcgaggacctgagttcagatgcaagcagtagtgccaagatgggcatgttccatgcacaaatctgtaactgcagccttgaggagacggagatggagacacagatggactgcttgctggctggcctagctcgggttcagtgaaggcccagtgtcgagtaaatgaggtagaaagtggcagagcagaacacctaatgtcctcctctggcctctgaccgtatgtgcacatgtatccccttgtgaggatcaccacacacacatacccacacactcctcaaaagttatcagctagatctaaccacacaaaaaacccagctgacgtgaaaactggagggaaggtgacaaccgtggttccctaacacaggccctgcctggggtttctttcccacaatttttagtcatggttcttgaaatcatgaactcagaaataagattagtgattaacataggagtaggactttgaacaggtgtcaagcaggcttgtaatcccagcactgaacactgaggcaggaggatggctgcatgttccaagacagcctgggatagatagggagactcttattggaagagagaggagaggaaaacagataggaaaaaaggaagaaaggcaggcggacagacagacagacaggctagaactttaaataggtactttgtaaaatagtacaacctagacaccagatgtggctacacatacccttaaagctttttgttatttttattttatgtatatgagtgtttctcctgtacatgtctgtgcaccagagtttctggtacccaaggaggccagaaggtatcatcagatcccctggaactggagttacaggtggttgtgagccatcagtaggtgctgggtattgaacccaggccctctggagaagtggccagtgctcttaactgctgagccatctctccagccctggtacacccagcatcacctagacacccagtctaagtgaactggccactgggaaaccaaagggcacttttttcttgtcactcgggaggcaggggcagatagatctcatggaacttaatcaaggtgagcctggtctaggtctagattgtgtgctccagtccagccagggctagagaataagaacctgtctcaataaagaaagaaacgagtactaatcagttcttgccctattgttggtgaaaaatataatttccgttttattctttgttggaatcctagatgcaggggaaatgcaaatcatgatggtactgagagactgtttgcattgatatgggtcccagaattaaaacagttggtcagactgtgtgtgggagatgacgtcaggtcacagtctcctctcccatgctgggatggagggacatcggcatgatcatgttctcaccctctgttccgacatactcacgtggcacttgcattcactcgggagaaaccaggacactcctggggaagatcacgtatgcaggcagcccaggctacaccagggcacacctggcagcagtacagctgcccaggagaacaaagaatacattatggtgcttttgtcccatgattatcctacatccctcaaatggatgaacagtggcaataatctgagagatccagtgggacatggtggcacgcgcctttattcccagcacttgggaggcagaggcaggcagatttctgagttcaaggccagcctggtctacagagtgagttccaggacagccagggctacacagagaaaccctgtctcgaaaaaccaaaaaaaaaaaaaaaaaaaaaaagaggaaaagggattcctcggtcctgtgagatggtttggtgggtgatgagctggcccatggtcaagtataatgtggtttcaagtatctctgaggtcaccctcagtgtaccccttttcaagtttctgagagggattttctgttcccagcttcttcttgatcctgagacaatctgggagacactaaaccagagcatatgtgtatgttcaaatgtctgcgtacagggcagggagcaggggttagggtctagtaggcacccactaaccactgttctgacaacctgacttgggttcctaggacccatggtggaaggagaaaactgacttccataggttttcctctgacctacacac

SEQ ID NO: 1022 - DNA, 2415 bp, Mus musculus
gactggctggtgcgggaaatatgcaggagaaaagtctttgcataatgtagagcgagccgtggggctccgggagcggcgccccaaggtctggggccatgaacgcgagcgtggaaggagacaccttttctggatcgatgcaaatcccaggaggcaccacggtgctggtggagctggcaccggacatccacatctgcggcctctgtaagcagcacttcagcaatctggatgcctttgtggcccacaaacagagcggctgccagctgactaccacgccggtgacagcccccagcacggtccagtttgtggcagaggagacagagcctgccacccagaccaccacaacgaccatcagttcagagactcagactatcacagtttcagctccagagttcgtctttgaacatggctaccaaacttacctgcccacggagagcactgacaaccagacagccaccgtgatctctctccccaccaagtcacgcaccaaaaagcccacagcaccccctgctcagaagagactcggctgctgctatccaggttgccagttcaagaccgcctatggcatgaaggacatggagcgacacctgaagatccacaccggtgacaaaccccacaagtgtgaggtgtgcgggaagtgcttcagccggaaggacaagctgaagacgcacatgcgctgccacacgggcgtcaagccctacaagtgcaagacgtgcgactacgcggcggcggacagcagcagccttaacaagcacctgcgcatccactcggacgagcgacccttcaagtgccagatctgtccctacgccagccgcaactccagccagctcaccgtgcacctgcgctcgcacacgggggacgcccccttccagtgctggctctgtagtgccaagttcaaaatcagctcggacttgaaaaggcacatgcgtgtgcactcgggggagaagcctttcaagtgcgaattctgcaatgtccgctgtaccatgaaggggaacctcaaatcgcacatccgcatcaagcacagtgggaataacttcaagtgtccgcactgcgacttcctgggtgacagcaaatccaccctgcggaagcacagtcgcctgcaccagtcggagcacccggagaagtgtcccgagtgcagctactcctgttccagcaaggccgcgctgcgcgtgcacgagcgcatccactgcaccgagcgcccgttcaagtgcagctactgcagcttcgataccaagcaacccagcaacctgagcaagcacatgaagaagttccacgccgacatgctcaagaacgaggctccggagaagaaggagagcggcaggcagagcagccggcaggtggccaggctggatgccaagaagacgttccactgcgacatctgtgacgcctcgtttatgcgggaggactcgctccgcagccacaaacggcagcacagtgagtaccacagtaagaactcggacgtgactgtagtacagcttcaccttgaacccagcaagcagccggctgcgcccctcaccgtagagcaaatccaggtccccctccagtccagccaggtgccccagttcagcgaggggagggtcaagatcatcgtggggcatcaggtgcctcagacgaacgccatagtccaagcggccgcagctgccgtcaacattgtgccccccaccctggtagcccagaccccagaggagatcccagggaacggccggctacagatccttcgccaggtcagtctcattgcccctcctcagtcctccgggtgtcccggcgaagcaggtgccctgagtcagccaactgtcctgctgaccacccatgatcagacggcaggggccgccctgcagcaggctctgatccccaccaccccggttgggacccaggaaggcacgggaaaccagacattcattgccagttcgggcatcacgtgctcggacttggaaggccttaacgctctgattcaggagggaacgacggaagtgactgtggtgagcgatggggaccagagcatcgcagtggccaccacggcaccctctatcttctctacccagcaggaactgcccaagcagacttactccatcatccacggggcggcacaccccgccctgctctgtcccgccgactccattcctgattagtctggagggaggggtgacagacaagacaaactgcgagaggagtactgtgagaggctcctggtcccgcataaataattgtattttatacagtttatgtaattttttaacagggtatcaacgtggagaccattctccctcaagctcttgttgattgtgtcttaatggttaccaaggctgattccaatgtggagttggaattcaccacagtaggactgaatacattcgtttgtttttccatgtttcggatttaatttttttcaactggaataaaggtgtttgggtttgggtt

SEQ ID NO: 1023 - protein, 691 aa, Mus musculus
SEPWGSGSGAPRSGAMNASVEGDTFSGSMQIPGGTTVLVELAPDIHICGLCKQHFSNLDAFVAHKQSGCQLTTTPVTAPSTVQFVAEETEPATQTTTTTISSETQTITVSAPEFVFEHGYQTYLPTESTDNQTATVISLPTKSRTKKPTAPPAQKRLGCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKSTLRKHSRLHQSEHPEKCPECSYSCSSKAALRVHERIHCTERPFKCSYCSFDTKQPSNLSKHMKKFHADMLKNEAPEKKESGRQSSRQVARLDAKKTFHCDICDASFMREDSLRSHKRQHSEYHSKNSDVTVVQLHLEPSKQPAAPLTVEQIQVPLQSSQVPQFSEGRVKIIVGHQVPQTNAIVQAAAAAVNIVPPTLVAQTPEEIPGNGRLQILRQVSLIAPPQSSGCPGEAGALSQPTVLLTTHDQTAGAALQQALIPTTPVGTQEGTGNQTFIASSGITCSDLEGLNALIQEGTTEVTVVSDGDQSIAVATTAPSIFSTQQELPKQTYSIIHGAAHPALLCPADSIPD

SEQ ID NO: 1024 - DNA, 60500 bp, Homo sapiens
cgttgatgcattaactatatgaaagaacaacaaaaaaatcaggcctgtgcatgcttgcttgtgtgaaattatccaagcaagtatattattaaaacacaggtgtgcacactcagttatgtgccaggcaagactcaaagccagctctcatcaaaatgattgattgtgtaactaccacttaatgcccagcaggtttagtctggatcatatctcattacagagagtttagcacttaagttaaatttcaagggtttcttcattgtcttttatgtttacataaaggattgcaggcagttgctaaatattgttagtgaatcaatttttggaagagaaatttcccttagtccccttccaatatttgggatcaggattcagtgacagtgacatcaggaggagctcgctggagtcacctgaggcatctctccatgctgtgcatgtctggaccagaggccccaagattctgtcccaggccccctagatggtgcccaagcatatgtgtcctcaacaagttcccttaaaatctgaggcacactccaggtaagaatcacccgtggtgtgtccagaaaagcaagaataaaagtataatccttgcaaactttaatacagctatgtcagtcagggaccaaccagagaaagagaagcaaatctaacaatttcagtaaatgtaacacagggaatttgatatccaagtgatgcaagagctgagaaaccaaatgggaatggttaggcaacccagagattagcaacacctggaagccactgccttttctctccagggaaggtggcagggagagagacaaagggaggaggtggtgttttcagggaccacagtcacccggcagaaggtgaggccacagtgggcccatcctataggatctagggccatggaggagacacagccactgccaccaagatagacggggaagaggagaaatactctgccttctcccttccacccctcagccaaaccctacaggaagctagaagcccccagaaccctggatacaagaaacaagggtcagcgtccctgacaaatagcagaatcaagggaagaatcacagagcaacagcctctggaccagaccaccagccttcgataaatttatcattgaaaccttagccacaattttctgtagtactttctaagtggagaggttgtcgacataagtacttttgaaaatgccaagccccaggatacccattgttgttagcccttgtctagaaaaataaaggaggtttaaaaataccagttatcataaagtctaaatggaatctataatttgctctattctgttattaggtcacatttttctccgtgtgtttactaaaaaggaaaaaaatgttttcctgtaatagttaaatgtttgctttaatagttatattctgaagccatcttgacaaaaggcacattcattcattcgtcaacatatccgtccaaccttttctaaataccatgcattgttataggtgctggtacacaaagaagaaaataaaatttcctgccttgagaattgacattttactaactatgaatgattactataggaaactatgtatgttaaaatactgttgaaaaaattttggtcacttgaaattaaaaactacagacgattcctaatgtaaaatagtacagttgatgattgttcaactttacaatgggtgtgaaagtgatacccattcagtagaaacccatactttccattttgattttttatattttcctgggatagcgatattcagtgtgatactctctcatgctgctgggcagcaccagtgagccattctgtttttcactttcagtacagtatcaaataaattacctgaggcatccaaccctttgttataaaataggcttttttattttatgtatgtatggatgtatgtatgtatttatttttgaggtggagtctcactctgtcgctcaggctggagtgcagtggcacgatctcggctcactgcaacctctgccttccgggttcaagtgattcttgtgcctcagcctcctgagtagctaggactacaggtgtgtgccaccacgctcagctaatctttcatatttttagtagagatggggtttcaccatgctgtccaggatggtctcaaactcctgacctcaggtgatccacctgcttcagcctcccaaaatactgagattataggcatgagccaccacacttggccaaaataggcttttgtagatgattttgcccaaccacaggcgaatgtaagtgttctgggcatgtttaatttaggctagactaagatagggcatttggtaggttaggtctattaaatgaattttcaacttacaacatttccagcttacaatgagtttatcaggatgtagcaaatcatacatatgctgaacagcatctgtatattgttaggagaaggatatatttgctcgaaaacttacagtaattaattcagttaatatgtcctcattattcttgttatcaacattaccagacccccccctccaaaaaaacctgcgtgttctcttaatactttaagaaagtatctgaatatctcttgccagaaataatttaagcaagtgaataattctaatagattgattttaaaatactgtgaaaatctgttctacagtttctgttacttgccatcagtgattcttatttatttatttatttatttatttatttaaatttagagacagggtcttgctctgtcatccaggctggagtgcagtggtgccatcacagctcactgcagcctcaaccttctgggctaaaggaatcctcccatctcagcctcttgtgtagcagggactacaggtgcatgccaccgcgcccagctaattttgatattttttgtagagacagggtcttgccatgttgcacaggctcgtcttgaactcctcgcctgcttctcgaagtgctgggattacaggcatgaaccaccatgcctgaccaaagattcttaactaacgtacttttattggtcttttgcctgaagaaaatttatttaggctttatgagactcagtttctgcatctatgaaatagtgataatagtgtctacctcttgactgttgttctgacagtcaagaataataaattacatcaggcatccaacactttgttataaaataggtatccaacactttgttataaaataggcttttttatttttttattttatttatttggacatagtggaggtaatgtaagtaacttagtgaagccttttagttaacagaaacattgaaaccatggagacggagaagttctttttttctatcagaaacatgttacaaattttggttaaattcaacatggctcacagaggcaacgaatgatggaaactgattctcagccttgttatcaagaataacagggaggagtggggactggggtaaatcagagaggctgggcttcatccacaggagcttctccggcccagccaagggttaccatttgacagtccaggcccagatttgccagatccttccatttttgcaaaaagctataaatcccaattcttatgagaaatacatcaacttttaagcactggtaacaaattcaagtttattttagttgccagatttagaacatggagtaggattaccagtatgtctgcaccctgcaagacatttgccatttctatattatattttatctattaaatgagaagtggtcaaaaacttgagaacagaagaaatcgtgagctttctagtcaaacaaaggctgttaacttttcaagaactgtgattcttactgagaaatagatctggatagaatccacattgaaataaataatctgaaaaaaggaagaaaaagcccttccacatggtgttgaaacaagttattctggcagctcttcaggatggctggcatagagaaataatgtgttcgcacgggccaattaaaaaagctactatggtgtattacttatgatatctaaaaaatcattaacagcagggctgtggctgacgcctgtaatctcagtactttgggaggccgaggtgggcagatcacaaggtcaggagttcgagaccagcctggccaacatggtgaaaccccatctttgctaaaaatataaaaaattagcggagcgtggtggcacatgcctgtagtcccagctacttgggaggctgaggcaggagaattgtttgaacctgggaggcagaggtttcagtgagctaagatcacgccgctgcactgtagcctgggtgacagcgtaagactccgtctcaaaaaaaaaaaaaaatcattaacaaacatccagtaacatagcaaataaattatgatgcaaccctataatgaaatattatgtgaccattaaaactaatggtagggagcagaggtttgcaagcaccaagtgctgattgaacaacccaaaaagtctgtcaagcatacagatacccaggcctcatcccaatccttctgaaggagaggggttaggatatttaataatttctcgggtgattctaatgcaacccaccaaatcaagatcaaaagccaattgtggaatagtttgcatagcattgtgttagaataagatttgattcaggtgcatgtgaaagaaacattcccccaccccaaataacaatagctgaaaaaagtgcatttctcatatatgatgtctggaaataggcaatccagttggaagttccacaaagaagttaggggcctgggctccttccagctctctattctgccatacctagagtatcgcctcattctcatagtccaaaatggcagctggagctccagccatcatatcctcatcccaagcaaggaaaagaggaagagctaaagaagaagggacaaacagcatatgccaactggtattttaggatatttcccagaagctgcatcacatttcatttacgttgtcagaatttagtcatatagccatgcgtagctacaaaggaagctgggaagagtctcttttcaggaggccatgtgctgagctataaattaggaattgtattattaaaaaaatttgaggccaggcatggtggctcacacctgtaatcccagcactttaggaggccgaggcgggcggatcacaaggtcaggtgttcgagaccagcctggccaacataacaaaccctgtctctaatagaaatacaaaaattggctgagagtggtggctcacgcctgtaatctcagcactttgggaggctgaggcaggcggatcacttgaggtcaggagttcaagaccagcctaggcaacatggtgaaaccccaactctactaaaaacaaaaaacaggctggtggcaggcacctgtaatcctagctgaggcagaagaatctcatgaacccaggaggtagaggttgcagtgagctgagattgcaccactgcactccagcctgggtgacagagtgagacttcatctcaagaaaaaaaagaaagaagtataatattaatgttatgagtacatattggtttgaaccatataaaattaccatttttaagtaaaaaataaatatatcagcaattcatatggttcattctattacatttctacagaaaaaaagcctataaagatatagacatgtagtacataaagatataagtatatatctctggttggtgagatctcagatagccatgtatatttcatgtggaggtgaaaaacatgtaagctgtaattacatttttataaaatatatgaatatgatttatatgtgtgtgtatgcacacatacaacacacacacaaaaattcatcaatcaaaatgttatttctgcatagtgaattataagtgggttttattttcttatgttttcctgtatttttttttcaaattctaaccaacaatttctaatacttttgcaataagaaaaacaagtatagggcaagtgcagtggttcacacctgtaattccagcactttgggaggccaaggtaggcagatcccttgaggccaggagtttgagaccagcctggccaacatgatgaaaccccgtctctaccaaaaatacaaagaaattagctgggcgtggtggcacacaccggtaatcccagctactcaggaggctgaggtgggaggatcgcttgaacctgggaagtggaggttgcagtgagccaagatcgcaccactgcactccagcctgggtgacagagcgagactctgtctctaaataaataaataagagtgtgttgatcttgatggagcttatgttgaaaaataacattttttaaaagtatagaaagaaaaataagaaatgaaaataggacattttcagaccagaaaaagactgttgcagtggtcaagatgtgtaatagagaaggttggctggacatagtagcaaaaggttaaaatggagctcatggaaacatgcatgaaatcatttcacaataaaaaatgaactgaggatgcctgcgtgccaggctctgttctaggccccagaggatacaggtaaataaaataggccaggtctatgccctcctggagcttacatggtagggagacagataataaccaaaaataattaaaagataataatagctaggatttatgccgagttatatgagtcaggcactattctaagcactttacagatattgattggttcctcctacaaaacagcttaatgaactaggtgctactattatctccaagctacagaaaaccgggacacagagcagttgaatttcctattcaaggttaagcaactaatcctagttcagcaactccaggatttgcatggcagtggcatagcctaactccagggcctacacacttaaccaccaaaccagtaaggcccagacttacatcatgataagaattacctggggcacttttgagatatttgcagattaccaagtcttaccccagaaaattctgatgcagtaagcatggcttggaacccaagaactcattctttagtgagccttccagatgatgcttctcttcaggcaaatgtgagatatattgctctcaacaaaaggaatcgtgacaataaaagttagaatggtgacctctgcaagattggatagtaggaatagtattattttatttatttatagttttttgagacagtctcgctccatcacccaggctggagtgcagtggctccatctcagctcattgcaacctccgcctcctgggttcaaacaattttcctgcttcagcctctggagtatctgggattacaggtatgcgccaccaagcctggctaatttttgtactgaagaaaatggggtttcactatattggccaggctggtctagaactcctgacctcaggtgatccgcccacctcggcctcccaaagtgctgggattacagacatgaaccaccttgcctggccagaatagtattattggctgggaaggtgcatgagggagccgaccagggctggaaatgtgtgtcttggaaggggacttcccaggtgtgcacatatgtaaacattcatcaagcaataaaaaataaatattgccgtaagctgcggtgctctgctgggtcatgttagctagacaggtatcatgaaggtgatgtcgcagagtcgcagggagagtgaatactttaggtaagacataggaaaggtctctctgggaaggcgacatttcatttgatgctggatgacctaaaatagccagtcctgcaaagaccaggaaagcaatccaggcagagggaggagcaacaacagcaaggagcctggtggagctgcctgggcaatgcagggtgagagtggtgtgatctgcagtgggactggcaggccacagccagttacatctagctcattcctgccccagggtttttgctcccaccagttcctcaggctggaattgctcccccctcatcctcacatggctgcatcctccccggctccttgttcagatattacctgctcggaaaggcctgctatgaccagttctacagccactattacagccccattttatggtctttggagcccttatcactagcaaaatgttgagaacacatggacacaggaggggaacatcacacaccagggcctgtcagggggtggggggcaacgggagggagagcattaggacaaatgcctaatgcatgtggggcttaaaacctaggtgatgggttgataggtgcagcaaaccaccatggcacatgtatacttatgtaacaaacctgcacattctgcacatgtatcccagaacttaaggttaaaaaaaaaaaaggaagttttatatatatttttttatatatataaatatataatatataatatataatattttatatataatatatattgtatatatttatatataatatatatatacataaatataaatatatattaaatatattaaatattatatattaaatatatatatatttacagtactgatttgattatttcatgttgactgcctccctggtctacctccagcggctagcccagtgcctggcacttcacaaacacttgagaataaacagctgctgcaggcagaaaccaagccttagaggcagcagcagggaaaatcccattcattatacaagccatatttactaagcctactatgtgtcaggcaccagccaagtcactggactacatcagtgaagcaaagagatttttttaatccccatttttacagggacttactgaaaataagggggaggagaacacagataatatacaactaaattatatctaagcagatatactcgagatacataatatgttccatctaacaccttttaaggacaaagcaggccaggcatggtggcttacacctgtaaccccagcactttgggaggctgatggaggatcgcttgaggccaggaattcgagaccagcctgggcaacatctctacaaaaataaaaattaaaaagtgagccagggtggtggcccacgcctgtaggggggattgcttgagcccaggagttggaggctgcaatgagctaggatccgaccactcttccagcctgagagacagagaaagaccccctctctaaaaaaagaaagggagaaagagagagaggcagagagagagaaagaaagaaaagaaaagaaaagaaaagaaaagaaaagaaaagaaaagaaaagaaaagaaaagaaaagaaaaagaaaaagaaaaaaacaggaaggagacagggagtggttgggggaggaggagggggctgcaatattagaatgattagaataggccaagcatggcctccctgagtgtgaatttgaatgctgaccttcagaagcaggacagactctatgggcaaatccctcgaggctgggagaggtctgaggcttgggagggtcggcagagagacaatagggctgacgcaggagcccgggggagacagtagtagtaagacatgagggacagagcagagaggtcactgtcctcagagtgtggacgccgaccaacactaggggcatcacctgggaacttagaaatgctcgttctcacgcctcgccccagacctactgaagcagaaacgctagggtgggcccaacagcgtgtgttctaacaagcctttcaggcgactgcgatgcacgataaagttggcagctcctggagcaggggtccctccgcgctacgaccccacctcttcgcggtcctctcagtctccctagcggggcaagggacccgcccagcgctttgctgatttgcccagcgctcacgcccaacctgggtttctccggagctcgccgcgccccgcgcacccaccccgcaacggcagccgcacgtgggtctccccgcaaaccacccaggcgtcccgggagcagcgctgctgcacggccgcgctgggggcccaacgcctggggttgcaggtgcaaaaggcgccccgagccggggaggccaatcgcgtccgcggagaacgcagagtgcgggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaagtaagtgcttttccgggagcagtgcgcgctccggggcccagtgcgcgctccggggcccgggcccaagcacgtctgcgacgcagccagcaggcccggggccccgaaatcggggtgacggctcggagccgcgtctcggggaccgcggcgggcgcgctgtgcagggggcgccggagtgggcttggggtgggggcgcacccgacctggcgcaagaccgggggcgctctccagccttgcgagaccccttggaagggaacagtgggggagggcacgccgttcagacaatcgccaccccctaagggcattcccgccccatcaggcggagtttggggcgggcaggagaaagggaggaatctagggtaaacggggcaacactgatgggaaaacttctgcctcagtggctcaaaattagagcctggagattgggggaatcaccaggtctcacgaggtcctgccggctcattgcaaagccttttcctcattaagggtggagatctgaatggaaaacggggccgtggtcgctttatttgggtttggggttcagtttttatttaaccgaggaggacatcagcgtttttcaagtccctggtttctcccggtgcattgtttcccaaagtgtggtccagagactgagtgcaaccagccacctgggagcgagagcgtgtattttaaaacagctttctgggccccacccattcaatctcgggggtggggctggggatccgctgtcctttgtagctgcctgggcaactctgaagcacatgaagtttgagaacccatctaccaggggtttgcagaaaatctggcacatagtaagctcccagcttgttagctgctactgttaacagtttgggagacactgggtcccaaacttggcggtgtattccttgcattactgtgaaaagcacagattttcctaaacaccatcctccccaccccaccctgttatgactcagtatctcctaggtggggctcagatatgtccatgtttaaatagtgtacctcagtaagaacccagcaggtaacatgctgggggactggcggggaggggggactgtgctggtacgagcaccatcccatttaattctcataacaagcccgtgttttttcttggagaaattaaaaacaaacaaaaaccatggattagaaacctctcctcccatttttcagatgagaaaacccacgcttaaagtcactgttgttaagcgacagtgtcaagattctaacgaaggtctatgtcgttacttttgcactttccacataccagtgacattatctgttatgaaaatcctttcattctgggtgtcagtcctattccatcattaaggaatcgtcagcaatgcaagctacttcatgtctcacttccttgtttccttgttagttccatgggtatctcagtatctgccagagaagaaaaggtttccttccttccatccattgattgcaaagtgcttaagtgtatccctgcaagatggcttatcacagtgctcagcccagtctccttagcaagtcaaccaaactgtatttctgaacagagatttcttgtcttagctagacctggggaaaattggacataatgtaaatatcttacaaattttcagaaaattatgaggcataattttatctaaccatatatgcacaaaggtagtcttgtatcatttaacttgggaaaaattggaaattatgtaaataccttattgttgctgagaagattatgacgcatggacaccatggaataatgtattgccattaaataatcatatatatatgaagagattttaatgatatagcacaatgtttatgcaatgtttaggaaaaagggccaggcacggtggctcacgcctgtaatcctagcactttgggaggctgaggcgggcggatcacatgaggtcgggagttcaagaccagcctgaccaacatgaagaaaccccatttctactaaaaattcaaaattagcctggcgtggtggtggcgcttgtaatcccagatactccggaggctgaggcaggagaatcgcttgaacctaggaggcggaggttgcagtgagctgagatcgtgcccttgcactccagcctgggcaacaagagcaaaactccatctcaaaaaaaaaaaggaaaaaaattaggaaaaggattagttttacaatactatgatctgaatatttacaatattatgatcttatgcaattttttttttttttgagatgaagtctcgctgtcaccaggctggaagttcagtggcatgatcttggctcactgcaacctccacgtcccaggttcaagcaattctcctgcctcagccttctgagtagctgggattactggcacgtgccaccacacccagctaatttttgtatttttagtagagacggggtttcaccatgttcgccaggatagtcttgatctcttgttgtgatccacccatctcggcttcccaaagtgctgggttacaggcgtgagccatcttacgcaacttttaagtgtaaagaaaatgaatggaaaaaaatattttataatattcatggtaggcagagatggaaatattgagtgattttccccttctttataagtttcttctaaattttcttataaacacgagttatctttttttttttatgtgagacggagtctcgctctgtcgcccaggctggagtgcagtggcacaatctcagctcactgcaacctgcgccttccgggttcaagcaattctcttgcctcagcctctctagtagctgggattacaggtgtgtgccaccacgccgggctaattttttttgtttatttttagtagagatggggtttcaccatgttagccaggatggtctcgctctcctgacctcatgatctacccgctatgtctttattgaacaagtatttatatagtagcttctaatacagtgccaaatactacactaagtgctttccaggtattaatatagtattaattcttgatatgattagtatcaagaaataatgtcggccgggtgcggtggctcactcctgtaatcccagggagggatttgggaggctgaggcgggcagatcacgaggtcaggagatcgagaccatcctggctaacaggtgagacctcatctctactaaaaatacaaaaaattagtcgagcgtagtggcgggtgcctgtagtcccagctacttgggaggctggggcaggagaatggcgtgaacccgggaggcagagcttgcagtgagccgagatcgcaccactgcactccaacctgggtgacagagcaagactctgtctcaaaaaaaaaaaaaaaaaaaaaaaagaaagaaaaagaaataatgtccctgccagttaggaatgaattttggctacaagtagcagaaacccaaattatactggcctaatgaaatctggaattgattgattgcagtgttgaatcagggaaatcagtgaagtaaagggcagagcccatagggatcttggcatttttctcatagttacaagatggctgcagaagccccaccatcacatttgcatccaaagccagaagaaaaggggcacattgctagccacatctgctcccttttcatcacaaatgccaaacttttcccagaaactcctccagctgtgtgctggagaagttcacaagtatgtagaggaccaagattatttagactattggttctcatagtatgtgttttgggtgagtatgtttggaaatgtgcgggaggatcagttttcacaattaccttttagttgggataggaggtggctgctggttctgcaaagtgcaggacatcccttttatctttgataaaagaactttcttgcaaacaatgccactagtgccccatgggtaacaatgcagcgtgaaccatcacatggatggttgctatacattatttccaattttccccaagttaaataatacaagactacctttgtgcatatgtggttggataaaattatgcatcataattttctgaaaaaaaaaattattttttttttgagacagagtttcactcttgtcccccaggctggagtgcaatggtgtgatctcagctcactgcaacctctgcctgctgggttcaagtgattctcctgcctcagcctcctgagtagctaggattataggcacacaccaccatgcccagctaatttttgtatttttagtagagacgggatttcaccatgttggccaggctggtctcgaactcctgacctcaggtgatccgcccgcctcagcctcccaaagtgccaggattacaggcatgagccaccgcgcctggccaattttctgaagatttctaagatatttacattatgtccaattttccccaagtttaactaaggcaagaaatctctgtgtggaaatatgataccttgctgctagggcacaattaggatgcagttcgcaggaagaggaaggtggagtggatactgggccactacccagccatgtctgccaccatgccttttcttcctaccatgaatctggtctgcattacaattcaaagctgtttggaattaatccgttactttccctttgtcccatggagttccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggtacagctggagcatgggggagtcggccagaattggcctggctgtgtctcaaacacgtccatggaacttgttaaaaatatagattcccagagcccaccccctagggttgctgattcattatttttaacaagctccaccaggaagccagctgcccagccaggtttgggagctgctaggttaaaacattaactgttagcagttataaatgttgtcacgttacaaaaaaaacagacaaaaaagagatttctgaaacaaaaatctatatactataggaaaaaaaaaaggctggcagaaaatacgttgcaataaaaaaaaaagtggttgttttgggtggtggaagtatgggtacaatccttgagtttgcattacttgtgtaaagggccaaaaagcatgttgttgttaaaaaaaaaaaatctataaactggcattggtatctcctcccccttgtgctgctgatcaggaaaacatccctgttctctgttgtgtacactcattccaccaaaaataaattacagatgggtcaaaaatttaaatgtgcataagaaaaccataaaagttctggaggaaatgtacccacaaacacctacacacacagttatacccctgtcttaaggggcaggaagataactttaaaattatgaagtagcccatttatgggatagtactggatcctgtagggaaacagagaatgtattccttagctaaaggcatttgattctaaaaaatatattaatatgcctaccaaaggaggcaggttgtggaccaccccctccaagaaaaagaatcatatatgtgattgcaaatgaagttttactttttccgaagtaaaatgcaaaatctaaagacaatcaacttggggaaaaatttgtggcatatatgattaaggcctaaatccctcttatacaaagaactgctaaaaccagtaaaaggagataaaaagtgcaaagtggagcctggacacggtggctcatgcctgtaatcccagcactttgggaggctaaggcgggtggatcacctgaggtcaggagttctacaccagcctggtcaacatggtaaaaccctgtctctactaaaaatacaaaaattagccgggcgtggtggcaggcgcctgtaatcccagctactcggggggccaaggcaggagaatcgcttgaacccaggaggcagaggttgcattgagccgagatcgtgccatcgcactccagccttggggacaagagccagacttcgtctcaaaaaaaaaaaaaaaaaaagtgcaaagtggaaaggtcagtggatgatttacaggggaggtttggtcaccttagtaattacaaaaatgtaaatcaaaacaaggcttgaggaaggacactgatttcattttctggggatataaattcttataaccagggcaattttgtgatagctttcaaatcttaaatttaaaatttcttagttttaaaatatacataaagacatttatccaataagtctacagctaggtattcattctataaaacttcatgaacaggccaggcacggtggctcatgcctgtaatcccagcactttcggaggccgaggcgggtggatcacctgaagtgaggagttcatgaccagccttgccaatatggcaaaacaccttctctatgaaaaatacgaaaactagcccagcgtggtgtcacgtgcctgtaatcccagctactcggaaggctaaggcaggagaattgcttggacctgggaggcagaggttgcagtgagctgagatcgtgccactgcactccagcctgggcaacagagtgagactctgtctcaaaaaaataaaaataaaaaacttcataaacaaatgtacaaggatattcatttacagcatgtactatagagaaagtggagcctttgtatgtatacgtcaagagagagttaggtatggccaggtgcagtggctcacacctgtaatcccagccctttgtgagggcaaggctggaggatcacttgaggccaggagttcaagaccagcctcgtcaacatagcaagaccccacctctacattaaattttaaaaattagccaggcgtgatagcacacacttgtagtcctagctgctcaggaggctaaggcaggaggctcgcctgagcccaggagtttgaggctgcagtgagctatgatcgtaccactgcactccagcctgggtgacaaatgagaccctgtttcttaaataaaataaaaaagagggatttaaacaaataaatatcaaagattccaacaatggaatatgacttagctttggaaaggaggaaagttggatctgtgtgtagtcacagaaagattctcaaggtaagtataaaaaaaatacatatgcctacatattatatggtcttatattccagggaagtttctagaacagggatggggcggtaatgtaaatgagagaagttatctttgggggaggtgttagagagtggtggggactgtggtgaagtagagaaatcacacatgcctcatccaaaagtgcagctgttctttggatccagccagttagatatttcagtttttcagagaagctgaaaatgtgaaattttccaaatataaaactttgttgccaaacaatacatctctgagcctgactgagtccataagtttcttctagcttattctcagagaatgtttacccaatagtctggagctgaagagtgaggagcatcagacgtcagggccaggcgcagtggctcacacctgtagtcccagcactttgggagaccgaggcggatcacttgaggtcaggatttcaagaccagcctggccaacatggtgaaactcatctctagtaaaaatacaaaaattggccaggcatggtgtcactcgcctatagtccgtgctactttggaggccaaggcacgagaatctcttaaacccaggaggcagaggctgcagtgagagtgccactgcactccccactgggcaacagagtgagtgagattccatttcaaaaaataaaaaggaaaccaactttccccttatgaggtatctactagggtgatgtttgaatttttttggcaataagcaaagttttgtgggtttttttcttaatgcatccaaaataatgtttctactgagttttttaaacagtagacattttgaaatacaataaaactgatcccctcacaaaccttaacaaaagtatgttgagatcttcccactgtctcctgagtttatcttcattcccatcttaaaggaagtcaccaagaaaaggtgaaaaccagaaaacccttaaaagtgggcctggtaggacctaattattttgcaccaggaccaagcaaagttgcctttggggaagggacatggccaaggtcccatcggaacttcaggacagtcctgggacatgtgttttgccccttatcgtagtggtcttcttcgtgaggacagtgtttcctttcttgtcctcgaaaaccaaaatcccagaacctctcacagtggatgggagccatataaaaatggatgccctgcgtgtgggaggcttccaggcccacactttttacttggggccattgcttctttctgggctctgagccttcgtggatgctttttcctttgcctgaaatacctttcccaccttggcctggctgatgccaactcaacctcaaggccttaagtttcatgacaatcttcacaaaaaagggtctgcattcttcctggggacaatccccttctctcccctctatattgcagcagccatgatgaactcctttctgtttctggaatgagccacatttcctccaggctcagaccttgcctgcattgttccttctgcctggaactgccttaattcttatgtcagagctggacttaaaggcattttctcaaagaccccttccctgcacgtctcactcttttcccagatcaggtcatgtcccatatttaaatgattaatagaggaatgactttaaggtgtatctccatcactgacctgtaagcccctctcctgttcaccactggatcccagcaccaaggcacttattatttcttgggtgtgaacactgctcacatctcatatgcatcagtaaagctgacctcacaaccaaatagcggctcccttttttgtcctcctagtttttttgcttgtttctttgttttgttttttgagacagagtcttgctctgttgctcaggctggagttcagtagtgcagtcatggctcactgcagccttgatcttctgtgctcaagcaatcctcccacctcagcctcccaagtagctgggactacaggcctgcgccaccatatccagccaatttttaaattatttatagagatagggttttgctatgttgcacaggctggtcttgaactcctgggctgaaatgatcctcccatcttgggctcccaaagtgctgggattacaggcatgagccactgcacccagcacttctatttctttgttcaaagaagttcaccctcctcttagcatttacacggccctgcgaccattggatcttgccatgccggagttttgttgactgtcctgaatgctcaggccagtcctggagtcctgtttgtgcctggcacacagagccctcccctgcacagtgctgaagggagccacaagctcagagatagactgctggactcgcatcccaatccaccacctaacagccctaggctgtgagcaaatcatttactctccctctcactaaacagtccccatctgtaaaaagaggttataatacctaatcatcattgcgttattgtgagaattctgcgataatccacataaagggcctgagatggagaaattgggttcaatgagcgatcgcttttattaatgtagagtctaataaacaggtggcgaaaggatggtgagatctgcagcttgcgttgtctccgtctgactcagctgctcctcctgatggttcctgcctctgtgccaactaaacaagcagaattctgctttcttttcttttttacacttattagattggttttctgggtgcaattcctcctattgtgcttcaagtttccattgactggcagttcccagacctgcctatggaccaagatcccctgggagcttgttaaggataccggtgcccgggctccacctcctgaatctgaatgtctggagccgaggctcaggtatctgtatttttaacaagctcctgggggattccggatctcagccaggttggagaattattcactgctcaagaccacagtccaaccccccaaatggtggatttctgcagatatcctcatctggacattttccagacttgtttgtccttgcttaagccaaaccgtttctcgctcttctcctatgtctcctctgcctgataatacttgggtttaaagtaaaatttattatctgcctactagctttgaaagctgcccgttgtctggcatgtgacttaaggactttcatatgggagctgtaaaattacatgtggatgctcatggaaatatatcccatgtgcattttctaagttcatggcttcaaatcaccgggctttggagtcaggtccctgagtttgaatcttggctgcgtaaggcctcaggaaccccatgaccatggcaaattacattacattcatttcaaagtgaggataaaaataaacagagagggggctgggtgtggtggctcgtgcctgtaatcccaacactttgggaggctgaagtgggtggatcacaaggtcaggagttcgagaccagcctggccaatgtggtgaaacccccatctctactaaaaatacaaaaattagccgggcatggtggcaggtgcctgtaatcccaggtactcgggaggctgaggcaggagaatcgcttgaacctgggaggtggaggttgcagtgagcagagactgcagtgagtggagatcgtgccattgcattccagcctgggcgacagagcgagagtccatctcaaaaataaataaaaataaaaaaataaacaggggacagggtttggtaatgaagagtctggggtcctgagacagactgcttgggttcatatcctggctgtaccacttgctgaccatgtgaccttgggcaggttacttacactgtgtttccatttccacaatagtaaaatgaaagtgatgatagaactcatctctgatggttccagccaggcttcagtgggctcctacatggaagccatttcgagctgtcactgttagctctcattacataatcagggggctgtgaaagtaaacaaaacagcccatggattgttagcacagagctcatagcaagccctcagtcaatattcattgaattgatcacttgaccaagattgattttttttttttttttttttttttgccatttctggttaattcctactctttaagtcccaggttaaaagtcacctccacctagaagccagctctgatttccccttctccctactcccacaattaggtttctgttttctccgctagcatgtatcacaattgtaactaattagtctttaattagagaagtgaattccaatgcaattccaagggcagtgaactagagaagtgaattaaattaagaagtcaattagagaagtgaattccaatgcgattccaagggtggcgtttgcagcagcacatattacgatagagagggagagggcctgtggccaactagcagagaaagaggaaagcagcccctgacagccagcagccatgattagctgggtcttggtgttgctaggaactgggctggcccacaggtaggccatgctgttctactgttgaacatacacagttgttcacagtttcataaaacaccaacatcagacaaggccactctgaccgtggtgggcaagacaaaaacaataccacatctgtcatcatgtgtgagcccagacaaaatgggaacactgtccaagccacaaaataccagacatcctcctcccctctgttaatctgagtgacattacttctttgcctattaaagtttgagtcttgctctgtctagccttctttccctcttgataatattttttaaaataacaaatcatagaattagccccacttgctggtgcctctgatggaggttttcttgaactcctccaaaagcatctaacatgagcccaaacctaaaataaaataagttatttctggcaccctctgaggttttccttattgcaatgagtaataaacttattcagtgacaggggtgtccctattggtctttggccagaggacaatgacatggggaaggccctgcccgcctgattgattttgaaagccttaaaaaagaatctgaagtttcagtttggcctgtgagctccaaattagttgctcaatttctagtttactagactgtaaatctccctgcatgcagagacctaatcagtcttattttcccaccacccaacacaccaggtctggcacatcataggcactcaataaaacagctattgaacgagggcaggaaagggtggctgtgaggattaaatgtgtttatatgcctgaagcacatggtgtgtatggcatgtgccccatcatgagggcttagtgatggtggctgtgttagtccgttttcatgctcctgatgaagacataccagagactgaacagtttacaaaagaaagaggtttattggactcacagttccacatggctggggaggtctcacagtcatggcagaaggtgaaaggcacatcttgaatagcagcagacaagagataagagcttgtgcagggacacccccctttttaaaaccatcagctctcataagactcattctctatcacaaggaacagtgcaggaaagacccacccccataattcagtcacctcccaccaggttcctcccatgatacatgggaattgtgggagttacaattcaagatgagatttgggtggggacacagccaaaccatatcagtcactttagggttgttgtgtggcaaatgatggaactcagataatggagatgcttgcccttggagaattccaagcccctcggggaggggaggaggatttagttgtaagacattcaagcccagctgtttgtgacaagtgtagtcttaaaggtgtgaagaattcacagagactgttggttccaactgggaaagtcaggggggagaactgtgaatgaaagcaaatgtataaccggctttgaaagacccattggcttttgggagaaagacggtgggaaagggggcatttcctaatggtggtttggagggggtgggggaagctcagggcaagatttgaaaacagtggctagagatggcacaggggaacgtggtgggagtcatgcttcagctctgtcctttattctgaaggagctggggatccattgaaagttcttgaacacatgagtgatttagtaagacaaactatgtggtgattgccagaaggatctggaaacaataatagcaaattcttacacagtgctcattctatgccatgcacttttctaagtactctatataaagtagttttttgtaaccaaaagttaggtaataataattattatccccatttgaccagtaatgaaactgaggcacagaggggttaaataacttgtccagatgacagaaagtggcagaaccgggtctcaaacccaggctgtctggttgcaaaacctgtgctcttaatcagtactgccacttagtaaattcctcattgcgatgtttctcaaacttgcttgtgcataagaaccatctgaagcttccgtgaaaaatgcagatatccagacccttcctggggataatatattagggggtctgagcaaggtccggggaatctgaaccagccagggagtggttgggtcaggtcagatgctttcggttgctcttttttttcttttttctttctttctttttttttttttttgagacagaggcttgctctggcgcccaggctggagtgcagtggtgcaatctcggctcactgcaacctctgcctcctaggttcaagtgattctcctgcctcagcctcctcagtagctgggattacaggcacccactgccacacccagctaatttttgtattttttagtagtgacggggtttcaccatgttggtcaggctggtctccaactcctgacctcgtgatctgcccgcctcagcctcccaaagtgttgggattacaggcgtcagcaaccacgcccggcctctgttgctcttaacaacagcaaactaaaagtgtgcacaacagttaaagacacatattatctctcatagccagaacaggcaaggtcagttcggcagctcaaaggtgcggagttctttccgtcttcctcctgttctcggtggtgggcttttatcctttgccctcgcgtcctccgcatggccgcatggtggcggctaatgccttgggcatcaaatctctcaggcacacccacaagcagggaaaggagcaaattaaatgtatcagggaggaaatgctccctgatgaactcccaaaactccagatcctgctggccaaaactgggacacatggctttgcccagttgcactgtagtggaggcagttaggctgccaagggacaaggagaaggggcctaccagtggaacccaatcccaagtcccctccgcagggccacgttcctaccactgcctcgttaaagggactagagtggcagttctcaaatgctgctgtgcaaaaaattacctggaaaatgtgtttaaaatacagctataaagatatctaaactttaccccaaatctctgcatcagaatctgtgatgcatgatcaaatttgagaaccattcaaccagaaggggttgaagggatggaaacccactggcactagagtctagttcacaataggtgctcaacagatctgaggaatgaatgaacggcccactgagggagggagggtagggtgggatgtgggaggaagctctgttccatccatggtttatttttcctgtttggtgaagtcccagtatagggcaagttaattttccgttatataggactgttcgtttgcttagaacagaccccctactttggctataattcaagccagaggggagactttgtttagaaggatataggcataagggagaattataggcaggcacgcagctggatctcaaaaagagattgaaccggccgggcgcggtggctcacgcctgtaatcccagcactttgggaggccgaggcgggtggatcatgaggtcaggagatagagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaagagagattgaaccagaagctagaaatattttagggttttccagactgtacagctcaaagggcttgttggaaatgctgggaaggcagagtctcggccccacccagaactgctgatcagaatccacattttagagagattgtggttggataagcactgctgccctgtgaccattcccaaagtttatgtcttctttgttcagaaggaaagtccacaccaaacctgagcgtcttagtctcagtttgggtttttttaagagattgggcgggtggggggaaggtctcactacgtcgcccaggttggactcggactcttgggctccagagatgctcccacctcagtctgggtcatagttgggactttaacggcagccgccaatacgcctggctgcaggattcaatttcagagcaagagactcgattggcccagttgctgtcaggtgtcttccactgcaccaatcagcaaaggcagagctggggcgtggtcagggcttccaacagggcagcgccactcacccctggggagggacatttgggccggtctaacgcccactgtggacggtaaaggccgtttgggaacagcgtaagtgaaaggggtggattttctcttttctctcagaaaatgaattattttgggggcgggggcggcagcgggggtgcggggggaagggaacggagtctcactctgccacccaggctggagtgtagtgcgatctcggctcactgcaacctctgcctcctgggttcaagcgattctcctgcctcagcctcccacgtgcctgggattccaggcgcccaccaccacgtccggctaatttttgtattgtagcagagacagggtttcaccatgttggccaggctggtctcaaactcctggcctcaagggatccgaccgcctcgggctcccacagtgctgggattacaggcgtgagccgccatgcccggcctcagacagtgaattctgagtttacagttgggatacttgcctggagatcaagaaccctaaatgagaatcctaagcatgaacgacactgcaaaaaacaacatacacaaaaaaatcaagagacctgaatatatgataatatcctgctgggcgcggtggcgcttgcctggactcccagcactttgggaggccaaggagggaggatcgcttgagtctgggagttcaagaccaggctggccaacatggcgaaaccccgtctctacaaaaaatacaaaaattagctgggcgtggtggcgcatacctgttatcccagctactcaggaagcttaggcaggagaatcacttgaacctgggaggcagatattgcagtgagccgagatggtgccactgccctccagcctgggagatagagccagaccctgtctcaaaaacaaaacaaaacaaaacaaaagatagtatccttaatctgcaaaaagcatttacaaatcaagaaaaaaattaaaattccaatagaaaaaatgagctaatagaataaacaggaagttcaccaaataaggcatgtcattggaaaaataaatgttgaaagggagtttaatctcactaattacatgtaaaggaaatgcaagttaaactcaagtgatctcattttgtcctctcaagtcgtctctgtgacagccaaggttaaggggaaaatgcaaataatttcagttttctgaaaggatgttataattatataatcaccaagtaataaaacatctgtaccattttaacccaagtcttcaatttcaaggaatgtacccaaagaaatgagggataaatttaaacttctggacaggttttactcataaaagtcaattcctagatatctcctccatgtccaagaaagggaaatggttaaactattcagcaaccaaaatgatgaaatattatgtggccattagaggttgtgttttcgatgaatgacaacatgataagatgttttaacatggcaaaagtgtttcattaaaaatatatattaaatgatttaagccatgatcctagttttatacttttaaaatatacttttttttttttttttttttttgagatggagcctcactctgttgcccaggctggagcgcaatgacgcgatcttggcccactgcaacctccgcctcccgggttcaagcaattctgcctcagcctcccgagtagctgggattacaggtacccaccaccacacccagctaatttttgtatttttagtagagacaaagttttgccatgttggccaggctggtctcgaactcccgacctcaggtgatccgcctgcctcagccaccaaaagtgttgggattacaggcgtgagccaccgctcccggccctaaaatatattttctatatataaaagaggttagccctttagctgatcattaattaaacaaatgttctttgagctcctccccttcacctggttctgtggtgggtgcagggggaacagtaatggaaagaaacaagggtctgtcctcacttaactcctccaaccaaatagaagagagaatagtcatttaataatttctcaaataagtatttaatcacagtagcgataggagctttgtataaaaagtaaggatgtaggctgggcaccggtggctcacatctgtaatcccagcacttttggagatcaaggcagggagattacttgaggtcgggagttcaagatgagcctgaccaacatggtgaaacccccatctctgctaaaaatacaaaaattagccaggcatggtggcgcacacctttagtcccagccactcaggaggctgaggcaggagaatcacttgaacctgggtagcggaggttgctgtgagccaagactgcaccactgcacttcagcctggcaacagagccagactccgtctcaaaaaaaaagaaaaaaaaaaaagcaaggatgtatattgccatgttttgacagcattgggaagttttttgttttgtttttctagagacggtcttgctctgtcacccaggctgaagtgcagtggtgcaatcatagctcactgcagcctggaactcctgagcttaagccatccttccacctcagccccacaattagctgaaactacaggcacacagcatcacacccagctattttttgtatggttttgtggagacggcgtctccctgtgttgctcaggctggtctcaaactcctggtctcaagtgatcatcctgcctcagcctcccaaattgctgggattacaggcatgagccactacacttagcctagttttttcttctctcaacttttctgtgtagagaagaaaatcctaaaattcatgttaacttttattttgcaaaaataaacattgtcatttaaaaagagaaaaggatttgttaaatggaatttttaagttgaagaagggaagggggaagcaaattagatagggagatatcaaagctgtcttgagatgtctgaaaggcaatttggtagaaaaggagctatggttggttcatgtgagccctaagactccacagagacaaacttcagagaaatagatgtggattatctatttcatgaaattcatataacagtcatacattttaaacaacatcatgatcaaataactgaatatgcccctgctacaaaccagaactaaatacaataagcaattctcagatgcacacctgaacatgcaggaaagaagggaaatcccctggagccagaaaacaaacctgaaagctgcagcaggtgtgtgaggctgtgagcttcttggggtatcggggacagggtctgatctcactaaacaggaggcttgattttaatggccacaccagggtagaggctgaagccctgagctcttgcaaaaagttagacataagacccccacataaagaggtggcccgtgctgcattctcggtgaaaagagggactagagaatattcttggggcgtgggcaagtcacgcctctactggaagcacttccccccaaggttatgagtcatcccgcctcagcagatgtggggcgtttcaccttcttctagggtgctctgagattccccaaggcccatgccactcattatgccaaacctgaatacagataaataataacctattatgcatagttaccgtaatgtccactgagaattctcaagaacttgcagtgtgcccgacttgcagtatgccttatccttcccttgaatctttactagaacaacaagatctaagctctgagatcactgcaatatccccattttaccgacaaaagaactgaagagcagagaagtgacttggtcaaggccctatagctagtgagaggagacagaggttggcccagggtcaatctgactgtacacacacacacacacaaacacacacacacacaccaacacacacacacacacccctggcaatgagtggtgactgcagcatcaaatcacatgcacacacccaggttggtccaaggtccactacacacacacacatacactcacctggggatgagtggctactctggcatcaaattgcatacaaacacccagttggtcgggcgcggtggctcacgcctgtaatcccaacactttgggaggccgaggcgggcacatcacctgaggcaggagtgtgagaccagcctggccaacatggtgcaattctatctctactaaaaatacaaaaactagctgggcactgtggcaggcacctgtagtcccagctactcaggaggttgaggcgggagaatcgcttgaacccaggaggcagagattgcaatgagccgagatcacgccattgcactccagcctgggtgacagagcgagactgcatctcaaaaaaaaaaaagaaattggggaggccgaggcaggcagatcaccttaggtcagaagtttgagaccagcctggccaacatggtgaaactctgtctctactaaaaatacaaaaattagccaggtgtggtggtgtgtgcctgtaatcccagccactagggaggctgaagcaggagaatcacttgaacccgggaggcggaggttgcagtgagccaagatggcgccgttgcactccagcctgggcaacagagcgagactccatctaaaaaaaaaatgaaataaaacacccaaattggtccaaggtcagtctgaccatgcatgctcacacatacgcacacacagacacatacacatacacatacgcatacacatacgcatacgcatacacagacacatacacatacacatacacatatgcacacacaccccctggggatgagtggcgactccggcatcaaatcacatgcaaacaaccaaaggggatgaggaggcctctggttgccagcagtccctcagtgattaccataagcctttccctggggtgtctctgcaggtcctgctgttcacagcagattctagaaaggccacgtgtgtgggaagggatacccttgataaatccagctaggaggcgccagcaagccgaccatctggatgagagtcttcagcacccaatgcccctttgttgctattgaattctggacacctgcaacagaatactattaatataataattatatgcttccatgttttatattcaaatgttaccttctcactgaggccttcctggacctacttaaaattgcatgcccaccagcatttcctggttcccttccctgctttatttttctctgtaatatttacaccacttgatttgcacactatatatttaaatacttattgcatgcaccactcctaactagagtgtcagctccatgagggcagggatttttgtctctgagtcactgctctgtttctagtgcttagaacagttcctggcacacagtcagtacagtacctaataaatatttgctgaataaattagtgaataaagtcaacagcaacagcagctttacatgcctggtttctgatcctcacagcagccctaggagataggaatggaaattgtccacattctccaggtaaagaaactgaggaccaaggaggtaagacacagcctaagctctggagcaaaccctttctggtctatagccatctactttgggatgactcgcaggttacatgggattagccctgccccaaaatgatccctgcacctgggtgcctgaatccctttgctgttgggttttgtttttttttccttgagatggagtctccctctgtcacccagactggagtgtagtggcatgatctcagctcactgcaacctctgtctcctgggtccaagcgattctcctgcctcagcctcctgagtagctgggactacaggtgcgcaccaccacgcctggctaatttttgtgtttttagtagagacagggtctcaccatgttggccaggctggtctcaaactcctgacctcaaatgatccgcccacctcaggctcccaaagtgctgggattacaggcatgagccaccacgcccggccctttgctgtgtttaacctgcccactcatgatgcttcctgctgcctctccaagacaccaaagcacaggcaacaaaagtgaaaacagacaaatgggactatattaattttttttttttgagacggaattttgctcttgttgcccaggctggagtgcaatggcatgatctggactcaccgtaacctctgcctcccaggttcaagcgattctcctgcctcagcctcccaagtagctgggattacaggcatatgccaccatgcccagctaattttgtatttttagtcgatatggggtttcttcatgttagtcaggctggtctcaaactcccgacctcgggtgatccgcctgcctcgggctcccaaagtgctggtgttacaggtgtgagccactgcacccagctgggactacgttaaattttaaaacttgtgtgcatcaaaggaaacagcagaaatgaaaatacagcctatggaatgagaaaatatttgcaaattatacatctgagaaggggttgatatccaaaatactcctgtgtttccctctgctgtgacttgcccaggcttatggtagaggacagttaagagatggagcccagccaatctctggagagagcagaaagtggcaggagggtgaagggcctaccacctacctttcaagagagtgctgaggagcccgcgagctgacttgtagggaggacctggccacccatactcaccccactgtgaacaccttccagcacagggggtcacttgtgcaggaagttgtagagcagaaggttgggaggccatggagtatgaccatagcccagcaccctggttttagcaccaaaattcttgagaaactccactacaaggcaaacagggatggttgatcatcctagctcatgagcatttcagttgagagtttgatgcacaagtgccagagtctggttctattgaactgtaatatatccctgttgacatttattgagattcaaccatggccacatcctgtgctactgaattctcttgttaaactttgcaacacccttatgaagtgggcatggtgattgtccccatttatagtgagaaaacaagttcaatgaagttacataactggcctgaggtcacatccatagtgaatgatcaaacctgaacttatatcagtctgaagacacattttaacatatctgaaacaacgatgcattttagaattagtgagatttctgtcaaccagcaggcagtccaaaaacattaccttgctgtgcatgtgaacaaacttgatttcagtgggtcacatttttcttacctcagctgcattgtgtgcaattttggaactatatgtattgagtttaattgctgtttaaaatgtcttccaagatattgcatgatgaagcaagttgaagatgaaaagtaattgcttacccagaaatgcctgaaaaccgtaacggggtaaatctgatattaatgaagcaaatcttcagtgttggaggagtgactgcagttgcacgttcttgcaaagcaacaaccgagagaggtggaattcctcatatagacagagctgggttaagttctactgccaagataggtggaaaaggatggtctctgctaatggttcttaaacttgagcatgtatcaggatcacctggagggcttgttagagcacagattgttgggtgcacccccagagtgtctgattcagtaggtctgagatggggcccaaaaaatttgctttggtaacaagttcccaggcagctccaatgctgctgtctggggaccatgctttgagaaccaagcagagcgagagaaaccaggagaaatagccagatcccacagagcaaatgaaaacatttcaacaagagacaggtgcagctgattcatgcatcagagatacttggcatgataacaggaaacatcagtttgtctgaatctttcagctgactttaaaccaaagcccttgacttccctacacatatttccattgagaaaaatggaaactgtggctttactcaaataccaaatgctgacagcaccaaggtatcatttgaggtgtatcagagtgatatgatcactactgaaggtgccaaagagatggagatcaggaacttgggtttcctgccaaatgtccaaagaagtcaggaaaagcccattcgataaatataaaataaaatacctaaaaaaagaaagagttgtcataatgtgtttaattggcagcattttaatcatatatgaaattatgacacattttacaatctaaaacatcttagattcaaagaaatatagtgtttaagagaaaacaaactagcacctggagcctgtggcatggatattagtgctttggacaaagctaaaataaacagtgatgttaggcctgtgttgacttaaataatctgtaaataaaatgtcaaaaatgtcaaaggtggtgtctgagtgactgaagtttgggaaacagaatattacagcggctctcaaaatcatcattagggcctcttagcctgacaggttcatccaatgaacaagcctccattggtcatatttacttcttatttgaaacccaatcttcatatgacaaagtacattctaagaaagaaccagaaaaagaaagaggaggagaggaaggaaagaagggagggagggaaggggaagaggagaaggagggaggggaagggaagagggagggagggaggaagggagggagagaagaagggagggaggaagggagggaggaaacatgcctaagtcccagactataaatgtagttaacaaagtagtcacttaattttttacaacaaaaaaatttgagactgcctatcttatcttttacaattttatttattatttacttatttttatttattttttattttttttgagacagagttttgctcttgtcgcccaggctggagtgtaacagcacgatcttggctcactgcaacccccgcctcccaggttcaagcaattctcttgcctcagcctccagagtagctgagatttcaggtgcccgccaccatgcccagctaatttttgtatttttagtagagatggggtttcaccatgttgaccaggctagtctcgaactcctgaccgcaggtgatccacctgcctcagcctcccaaactgctaggattacagctgtgagccacagcgcccagcctacaattatattttatatttagtctgtgttttgctattttttttttctttttgcttcagaacctcagtaagagtacaaggaattttttgagggggggaaatacttatgctgagaagaatgttaattagactaattttgccccaaatcccttctatcgttcctttttggtgtttcattaggattttgtcatatagcttatgaaagcacttaatgcatttggctgcagttaacagaaatcttacctggcataaattatagggacataaattatagggacatttcttgtttatttaagaagtctagggcaggcatggtagttaacaatgtgggaggcagagacaggtagatcacttgagctcaggagtttgagaccagcccgcgcagcatggcgagaccccagtctttacaaaaaatacaaaaattagccgggcatggtggtgcatgcctatagtcccagctgcttgtgaggctaaggtgggaggattgctccagcctggaaggtcaaggctgcagtgagctgtgatcatgccactgcactccagcctgggtgacaaaatgaaaccctatctcagaaaaaaaaaaaagaaaaaagtatagatttgggtggcttcagagctctgactcagcatctgatttccatgtttacccttatggttacagaatggctgccacagatccaggcatcacatcatcactccagcatatacaaagacaggaagtagggcagccagggcagcaagatgagcttttctcaactgcttcttttaccatctgccctgcccaccctgcccccccatgctattttaaatcagggaggaaagtcttttgcagaagtctcccagcggatgctctctagtgtctcattagctagaactgggtcacatgatcactgtgaagccgcaagggaggctgggaaagcaaactagtacatgcattctctctacaaaggaaagtaggcagacaccatagctagcgggcatttatattaagaaaattaataatcaccatatcttttagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggtaaaggcagcattatgtcctacttgtgtagagggtgtgatatttaaccaggctccagggctcctcctcatgagttcctgacaactgctcatggatgtgttccaaactacctggcataaaaatcagagccccctggcatttacatcagcacatacaacctatctcccactgtctgtggtcattctgcctctgggttctaagacttttctagccataggcctttgaagtggaactcgtgaaaatttcaggttgctataaatttttttcctatgctatagcttaggaagatatccagtaagaattttctttccttactttggttttaatttattcagaaataatttcagatgtacagaaaagttgcaaaaattgtaccaaaaaaatccctgtatgcccttcatctagattccccaaatgttaccattttattatatttgctttgtcattctttgtatatatacaaatatatatacaagtatagttttccccaaaccatttgaaagttgctgacaatgtgatgcccctttattcctaaatacttcagtgtgtatttcctaaaaaccagaatattcttttaaataaccacaggacaatcatcaagatcagaaaattaacatttataggaactattatctaacctactgaccttagtcagatttcgtcatcaagtgtcccaccgatgtcctttctaccaatatcaaaagaatgacatttttcccctctgatccaggctccaaccagtgatcactaattgcatttagattttatgtctttcatttcctctaatcaagaacagttaagcatttatctttcataagcttgacatttttgaaaagtataggccagtgatttttgtcaaaagggcctcagtttgggtttatttgatgtttccttatgatcagattcaggttatgcagttttggcaggaaccacaaaatgacggtgtgtttttcccggtcatcacatatgaaggcacatgagatctctttttcccattaccgtggtgttaactcttgtcacttggttaaggatgtttctaccagttttctccatgctaaaagttactaagttttcctttgtaattaatctttcctttttttttttaggttgccaattcaagactgcttatggcatgaaggacatggagcggcatttaaaaattcacacgggtaagtagcatttctttagcgcatatgccctcaacacctgctctgtgctaggagatggggatccacataggtcagacgaatgataccactccaaacgtcactggctgttatgggaatacaagtccagattttaaaaaataaggtgccatttgtacacatgactttggcagaaaaatctttaacataataaaatccagctctggagaggatgtgagcaaacttagctaagtgggaatgtgaactgttacagccattttgaaaatgattctgccaaaattaattaaaatttgaacgcacatattctcattttgaggagatgaccctacgagttcatatgtgtgtgtgtaatgattagtaaagagaggaataaggggagagaaaagaaactgtctctttttttgtctttttcttttatattttgagacagggtctcactctgtcgcccaggctggagtgcggtggcactcgacccgcccacctcagcctccagaatacctgggactacaggcagacgccaccacacctggctaatgttgtgtattttttgtagagagtggggtctcaccatgttgcccaggctggtctcgaatgcctggactcaagcgatccacccaccttgccttcccaaagtgctaggtttacaggtgtgagccactgcacctggccaaaactttcattttatgtatctttatgttatatcactgaatacagtgagtgtgtgttatttttgtaatttagaaaggagaatttaataaatacttgttttaaaagaagagagaaagatcaatgcatgggaaaagaaaaaagtgatgatttctggtgattttatttttctttaatatattatttttatgtttcccagattttctgcatggaaaaggaattgccttcagacttttttttaacaagtgttatatgcttgtattcaaatagtacagatttaaattttaaaagtataaatgtgtataagatgcagggagttttggctttggcttcgctaattgcccaaagcctgctatttagcctcagcctttggaagatgagtaaccaacagttatttcttacattccttggccataaccaataagtgccttattgcactggggtcaccatcatatctaatcagcctcacagtgtcatgctatctggatttgttctaattatccaaatattaagtttcaagtattgattggtaagcgttctagtgtaataagcaattaaactctccatgtgggtttcatatattgaagtttcatccatcaagccatagcatatttattattgaaagaataaagtactataatttttgttttgttttggtttttgtttttttgagacggagtttcgctcttgttgcccaggctggagtgcaatggttcaatcttggctcaccgcaacttctgcctcccaggttcaagcgattctcctgcctcagcctcctgagtagctgggattacaggcatgcaccaacacacccggctaatttttgtatttttagtagagacgaggtttctccatgttggtcaggctagtctcgaactcccgacgttgggtgatccacccaccttggcctcccaaagtgctgggattacaagcgtgggctaccgcatctggctgagtactataattattaatgatgatagagaaagcgttgtaaaagtacaagtgagggccacagctttgtctatttctgcaaatccgcagaaaatatcttctacagttagcctaccttgtgtttggaggatagtttctgcggtctctgtctacattttcaagtttaaatgtatcctcaccttagttaccttcagagagtgggggtatgcttaattacccctggagttggggtttgggggaaccacagcaacagggctctttaccagcagagctggccaaaaaccactgagctctgccaacatccagcatttgcccagtgttgcaaatacacagtgtagtgaccgcaggaactactgagccactgacaatgctggtaaattattgttcctggatttttaaatttgatgactaaaatttttgtttgtttgtgtttttgtttttgttttgtttttttgagacagagtctcgctctgtcacccaggctggagtgcagtggcgcgatcttggttcactgcaagctctgcctcccgggttcatatcattctcctgcctcattctcccgagtagctgggactacaggcgcctgccaccacgcccggctagtttttttgtatttttggtagagacaggatttcactgtgttagccacgatggtcttgatctcctgacctcatgatccgcccgcctcggcctcccaaagtgctgggattacagatgtgagctaccgcgcccagcctactaaaatgtttaataataaaaatgctaatttttttttttccttttgagatggagtctcactctgtcacccaggctgtagcgcagtggcacaatctcagcacactgcaacctccgccttccgagttcaagtgattctcctgcctcagcctcccgagtagcagggattacaggtgcccaccacgatgcccagctaatttttgtatttttagttcagacagggtttcaccatgttggccaggctggtctcgaactcctgacctcaagtgatctgcctgcctcggcctcccaaagtgctggaattacaggtgacagccactgtgcccagccaaaatgctgatctttaataaacttttagatgtattcttaaatcccaaatatttatttatgacgacagtgatcagctttggctattttagcacttggctagttacgatttggtgaaaatacatatttgatatataaagtaaaaaaaagaaaatcctgattcacagccacctccttccatgaccaaaagtcagctctcctaatagacctctatgtctcattctgaaatatttgcatgcctagaccaggtctaaaaacacacacatttaatttttccatgtcttactaagttaatatgatacacgctatcagtgcaacttgcttcttttcatttactattgcacatcatttcacatcagtatgtcatatcgacttactctttttcatggccaagtaaggaatgggttcagtaatttatgcacatccatacagtgaaatatttcagccttaacaaccgcgttgtgggtatgtaatgatatgaaacaggtgatcgaaattaccgtacatgcaagaaagtagtcaatagggaggcagtgcagtatttggcaaaaaaaaaaaaaaaaaaaagaaagcaatcacaagacggtcctgggttctaattccagctgttgcaaggattaactaaagtaattcaaaggcacagtgccattcaaaaaggaagtatttaaattgatgttagccaggaatttttatgtaccaaaaacatacacacacagagattggaaaaatatacatcaaaaagttagcagtagttcacagatgtcaagttgacatagcattagtgaggttcagattaagctgctgtaagaatgaaactgaaacaccagctcaaacaagatagggatttgtatctgtcccgtgtaactgtccggaggtgagcaggcaggctaggacaggtgggcagctctgtcctagggaccagccaggcacttaagttcctcccacctcattctattacatgactccaccatctgcaggtatgccaccctcagctgctcactcacctgccctcacctgctcactcacctgcgctcaccgactcactcacctgccctcacctgctgccttatccccatgccttggctagaagcaggaaaagagaaaatgtaaaaggcaagccgtttcctcttgtgaaagagacacactttactttctctgccatcgctttgataggaacttagtcacagatcacagctagctgcaggcgaggctgagaagtgtaatctttccctggtgagccatgaactctgctgaaacttaggtattctaaattttacggtgcatctctgttgtgaaaaggaaaaaggagagagtgaatacaagggaaaattaacaaaactgttactattttacgtacctatactttaaaattttaattgccttctatttttaatttataaaaaatttataagaaattcatattcatcattttaaaaattcaagtaataccaataaggaacatggaagaaacttcccctctcccaagatgttagctctttgccaatcatccacccagtgttttagggtttttggaatattcttcggtggttgtatatgacttttttcgtaaggcagtgggaaataagccttttccttttttaatcttgtttcctgctgccatctgtgtgtgtatgtgtttgaaggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggtgagtcctgcctgttatttgctctctacgctcctcactttctatggcataaatcataagcaccttaaagcattcagccacaatgtaagaaatcgagttggaacctttgctcatcccgttgtttgcagttttgtttttttttgttgttgttgttttgtctcgctctgttgccctggctggagtgcagtggcgctatctcagctcactgcaacctccacctcccaggctcaagcaattcttgtgcctcagcctcccaagaagcatgttgcaccacgtccagctaattttttgtatttttagtagagatggggttttgccatattggtcaggctggtcttgaactattgacctcaagtggtctgtccacctcagcctcccaaagtgctgggattacaggtatgttgtaccacacccagctaactttttctaattttagtagaggtggggttttgccatattggtcaggctggtcttgaactcctgacctcaagtggtctgcccacctcagcctcccaaagtgctgggattacaggcgtgagccaccgtgcctggcccatttgcagttttgcttttcagctgccttgaagagcctttctcagtaaaataggggaaaatcatgaagtttataactttatacatatgtatatctctttctataactttgtaacttattcagttgtaaagtgtgtaattgaggagatgcatgaaatgaaatacacgtataagccatgtatctttgataaattctgcattatggttaggcattccaatcatttttgaagcatactctagttcagcatggaacagcttgaccaaaaaacatacagcaaaattagcagagtaggtaactcaataaattacatacttttttctttcggtgtatcagttagataatgattcagtcatgctgcagtaacaaccatgaaatctcagtgttgtataataaacatttgttgctaacatactttaggtcagcaggaagttgactggacaactctgttgatcttggcttggcttaaccacatgtgtggggaaggctgggtgcctttcagatttccctggggatctgctggccatgggctggctggctgtccactggccttggctgaggcaatctggttctgttctgtgcatctctcatcttcctcctgggaccatggactaacccaggcttgtccttctcatgaggatggcagaggtgcaagcaagcaagccccagtgtaagcccatttcaactctttgcttctataagttgtcaagcatcacattggctaaagcaagtcacatgtttcatcctggtgtcaagggcgggactgagctcactgacagtgagaggtcatcacagtgttacatggcaaaggtcggggatgcagggaaggtgaagaattgggactttttctttctttctttcttttttgagatggagtctcactctgttgcccaggctggagtgcagtggcgtgatctcagctcactgcaacctctgcctcctgggttcaagtgattctcctgcctcagcctcctgagtagctgggattacaggctcacactgccatgcctggctaattttttgtattttagtagagatgggatttcaccatgttgcccagcctggtctcgaactcctgagctcaggcaatccacccgcctcaacctcccaaagtgctaggattacaggtgttagccaccgcgctgggctgaattgggaccatttttgcaaacaaccacagtccgcctttatccccaccgtcattcacatctctctgacaggcaaaatgcattaacaagtctcatccaatcataggatcagccttaaagaccacaattgcgtgatctcccttgggtctggatatggtttctcttcatctagagacggttgaaataaaagacaagttgtctgtcatgatacacccaatatacagtgtaaaacaaaaagccaaaataattaccataattctaccatttgaaagtagtgtaagacacatgcacacatatgtttattgcagcagtattcacaatagcaaagacttggaaccaacccaaatgcccatcaatgatagactggataaagaaaatgtggcacatatacactgtggaatactgtgcagccataaaaaaggttgagttcatgtcctttgcagggacatggatgaagctggaaaccatcattcttagcaaactaacacaggaacagaaaaccaaacactacatgttctcactcataagtgggagttgaacaatgagaacatgtggacacagggaggggaacatcacacactggggcctgtcaaggggtgggaggctaggggagggatagcattaggagaaatacctaatgtagatgacgggttgatgggtcagcaaaccaccatggcacgtgtgtacctgtgtaacaaacctgcacgttctgcacatgtatcccagaacttaaagtataattttaaaaaagaaagaaagtagtatagaagaacgggaggcatttgtcagtccctggtccatagcatttctgaaattcttctgggcacaggttccccctactcaggggttagggaatgtttcttggttaggccttggctcagctctttggttcttaaccctgcccattggaacatcctttccatcactttcctaagctacttctgaaaaagattgcaaaatgtacctttgagaaactttctcagcttgcttcctgtctaccaaaagctggaggtcttttaccttttgttttagtaaggctggtgacagttttgctggtagagctgtctttaaaaactgtgtgagtttcctatgtatccatatgccaaaagccatacccacagttcttttggaatcttgcctctttttctaaactcaattataggcacttttggcatttaaccttctgtgggttttaggagtcctttgtccagctgagagaacatacttggcaccaacttaattctcaccattcttaattctcttttggagattttaataaagagtcttacattcagaccccttatttcacatttggtcttcactctgagactagtttcttagatatggtctttgtcccaggcttttgtcttacttgggaaagctggctggagaagctggctggagatgagaaactatatccagtaatctttgactttctatattccctctaaattctgcttacaaaatgtccagttctttttttgagtttgtctctttcttgtagtcttttatcatatgcagcttataaaacactttcactgttctgcctagaatttatctctttattcaagtccaaaactcatgatgtacattttctgtcttctaagctaccacgagtgacagtcttaccaaatgtttgccattaagtagtgtgcattgccatttttccagcctccacatgcaaccgaatctcaaaaccaatactctgtattatggttttctgttacagcgtcaccctttttctagataccaatatctgtatccattgtctgttgtcacagtgatgcagcgtaatagcccacaaaacctcaatagatgcaatatgctttttctggttcccatgcggggatcagctgggcaaaccagctgaccttggctgggctctcttattagtctgaggatctgctggttatgggctggctgtccactggccttggctgaggaaatcagctctgctccacatgtctcttggccttctgagaccagcaggttaggccaggattgaccgcatggtcatgaccgaggtgtaagcaagcaagcaagccccagtgcacaagcccatttcaagccattccttgtttcaagttactaaacataccattggccaaacccaacgacatggttgaggcttttgtcatggatcacgggagaacatgcctaactacatacatggcagaggccgtgctaaaggaggggtgggaggtgggaagatttgggaacatttttataatctacagcaagttcagacattggcataatcgacgcccaactgatttgcttcagaaatttcccccagcctaagttagagaagctgaaaaattcatttatgaaaatggttcattttgattgataaggatgaagttactatttatagcagcatctttaaaattggtctagaaaaggtgtgtttttcaaaaatttcagtgtgtgccatttatgcatggtcttcgtggaatgttcattttcccttttataaatctgtggcactggtaaaactgtaaattaataggattttgtttttaccctttcggcaattggatagactacatcaacacttgttttagtagcaacccaaactcaaggaggacctgtcagcttaaatatatgtcgctcattcatccaacattctttaaacctcgctatgtgccagacacagtgggaatcaggtagtaggcaagaatgaacatagtcattagctttgaagaccttagtgtccagtgggactatttgaccaggatacttcattaaagaaatgtttatggttaaattaaaaaaaaaaagacaaaggaatttaaaacctttgctttcatgccaaaaaacgttgttaagctctgcaacttagctgcgagatttggttttctggattttctgggtctcacctctgcagattgcttaaaaaaagtgaaaaaagactgtcactataattttgacagggatataactggaaaacctagtaaaacattctggagcaaggattctgactttgagtctacagacgtctgcccctgagaaatccatgagtagatttgggaaggaggtccttgaatgggggtggggaaaacaaagacgtcttcattttcactagcctgtattaaaatttgacacgtccttcaattatgaaaacaggcaaccaatctgataacagtgcatgtaaagttgtcgccagcggaaatcaaaaatctcttcataatgattgctgcagatggagcaaatatcttttacactcttctttatttagaaatgactgtagttactagagctgccgctaggtctgattcttgaattcattaatgaaacacacacattggcatatcacaattttttctctgtaataactattttaatataattagtttcttttatattcctattggtttttattttagtttatttggtacatttaaaacattatctaagaagggttccatggacttcactaaactgccaaaaaggggtaatggcataaaaaaggttaagaacaacattctcaggcagcaaacggccctttttctgaaaagggccagatagtaaatattttaggttttgtgggccatgcagtatctatcacaaatactcacccctaccattatggcaggcaagtaaccatatgtaaacaaatatgcatggttgtgtttcagtaaaactttatttatagaaacaggctgtgggcaggatctagcccataggctgtagcttactcttccttgttctagagtttagtatgcatgatcttggtggtattcagtcatacaaagcatttttttcaagtttaggtttaggcctctcagtgttctagaagcttgttcaattgcctcctgccatctttgtttgcattcattaagcagctcatggtgaagtagcagatcctatgtcaaaaagctggaacaccatcccagtcttgtgggtttatgacctaagaaagcaaacatcagttatatgcacagataattacctagcatctaaagataccagttgtggagtcagcctggattggaatccaagcccttctttgtactacggggcgaccaagaacaagttatgtagtctgtctgggtctcagccttctcctctgtgtaactgtgttaaaaaacaatattaataatagcacccaccacagggcaatcttcccagcatcaagcgagaccatgcttgtggagtgctcagcatagcgcctgccatcccggaagccatcgaagaatattagctgctattttgcttacttaaacaatgttgagatgaggggtcgccaatttgcttgaattgtcattgcctcagataatttggacttggcattcattgaggaagtaaatttggaatatggtatccaatcagatgtttgcaatttcacttgccttgctcatctttcagcgaatatgaattttttttaaaaaaaatcaagcagctggattttgtaacttcacaagtaaagaacgcagctggcaatatgggataaataaattttgtgcaagaaacacatctttattaataaagatctgcatgaaatataagctgggtgtttcagtcattgtaaaaccatactccaatgagtgcagcacggagctgacccattcgaaaatatattgttgaatctgttacaacatgtaactcaatcaaaatcaacgggttgtgcaaaagtcttcaactgtgaaccattaactagcagagtgggcaaattaactgtatgaaagatagtttgagtgttttaaagaatataacaagtatacttgtaaatcttattttatctgggacaattaaattgctcttttcgatctcccatttttcttctgggtttgataccggtggtggtggtttgggttccggggaaagataaagacgccctgcccctcttcccccactgccaggggctgctagaagctgcagttaggaggtctgcacccacccaccttgtataagcgattttctggtgtgtgcttcggggggatccgctgtggttgttgcctgcctgttcttatcgaaactcaccttgtgttgacaggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaatatactgaatgttaatgattctttagagccaaggtgggatttgggaatgatggggcgtgagtcattaatcaaaaacaaactgaagcagcaaaggtttttagtcctttcataaacgtcacacaatcatcttacctcctccacagtcacattaaatagatgtggtacctaaagtgataaagtgatccatcccactgttgttttcattttgaaacttcagactgacaatcctggcatttctgtttagacacaaaaatgatcaaagttcctactaacaagacagaattttctagaataccatttttgagatgttaatatctgtgcagaatccagatgagtggactgagagagtacctagattttttccaaagcataggttgtattgagaagaggaaaattcagattgtgttgttttacattgaaatgctgtttgatcagtaggtggtgccagagagcaagctagaatcatccatatttgtaccttaagccattctgtaaggttgtaatagcactcatttctgctgtcagcaaggattggtgaggaggggaggttactcttgggacagaagcatatttagaatattatgagaatacttagatacatttctaccacttttattcttctttctttgatctgtaatagttggacacaattttgatgacttgctatatttgccataatttctttattttcctatcatcaatgataatagtgagttattaactatgtttttggtaagaaacagaaaaggcttgcagtgtacaatgttagtgatttaaataattttgtcactttaaacttattgcttacagccctttagaaaaactgttctgcttttgaatttcagctgggaaacttccattgtcatggtcctatttcctatgtctttctcttttcccacttttttcaaccataaaggattttttcctgattataatgtgtattcaagatagaaaatatgaaaaacagaatattactaggaaaaaaatagaagttactaataatcttactgtccagatataaactatacagattgtaaccattttgatggacttcctatcagtctttttttttttttttgaggtggagtctcactctgttgcccaggctggagtgcagtggcgcaatctcagctcactacaagctccgcctcccgggttcacaccattctcctgcctcagcctcctgagtagctgggactctaggcacccgcaaccaagtccggctaattttttgtatttttagtagagacagggtttcaccgtagccaggatggtctcgatctcctgaccttgtgatccacccacctcggtctcccaaagtgctgggattacaggtgtgagccaccgtacctggcccctatcaatctttttttatgcttacgtatatatgttttctactccagttatgaagttgtagtttaattaagcataatattttttatattctatatttccttttgtatccttagatctctacctaccagctgccttccatatataatacatacacatacatacatacatacacatgcatgcatagagatgtacacacatgcatatttgatttgttggttgttttgtctttttacaaacaaaacagtaaaacttactctttggaataaattatacacagaattgtacaaacaccaagccaacaacttccagcccctccgtattctcaccccacccaaggtaagtaatgttaggtgctctgtgttcttaccaatatacgtagactcaaaagataacatagaaaaggtttttcctagttctatagtaattgtatcatactctgtacatttctctgcaacttgctttgattattccatttattgacagtcctgtgggtcaacaaaactagacctagtttttttaaataagtgttagagacatgccaggctttagtccgtcatcttgctattatgattcttcaggttgtttggggaatatttttgccattacgactgccccagtaaactctcatattcagctttttttttttttttttctgtaagtagattcaaaagtgtaagtttcacggagtttccatagtttgtacttgcataaatacggattaattttcacaatgatagtctcatccctgatgtgagctcaactacctttggaagttttatcactctgctgcgtgaaaatggttatctggcctttgtgcactcccctagctggtgctgtggtctgcgttttctgagacgtctctgcatagggctggttgaccatgtgtgcttctctcttctatgaacttagaactcttactccctccttttggttgttgggaagttggggacattaacccgacatcagtcacacattgctgagtttcttcccctcctgtcattgtcttttgactttacctgtggggctgtcaccatataaaaatgactgtctttttctgtagttagattcttctgtcgcttcatttgtggcacgtgtgttttctaagaacgtccatccttcccctgagattaaactggttttccctttagtgtttttactgcttgcttatttgtttttcaatggctccttgctgcagccagaattctttttttttttttttcttgttttgagacagagtctggctgtcgcccagcctggagtgccgtggcgcgatctcagctcactacctgctctgcctcccaggctcaggtgattctcctgcctcagcctcccacgtagctgggatcacaggcgtgtgccaccacacctggctaatttttgtatttttagtagagacgagatttcgccatgttggccatgctcgtcttaaactcctggcctccagtgatctgcccacctcggcctttcagagtgctgggattacagctcatgccaagaactcatatttatatgttatgatgaacaggtttgactgtccacttatgccaggaccatttgttaaatattattttcctgaaaactgaaatcctaatttaagccatcgtgtagataaagttcacaaatatacttccagaacttctttattctggaagattatagatctgagattcccaaagaagatctggctggccaacatgacatatttgattatactagcattaaggtaagcttaatcttttagacttacaaagcttcccccagctattattttccaaaatgttcttagcaattcttagatatttattcttccaaaggaactgttattttatccagtacctaaaccacccccaccaaaaaagaaaaccttttggagatttttattgaaattgcatcagtattttatatgaacttatcaaaagcacaactatgaaaatattaagtcttccacccaattttggctcactgcagcctccacctcctgggttcaagagattctcccacttcagcctcttgagtagctgggattacaggcgcctgccaccatgcctggctaatttttttgtgtgtatctttagtagagatggggtttcgccatgtggaccaggctggtcttgcactcctggcctcaagtgatccgcctgcctcggcctcccaaagtgctgggattacaggtgtgagccacggtgcccggtcctgtgttttcttattattccataattttatcataattgtgaataggaatttttgcatttgttgcaaacatcaagaaaagccaaaatagggtatatttgtctatattaaagaaaaattctcagtaatgaatggtatttattagaaattcttggtctctgataaatatgatttataattatctgatatagtcttttattttcagattgtttcatctcttcctttagaatatttttactacttattttgttttcttgtcctgttgctttagccagaacctccaaacaatgctgatacagctggcatccttgctgtgtccctaattctaacttcagaattttccaatgtaatatacaccactcctttggataatggtttttatggtacttaggtcattttcttccactccagttttcacttagagtgaaattgcttgaacccaggaggtggaggctgcagtgagccaaaattgcgccactgcactccagcctgggtgacagagtgcaactccatctcaaaaaaaaagaaacacagaccttatataatgaaaatagactacataatttgactgaataatgtttacaatggagttaaataagggtttttgagtggaagacttaatattttcatagtcattcttttgataagttcatataaaatactgatgcagttttacttatcagggtagcttgctgaattttatcaaatatcttcttaaaattgttagccgtaagtatttgggttttgcacttaaatatgttgacacagtgaatttgtgtagcatatagcctggtatgttaagtcaccttgcattcctggaagaaatcctcttggtcatgttgaattattcttccaaaacactgctggatttcgttttctaatatcttatctggaagttttgcaactctagttcatgtgctacataagagcattttggtcaacaacagactgcatgttacaatggtgatctcataagaataatggagctgaaacatttcttttttttattatactttaagttttagggtacatgtgcacaatgtgcaggttagttacatatgtatacacgtgccatgctggtgtgctgcgcccattaactcgtcatttagcattaggtatatctcctaatgctatccctctcccctccccccaccccacaacagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttggattggttccaagtctttgctattatgaatagtgccgcaataaacatatgtgtgcatgtgtctttatagcagcatgatttatagccctttgggtatatacccagcatgggatggctgggtcaaatggtatttctagttctagatctctgaggagctgaaacatttctattgcctactgatatcttgatgatcctgaccctgcataggctgaggctaatgcgcatgtttgtgtcttagtttgttttttttttaagttgaaaaagtaaaagaaaaaaataaaatagaaaaggcttatagaataaggatataaagaaagaatatttttgtacagttgtacaatgcttgtgttttaagctgagtgttattacaaaagattttgataagtcaaaatataattaatacatgtataaagtaaaacagttacaataagctatacttaatttactactgaagaaagacttttttaataaatttagagtagtctaagtgtacagtgtttataaggtctgcagtagtacacagtcatgacctaggccttcacattcactcaccactcacccactgactcacccagagcaacttccagtcctgcaagctccattcatgataagtgtcctaaacaggtgcaccatatttttatcttttataccatacttttactgtacttttgttttgttttgttttgtttttgagaaagggtattactctatcacccaggttggagtgcagtggcacaatcacagctcactgcagcctctacctccccaggctcaggtgatcctcccacctcagcctcccaagtagctgggaccacaggcatgtaccaccacatattttttgtagagatggggtgttgccattctgcccaggctggtctcaaactcctgggctcaagtgatccacccacctaagcctcccaaagtgctgggattacaggcatgagccaccacgcctgggctacagtaccttttctatgtttagttatatttagatagacaagtacttaccattgtgttaccattacctatagtactcagcacattcacgtgctgtatggatttctagcctaagagccataggctacgccctatttctcagaatggatccctgttgataagtggcaacgactgtatacacatacatgcagctggtctctagttttcttttttagtgctatctctgatttttgcttgtttcttatgcaactctaaaaataaattggagcttgtgcaactctaaaaataagctggagctcttttcttctttttcggtgacctgaaatagtttgactatctcagaaattatctgttctgttatcttggctgatactctttttcactgtaacattcttaacaaatttcccaattattttctgtaattactgatctgttcaggttgtataccttatctggatcaattttagtagtttatatttagcaaaagaaaaaacatcatttactctgctctaaattttcaattacgtggccctatgattccatttaactttctttttaaaatattttaatatctttagcatttgggggtccaccacctttcttgttactactggttttggggtttctttttttattgttgtatttttagtcttctacttagtatgctaagggtttacttatttagtcatttgtattaaagtaaaagtagcacttttgcttttatttatttctctacccctcctccatttcattcatttcagctttcagcattttttttttttttttttttttttgagacggagtctcgctctgtcaccaggctggagtgcagtggcgcgatctcggctcactgcaacctccacctctcgaattcaagcgattctcctgcctcagcctcccgaatagctgggactacaggtgcacgctaccacacccagctaatttttttgtatattttgtagagacggggtttcaccatgttgaccaggatagtcttgatctcttgacctcgtgatctgcccgccttggcctcccaaagtgctgggattgtaggtgtgagccaccatgcctggcctcagcttttattttaatacttctttcccctgcttttctttcattttattttgttattctaatttcatgtattaagttcacttagtctttagtaataaaaacatttaaagctatatattttccattatgccttcacctgtgttaaaagataattttttaagttaaaatcatgactgtcctacaaatataagattaacacgtcaagtatttaattcattaattaaagggggaatcagcaaactatcacaacaggctcaaaggaggattaacaaatgcatgattacataggcaatcaggaatgctgaaataaattcaccaacagatccaaaactggtcagtatctccagagtagtaattagctgtgttccatcaaacgaaatctgtttgcagtcctgtggatgagttatttgcaacactatctatttctgtaacttgcaaagttataaaatggccaggcatggtggttcacgcctataatctcagcactttgggaggccaaggcaaaaggatcacatgagcccaaggattccagaccagcttgagcagcataggggagaccctgtctctacaaatactattaataataaaaaaaaaaattggccgggtgtggtggtgtgcacctgtagccccaactactctagaggccgagattagaggatcacttgagctggggaggttgaggctgcagtgagctgtgatcatgtgccaccgcactctagccttggtgacagagtgagactgtgtctaaaaaaaaaaaaactaagtcgtaaaatagctcaaaaacaacaataaagagcactaacctctatagaagcagataatccagaactgggaactgacaggatatcctgtaatctttattgcctacaaaatcattcaaaacttgtccttatatccatccctataaacttttatatgacatgcccttctttccataaacttctagactttgttatttcagttttagggatggttagttggttgctttaaaggggatagggccagaatccaggggttatataaaggtatgtttcctatttttcaagtacaggcatgtttcggagatattgtgagtttggttccagaccaccacaataaagcaaatatcacaataaagtgagtcacacgtatttttaaatttcccagtgcatataaaagttatgtttataccatactatagtctattcagggcacaatagcattatgactttaaaaagtacatactttaatttaaaaatactatgttgctaaaaaaatgctgacaatcatatgagccttcagcaagttgcagtcattttgctgataaagggtcttcctcaatgctgatggctgctgacttatcagggttgtggttgctgaaggttggggtagctgtagtaatttcttaaaataagacaacaacaaagtttgccacatcaatggactcttcctcttttttgctttttttttttttttttttgagatggagtctcactctgtcgcccagggtggagtgcaatggcatgatctcaactcactacaacctccgcctcctgggttcaagcaattctcctgcctcagcctcctgagtagctgggactacaggtgcacgctaccacacccagctaatttttttgtatattttgtagagacggggtttcaccatgttggtcaggctggtctcaaactcctaaccttgtgatcagcccgcctcagcctcccaaagtgctgggattacaggcatgcgccaccgcacttggcctcttttttgccttttttggtataaatttaagggatacaagtgcatgcagttttgttacatggatatattgcatagaggtgaaatctgggcttttaatgtaactatcacccaaataatgtacattttacccattaagcaatttgtgtgtgtgtgtgtgtgtgtgtgtgtgtgtgtgtctgtgtgtgtgtgatgaagtctcactctgtcgcctaggctggagtgcagtggcgtaatctcggctcactgcaacctccgccgcccgagttcaagcaattctcctgcttcagtcttccatgtggctgggatcacaggcacatgccaccatgcccagctaatttttgtatttttagtagagatgggggtttcaccatcttggccagactggtctcgaactcctgacctcaggtcatccgcaaaccttggcctcccaaagtgctgggatcacaggtgtgagccaccgcgccaggcccattaagcaatttcttatcccttacctccctcccatccttctgagtctgtaatgtctactattccacactgtatgcccatgtataaatattattgagctcccacttataagtgagaccatgcggtgtttgactctctgtttctgagttatttcatgtaaaataatagcctccagtttcatctgtgttgctgcaaaagacataattaaatcttttcatgaaagatttctctgcagcatccaatgctgttggacatcattctactcacagtaagactgctttcaaaattggattcaatcctctcaaaacctgacactgcctaatcaactaaggctatgtaatattttaagttgtttgttgtcattttcacaatgttcagaacatctttaccaggagtcgattctatctcaaggaaccacttcctttgctcagccataagaagaaattcctcatccattcaagttctctcataagattgcagcaattcagccacatcttcaggttccacttctaattctagttctcttgcaatctctaccatctctgcagttacttcctccactgaggtcttgaaccccctcaagttcatttatgatggttggaatcaacttcttacaaactcctgctaaggttgatattttgacctccccccaagaatcatgaatgatcttcatggcatttagaatggtgaatccctcaccttgatgttctggtgaaaaaaataaatgaatattgaatcctttttagaaggtttccaatttactttgcccagatgcatcagaggaatcactatcaccgctatagtcttac

SEQ ID NO: 1025 - DNA, 3050 bp, Homo sapiens
ccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaat

SEQ ID NO: 1026 - protein, 708 aa, Homo sapiens
KEKSLHHVDQRPPLWHPGRPGTSQSAAMNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 1027 - DNA, 28614 bp, Mus musculus
  misc_feature (1)...(28614): n = A,T,C or G
gccgattctggaatggggattccggactctgttccaggaaaggagagatgcggagggagggagcctcaatcccccacctcggagggagcctcaacccgcccacccctttgcaaatccccctagttttctccctcttattgtaaagttgattccacattctgcctctccctccaacttctctctcctcgtccacagtcccataattggtttccctcctttggatacataagcacccacctacgccggtaacttgggcttccttcaccccctctctagtggcgccgcttttaaaagaaagagacccccaagtctccccaccctctctactaccctcttgggggcccctgggggaggggcgcacctctgggggaccccccgaggagggcgatctgttgcacgcgcccctcccaggccgagtgggggnnnnnnnnnnnnnnnnnnnnggccggggcccgggcagcgggtgcatggtcacccccctctggggcgcaccccccgctcctttatttatttttttgcacggatcccccgggcggcactgctcagcacacgcccgggaggtgaaaggggagaggtcgggttgcggctgacccggcctgagcctccacggagttcaggacctcagcgcggccgggagctgcgggcgagcccctcgtccctgcccgccgtgctgtcgccgaagaaaccgggaacgttgggaggagggagtccccctgggcctcccgctcgattccagctctccgcggatggtgggcggtgtgcggactctgcgcgctctgcttgggcgctcctgttttccccggagtgggatcctacttttcccaaacttaacgagtttatcaaagttcagtgaccttctacctcattgtatccccccccctgccccccagggcaactggaaggtcattgcttgttcgagggggcggatgtgagttttggggcgttggagcatcccacatcatagggccgggcagctgggatggactctttgtgccttggcccggggagctaggggtgggggtgcagatcatggagaggctgggtcgcttggtccacctggaacaaaagggttaaccctcagcccgcctgcttcctctggagaggaggggcgagctctcggccctgacccctcccctggtcctgcgatgacctcccttccccctccatttggggtgagcgcatactagtgttttttgttttgtttttttctcctatttagctggtggtggggactctgggggtgggcggcatggaggagtggcttgctatagaagggcttccgaaatctccgctggctggagtcgtagttaacctggctgcaccctgaggccgctgggcgcgcgctgccacccagccttgggaagcgagttttctgcggatcactcgcggtcggagcccggcctctggcgtgcgggcgccctctggagaccggccatgtgcggactgcgacacacacctggtgagtgaggttagctaggccggagacccgcacacgcgtgatctctgtggggtccccatcttctgcatcaacatcagtgtttgggaatcttctccaagagttcttaaaatgtgtttgtagggggacctcgattgtggttttgggaagaggttttttgtttttgttttaaaatttctttaatgcctgcattttgggatcacccttagtttagataaatcttttggaagcttttggatccctcttggtcggtctgtaggagaatgcaggtttttttttttttttttgagcaaggcaaatgaaatccgggcaataattagcagatcaaaaaatccgcaggtggtcaaggagaaggggcttacagtacttaaaggaaaattagcattttctcaaaagggttccaaatgccctttgtgctaaactggattacaaccttcagctattacgattcccaggtttttagtaatttagcgctcctcgccatccttcatcgacctgcctgtgcctggcttagttaaggtttcaagctaattcagtcttccccccaaaagggggagggggcttcttttttattcatttaattgcatgtaaaatgtgctccctaaccctcggaggttctccactgccagtaaacgatactttgtcattggtgatggggattaaggggatttcagtttaagtaggggaccgggagccgttttgggggagctgaggcatggttatttttgaatctcctccttttggatgtaaaatgtcaaatgagaatttggggaaaagaattttggcaggattcagtacgaggaagctcggcgttgcattctgggtgtaaccttgcctaggtggactagtgtacccccacttattcacccagctttttgggtccttgtgtacagtggcagtgaaaaagttttctatagactccttgcatgttgaggtaatttcatccacggaatgacagttttcactggaacctgctatgtggcaggctccagcctgggacctcgaaggacctcaccgttaattctcacaacctgaagtagttttggtatttcgctcccttgaataaaggctcccgggtggcaagggtcgcccagtggttcccctcccacttgactttagccttcttgaatccatggggtgtttgttgttggttctagagcaagggggatgtactcattagtaagggacagcctagccatggtgcttgaagctgctttggtttggtgacacccccccccccagtctgtctgtgtagtaaccatgacagctttctaacctgtcccagccttgtcacgctcttgtctttgcctctgaagctgagattggaggaatgtgccgctaaatccagtgcccatttgatttttcaaattgccttttagaaactgtgggtgatgagacttcccagcaagcaactcaagagctaacgtcatttgggtttctttcttggggttacgtgattttgaaaaagaaaaaaaaaaaaagccaaaccaaataggagatgaatttgggaggttaccgtaatcactctaatctctacttttttaacaaacacagctaacacacacaggttaaagccttggttggtgcaggctctagacagccttgtttcatcccagggagagacctctgatctctcttggggttggcaagctcgttcagttgaggcaagtatcccttactcttatgtaaggcatattttatataaagcgtcttctgaccctcctacccttaaaaacttgaattattgattgcgtgtgctgccaccctgtgagtgagcattcagaggacgggagggctgatctatctggggtcattcattcattagctgtggccagcgtcttaccctttcaaaaccttttccacaggcccctgaagtttaatccgtgattgttttttgatttctgcaactcttgattaagtagaaacttaatttcaagtcaaatttgacctctctatgtagattttaaggcttgctgtttgaaactggttttaaaaataaagctcctacagctggatctgtaatatataatcccttttgttttttggtaaggatttatcctggaggtagggcagggtctaggatactgtgtgctttaggtaaactgttcattgtctttctttaatacaggaccagtaacagataagcccaaggcaccaggcttttatcaagatacacagatttcaattttttttttttttgtttctgcttttagctgttttgagtgtcttctgcctcctggctgattagctttcttcctatacaatagtaagcgcattttctattcatctgggtgagattgaatcgaaagacccctgctggctttactgcattcttcctacttactggataactagatgctgaagagataacattcctaaaattcggggtgggggatggaagccacgcttgctggagttatccctgtggactttgccttccttcccttcaggttaatttaagcatagccagcaattgttcctaacagggtcctctttctccttggcaaatactccgtcacattatttgccgacggtggtatggacgaggtagttttttactgcctaagcaaacatcggctacagttttaagtgggatgcctggtgcagcggtcaggctgcagggggagaggcttcggggcttgtgtatacagtgaaggcggttggcatcccggtagtaaatcactctgagctggtgtatccttcgggagcagagatgcttaaccttttttgtgccatagctcccttctcagctgagtgctgagcggacgcagggtaccagggaaagcaggtacagtgatgtatgaacaatgatcagaaacgaaaaaattcagccctcttgtctttccctttgcaagctctgggaaatgactaagagggccctgggctggctattgtttctggctgtttctcccctaaacaatgcagcctgaaaactatttacatagtgtttgcattgcatgtgggcatgctaaatcccggagattaaagtttgggagttggagatactgctcagtgggagagctacacccttagctggtgtgagggcttgggctctataccccatgtgggggtggggggcaaaccagagggtgtgccagacaggatcccttagagtctccaactttgtctgctctccacctccctttaaaatatcaggggaatattatagtaatgttaatattctgttaataaaatgacaggttagggtggcacggtgtggttggagaactctttgacttttatttatttagttttttttttttttttttccttttttgaggtagggattctctatgttattctggctgtctgtgacatgctatggctgtctgtggcatgctgtgttctggccttttaaagacagacagggatgtggtccagttggtagagtgctggcccagcgtgtatgaagcaatatttgcagccctgcaggaaacttaaactggatctggtgttgcttgcatttatttggagcattagggagctggaagctggagatgagcggtacaaggccatctggatgccctggtaggaaggtggacagacttaactaggtaggcatcaggtaaaactgggcattggtagtttccagagtgggcgagaaggaagggcggagggatggagaggctgacgtcactggaagcacttctgatccagttggtaccggtttagagggatcttgagggtcccggaaacagaggcaagctagtctctggattcgaggccagcctggtataccgggtgatttacatacagggtagccagggctacacagaaatcctgtctcaatcaaacagaaaaggaccttcccaaagtacccaccccgctttctatcccacttccctatagacattcatgtctgacacacccataccctgcccagcctgcttcctgcctttcaaaaattcctttctttccgaagaattgaggcaaagcctgaagtgctgggatattacaatcctggttgaggcatatgctcaacaagcttgaggctgccttgtgagatccgggccagcgtggcctgcgggaccctggttcagacatcagtaaagactcttgtgtggttcttttagagaaaacaaagttattttggggtggtttactgttttgttttatttacgtggaaacttggtagatcaagagctgttggtgattgttaattaatgtgggaattgtgtgcagccagttgctgaggtagacgagttggttttttttttttggtttttagacacagggtttctctgtgtagctctggccgtcctggagctcactttgtagaccaggctggcctcgaactcagaaatccgcctgcctctgcctcccgagtgctgggattacaggcgtgtgccaccacgcccagcctaattttttttccattttttattaggtatttagctcatttacatttccaatgctataccaaaaagtcccccatacccacccaccccaattttttttaaagattcgtttatttattatattgtaagtacaccgtagctgtcttcagacactccagaagagggagtcagatcttgttatggatggttgtgagccaccatgtggttgctgggatccctgagccagccctgtttgttttatttttaaaagagaaaggggctggtgagatggctcagtgggtaagagtacccgactgctcttccaaaggtctggggttcaaatcccagcaaccacatggtggctcacaaccatccataacgagatctgatgccttcttctgttgtgtctgaagacagctacagtgtacttacatataataagtaaataaatcttaaaaaaaaaaaagagagataaagggtttctcttagtatagccccagctgtcctggaactctctgtagaccaggctggccttgaactcagagatccacctgcctctgcttcctgaatgctgggattaaaggaagtgcgtgccacctcgcccgtcttatttgtatattttcttgttatgttcatgcctggttaatgtttgagatgtggaatctccttgaactagagtttcagttaagagcaaacatgtaggtgctaggaatcgaaccccggtcctctggaaggacagcaagtgaggagccgtggtacctgacccatgcctgctgtgttcgggagggtcctgaacgttgcagtatttggacaggatcagactctccatgtcaaggtagcccaggctggcctagaagttaagaacctctaggactgtcattacaggtagtcggcttacatcctaattttaaattttttatcgtgggtctcctgtatctgaggacacctcatatgtcaccaaggatggtctggaacttcttatcctctgcctggctgggtgctattattccaggagtgtacaatcacaagacttcactctgtgtcgaggatggaatacaggtgtatgcttcgcgctgcccaactcccagctctccgttgttgttgtgagagagagaagacgggcaagcagtgtcttctactggctttttttttttttttttttttttttttttaaacattctctttttttttttaagatttatttattatatgtaagtacactgtagctgtcttcagacactccagaagagggagtcagatctcgttacggatggttgtgagccaccatgtggttgctgggatttgaactctggaccttcggaagagcagtcgggtgctcttacacactgagccatctcaccagccccttctactggctttaatgtgtttcttgtttcatggtttcctatccagcaggattcccctcccccatcccctagacttactgttgagaaagaaaagggcattgtgttcataggacatgtgtgtgtactagggaaagacctagctcgggtcccagcatcccctcaccccccctcagtgaaagctgctgggtgatctacaaggctccagttggtcactgtggtgagggacttgtcacagcacgtcgacagttttctattagcttttgtgaatgagggtgtatatgggtgtgtgtgtgtgtgtgtgtgtgtgtgtatatatatatatatggatatgtgtgtatcatgtacatacacaggtaccaacaggacactagattccctggaactggaattatacatgcctctgtgtgggtgctgggagttgaacctgggtcctgtgcaagagcagccactactcccattcagtgaaccatctcgagcccccgataaacttttttttttttttttggtttttcgagacagggtttctctgtgtagtcctggctgtcccagaactcactctgtagaccaggctggccttgaactcagaaatccacctgcctctgcctcccaagtgctgggattaaaggcgtgcgccaccacgcccggcaaacttttgttttcttaaagatttattttatttattatacgtgagaacactgtagctgtttccagacactccagaagagggtgtcagatcttgttatggacggttgtaagccaccatgtggttgctgggatttgaactcagggccttcgggagagcagtcagtgctcctaactactgagccatctctccagccccctgataaactttaaaaagactaatttatttatttatttgagtacactgtagctgtcttcagacacaccagaagagggcatcggatcccatgacagatggttgtgagcccctgcatggtggctaggaattaaactcaggatctctggaagagccatctcgccagatgatgaacatttttttttgttgttttttgtttcttttcgaggcacggtttctctgtgcagccccggctatcttggaactcactttgtagaccaggctggtctcgaacttagaaatctgcctgcctctgcctcccaagtgctgggattaaagatgagtgccaccacgcccggctgctgataaacaggtgcctgcagatgctcttcctatcccgtagtccaaaatcagcaacagttgagggttttattaaggctgcgctaggttgaacttggtggccacatcggtggtgcggtgaggctcgaggttgaatccagtctcccctgtcacgcatggattctgcacttgggaggatgaggcagggcagtgagtcctttttcgatcagcctggccgtgtgagactcagaacacaacactgaaactcccacaggttgtcctgacgtccatatatggtatagcatgagcaagcacatccatacggccacagacttggtgaataataaagggaggaaggactccgagtcccgagctccagtctgtcgaagacatcgcgtttgcaccctcccaatgttgaggcgaccaaacagaacagccctaacttggatcctctttgtttaacatgggacagcagtgaatgttgtagttgtagggtgtcggcctcccggaattgcttatctctactttgctctctctatatttatgtaaaagcttgttttttagagttcgatgctgccaggctctctccttgagagggcgtgaagtctgtctgcatctttgccagcctttgtcagtagcttttctcatggagacgtagctgtagaacgatccttgtccttaaatttaacacccagtgtcccgtgttctgtactccaagtgatcgtgtaggtggtgctggggacttaactcagaaccgcctgcaagctgggccagccctccaccaactctagctgctaatggctggaacttgctcatctctggggttgggtgaggttctgatttattctttccatttcgcctgtgtcgtggtggagatcagtgtgatttggccctgtccattagtctgtgcaagccagcaccgaaggagacatagggattgatggggttaatttaacagctatctagtgggacgtagtgccacgtggctatctataatcctagctcctgggaggctggaggtaggattgctacaaagttcctatgtaaaatagctgtgtatctccgtattgctgtaacaaactactacaagttggcttaaacggtggtcgattgattttcatggatgtgaaatgtctggattgagtgactgactgggttcttcctcagggctcggggaagctgatagattcctgtggtttcagcagttcttggtgggggcccttgactccatctctgtcttgactcttggggccctgttctctgggactgtgactcacaggtcccaattcttcttcttggagtgatgcgaataaacacttaacattcgccaaaacccctgtccaatccaggcatgggaaaacaggctcttgtaatctcaggactctggaaatagaggtagggagggttaggagttcaaagccagcctctgctacaaagcaggtttgagactgcctgggctaagggagatcctaaaaaacgatccagatagttatgccagacaggcatggggctgcaggcttgctcgtgttatcctattcggtcctataggctatatataggagacttagtgtcccttatacaatcctcctgagtcaggacatgtgctgatggggaattgattactgctggtcacttgacatcccttctcagggcatcctgctcacctttttctctcctttcacaggtgctccagtgaactcccctgggaactgcgatgaagcctcagaggactccataccggtgaagcggccccggcgggaggacactcacatctgcaacaaatgctgtgccgagttctttagtctctctgaattcatggaacacaagaaaagttgcactaaaacccctcctgtcctcatcatgaatgacagcgaggggccagtgccttcagaggacttttccagagctgccctgagccaccagctgggcagcccaagcaataaagacagtctccaggagaacggcagcagctcgggggacttgaagaagctgggcacggactccatcctgtacttgaagacagaggctacccagccatccacaccccaggacataagctatttacccaaaggcaaagtagccaacaccaatgtgactctgcaggcgctccgcggcaccaaggtggccgtgaaccaacggggtgcagaggcacccatggcgcccatgcctgctgcccaaggcatcccttgggtcctggagcagatcctgtgcctgcagcagcagcaactccagcaaatccagcttacggaacagattcgcgtccaggtgaacatgtgggcagcgcacgcgctccactctggagtggcgggggccgacacgctgaaggccttaagcagccatgtgtctcagcaagtgtccgtgtcccagcaggtgtcggctgccgtggccctgctcagccagaaagcctcaaacccagctctgtcgctcgatgccttgaaacaagccaagctacctcatgccagcgtcccctccgcagccagcccgttgtcctcggggttaacgtccttcaccttgaagcctgacgggacacgggttctccccaacttcgtgtctcgccttcccagtgccctgctacctcagactccgggctctgtgctcctgcagagtcccttctccgctgtgacgctcgaccagtccaagaaaggaaaggggaaaccccagaacctctccgcctctgcctcggtgttagatgtcaaggccaaggacgaagtcgtcctcggtaagcacaagtgtaggtactgtcccaaggttttcgggacagatagctcccttcagattcaccttcgctcccacaccggagagagaccttacgtgtgccctatctgtggtcaccgcttcaccaccaagggcaatctcaaggtccacttacaacgacaccctgaggtgaaggcaaacccccagctgttggccgaattccaggacaaaggggcagtgagtgccgcttctcactatgcactccctgtccccgtccctgccgatgaatcgagtctctctgtagacgccgagcctgtcccggtcacgggaaccccttctctagggctgcctcaaaagctcacgtcagggcctaattccagggacctcatgggtggctccttgcccaatgacatgcagccagggccttctccagaaagtgaggcgggccttccactccttggggtggggatgatacataatcccccaaaggctgggggcttccagggcactggggccccagagtcagggtccgagaccctgaaattgcagcaactagtggagaacatagacaaggccactactgaccccaacgagtgtctcatttgtcatcgggtcctcagctgtcagagttccctgaagatgcattaccgtacccacacaggggagagaccattccagtgcaagatctgtggccgggccttctccaccaaaggcaacctgaagacacaccttggggttcaccgaaccaacacgaccgtaaagacccaacattcgtgccccatctgccagaagaaattcaccaacgccgtcatgttacagcagcatatccggatgcacatgggtggccagatccccaacacccctctgccagagagtccctgtgacttcacggctcccgagcccgtggccgtcagtgagaatggcagtgccagcggggtctgccaggacgacgcagcagaagggatggaagccgaggaggtctgttctcaggatgttcccagtggcccctcaactgtctctctgccggttcccagtgcccacctggcatcgccctctctgggcttctctgtgttggcctccctggatacgcaggggaaaggggctcttccggcgctggccctgcagaggcagagcagtcgagaaaacagctccctggagggcggtgacactggtccagccaatgactcttccttgctcgtgggtgaccaggagtgtcagagccgaagcccagatgccacggagaccatgtgctaccaggcagtgtcacccgccaatagccaagccggaagtgtcaagtcccggtctcccgagggtcacaaggccgagggcgtggagagctgccgcgttgacaccgaaggtgatgaggctttggatttcctttaaggtcccttttgggctcaaggtcaccagaaaaagaacctaggttgaacttgacagtgtgacctgaagcagcttctttaagggcaattagctgttctgttctgggtctcgggatctaataaccgcctttatcctgacacccagtaggctggtagcgtggttcctagaggttgagtgtgcccaatatgaaatgttggttttgttttgattttttttttttctttgaccccatggggacatgggtgacggtagccatatcactgtgttcagggaagcaggccccatttggactgtgaaatcaagccatatttgcctgatttagaggtctggctatgaaacgagttcagatatgagaggtactgcctgccttattgtagatgccttagctgaggggtcccttgatcctaactagaacccaagttcctaggtgggacttaaaggtgactttcttcattgtgctgccaggatttcaaccaagggtgtctctcctggttgacatccccgaccttccatcctgttttttttgtttgtttgtttgttttttttgttttgtttgtttttaagatagggtctcatcactgtgttgtagactaggatggctttgaacttgagtagtttgcctcgacctctcaagtgttggggttgcagtcatgcactcccggatcaggctttttcaagggttggcaggaggataccagctggggttctttcttcagatcctcctgcctcgccctctcacgtagctgcaatgataagcccagaccttaaaggtgatatcttacgttgagtcttaggtgctatctgtacacatatttctatgttacctatactttaaaccataaaaaacgtccattttccaaagtgtttgagcctctgttttcttttcatgaagaactctggggcggggctagcaattgagcccttgtctcccatgcatggtgatctgagttaagttctccagaacacatgtgcaaaggccatgtgtgctggggtgtgcttgtacctggtgttggctgatgggagacaagctgatagcttagacccctctcgatattctagactcaggagagagcctgtctcaaagaggtgggtgataccagaaaaacaacacccaaaggctgcccttcatgtacacacacacacacacacacacacacacacacacgcgagcgcgcacatacaagaaggtcagaggaagctgctattgaaaaataatttctgtaaggaaaatctagcaggcaactgcagagcgtttgtcttattatttacttatttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaaaaaccaaaaaacaacaacaaaaagttaaaaatctctccctttctccacattaggtcgtaccagcctccctccaacatttatccgagcacagcccacctttgtcaaagttgaagtgcctggcacctttgtgggaccccccagcatgccctcgggtatgccgcctttgctagcatcgcagccgcagccacgccgccaggccaagcagcactgctgcacacggtgtggaaagaacttctcgtctgccagtgccctgcagatccacgagcgaacacacacgggagagaagcctttcgtgtgtaacatatgcgggcgggccttcaccacgaaaggcaacctgaaggtgggttccgacgggcgttggtgtgtgacgtctgtgtgcacagagaacatccattggttcatgtgtctcagatactataaacctagcaataccagaggcagaagcaggggtcctctgagttcgaggccagcttggtgtacatagtaagactaggttattctggcacttgcactgtagaccaggctggcctctcagatcttcctgcctctgcctgtaagcggtaaaagtcttgctttgtgtgaaaactcctaatccttctgactgggtgagccatcatacctgtgcgctgtctctctgtctgtctgtctgtctctgtctgtctttctctctatatacatatatatgtatgtatgtgtgtatatgtatatatatatatatatatacatatacatatatacacacacacatcagagccttgtactcagggaggttagaagacgattctcaggcaggcactaaagtaaattgtgtatgcgctagctaccgtgtaggttctgcgagtcaaacctcaggacctgtaagagcaatgagtgatcccaaccactaccccgtctctatccccaagttgtgatgctcttgaacttggcgacatataaaactgttgtagtcacatgtgagtcactcggaatcccagtcgtctggggggggggttgcagtcgggggcctaggtcgacatctcagggttgaatgcgttgctcttcttgcagaagacctgagctcaattctcatctcctatgtgggacggctcacaccacttggtgttggggatacgctggtttcatctcagcattaccagaaaatccatagactgcacattggtgccgggtgaagctgggctggcagtgcctgtctaaagctcatctctgtcaccctctaatccagccttgctcgtctcacttcttgggaggtgaaggcagtggggcaagggagagccagtattgaatgtcagtctcagctaggaaagattcttgtctcttcgtttgtcttgttttttgtttgtatggtttctgacacagggtttttctgtgtagccctggctttcctgtaactggctctggctctcttagactaggctggcctctttaaaaaaaaaaaaaaaaaaaaaaaagttggccagaacatcaggctaggaactgaaattgccttaatttaggactaaaaaagcttaattagtccactggtcctgcctgactgtcgagtgcttttcttgttgaggggtctgagcaggtgaggtgccttggtttctgcaggcagtggatgctggggtcagaactcctgcttacaggtatccattgccaggcctttccagcagctgctagcctcagcttaggatgctagagacgacctggagaggatgtgttgccaatgcgttgcccgggagcctgatcctgtagaggcttttgaatgtcagccaggggcgggtgagatagctcagtggttaagagtgcatacatactgctgcagaggggctggtccattcctagcacccatgcccggtggtttagcaactgccagtaagcttaactttgggctcggggtggggtgggggaacctgatgtctctggcctccgtgtacatgtacgcttacaacacgtgcgtgtgcacactcaaacacacataatttaaaagaataaaggaagaaaatttatttttaattgagacagtttctctgtgtggccctggctgtcctggaactccttctgtagaccaggctggcctcgaactcagagatcacctgtctctgcctcccgagtgctgggattaaaggtgtcagccgggcagtggtacccacacacaagcatgctctcaactgtatagatactacctgcatttattattttctggcttactgatacaagatctgactgtagcccaggctgccccttccaccacactctgaccactggtgtgaacgtgaagccagctgacttgggcttgcctacaagcagggggaccatctgatgaaaccctctctctgctgtcccccaacaggtacactacatgactcatggggccaacaataactccgcccgccggggaaggaagctggccatagagaaccccatggtcgcgctgagtgctgagggaaagagagcgcccgaggtgttttccaaggagctcctgtcccccgcggtgagtgtggaccccgcctcctggaaccagtacaccagcgtcctgaatgggggtctggccatgaagaccaacgagatctccgtgatccagagcggaggcatccccacgctgcctgtgtcgctgggggccagctctgtggtgagcaatggcacgatttccaagcttgacggctctcagaccggtgtgagcatgcccatgagcgggaacggagaaaagctcgctgttcccgacggcatggccaaacaccagttccctcacttcctggaggaaaataagattgccgtcagctaaggaggaagaggagaggagtcttctgcagggagattctagaatctgctttattctttagtttttttttttttttttttttcttaacccacctcctttttttattttcttcctcttcctgatatgcaagtgatgtggcttgtgaccatagccttgggcaatcctacaatcacgagagttgctatgctgctttccaaaaaaaagatgaaaaatggaggaaaagtgaaaaacaacaaaaacaaaccaaaaaaaataatgataaaaagccagactttttatttttgtttttaaaccattttggaaagaagcgggttttgaaaaatagttctgttaatttgggacaaattatattctagaagctttgtgtgacctcatggctgtttccaaagactgtcatcaacctgtttcgaagtgaaacagttgggactcattggaccacagtggaagtgacaactccttaacccagtcctggggtgagggtgtggtgtccttctgtggtgactaatgcgggtaaatgtagggacctggttttatgcctcccgaccctgtcttcatcctctgttttttttttttttttgtttttgattttgttttttttaaatgtactttaagagaaaaggagaagagaatgccagaaaactaagatggttcaattaatccacttccttcagccttatgcccttggataggacatcctccatacaccggccatggtccctcggaaagcccacaatttctcctgctgcttccttaaatatttcagagcccctagagtatgcctccaacccctgctaccccatctcccacaaaccaccttcccaggccccagggtggggacaggcaccagagtgggcacctcaggagattttccgaggttgtcttcagtgcccgctacattggaaaactgcctgtttcctagtggcaccaggagggttgcctcgactccacgtgcatgctatcctttctgtttatttcggttattccaagacccaaagaccttcacacccacccaccctccgccgcctgccgtcatgaaggttatagagttgagaccagcaagtcttggatgtgagggctttaatttatctacctcaattatctttatttttgtagccaaaagtcttctctattttgctatttttgcgaccacccaagtattgccaggtcttaaacctaagagttcttatactggtaagaaggccccgaagctcaagaagtcttcgtggttggttctgtgggttttgtttttgtttttaattacatttttgttcgtgtaataattctgaacagctgttgtaacagtgttccgatggtttagtgaggtaggagagatttctccagtctctgggtagaaaattctgcctgccgtgttgaatgcccttgccaaatgaagatggagactctcgcccagtgtttcctctgacttgttgcacctgattttaggatccaaaacttgttttgttgttacttctttctttttctctttctttttttcgccaagtcgtgcctttccttctgggattgtaagtgaaccccgtgatcaagtgttcaccggttcacctgtttacactgtgaagtgggtatcttacggagaacacaccagccttggttttctcacgccccgtgaatgaatgtgtacgccacagttttacctgctgatactgtaaggtctgaaaataaagtgaatgttttccctccatgaggcgggcttgtgtgtatgcttttctggtatggtctgctttcaaagcactcccccgatccaattttagagtctgacacacatatatgtggttaggtccattctggcccctaatgtagggggcatgtgtgagggttgcgtttatattaacacacacacacacacacgcttgcagaagactgcttgtggaggacacacacacacacacacacaggagcttgcagaagactgcttgtggaggccagacacacacggacacacacacacacacacacaggagcttgcagaagactacttgtggaggccagacacacacggacacacacacacacacacacacacacacacaggagcttgcagaatactgcttgtggaggacacacacacaaacacacacggacacacacacgcttgcagaagactgcttgtggaggacacacacacacggacacacacgcttgcagaagactgcttgtggaggacggacacacacacacacactggagcttgcagaagactacttgtggaggccagacacacacggacacacacacacacacaggagcttgcagaagactacttgtggaggccagacacacacacacacacacacacacacaggagcttgcagaagactgcttgtggaggacacggacacacacgcttgcagaagactgcttgtggaggacggacacacacacacacaggaacttgcagaagactacttgtggaggccagacacacacggacacacacacacacacacacaggagcttgcagaatactgcttgtggaggacacacacacaaacacacacggacacacacacgcttgcagaagactgcttgtggaggacacacacacggacacacacgcttgcagaagactgcttgtggaggacacacacacacacacacacacacacgcttgcagaagactgcttgtggaggacagaggatcactgaatgggattaactctggtgggtgctgggcattgaactggggccgtcagacttggcaaaggtgttgttggttgctgagccttatgtttgtcacacagttttgttttgttttgttttgttttttttaaatctcatgtagtatccagtctggctgagaactcacaatagtccctttggggtgggtggcgttttgttttttaatatgcaactcttcagacatggcatgcatgatcttcccatgacagcaaccaggaacttgtggttctaagcttgcctgggcaatgggggtggggagggcttcaagtcccaggagctaccttgtgatcttgtgttctgtccctaatatgaaatagcagctaatctggccccattgcttcctttagtgccgtcccttggcaaggggctttgccagtacagggaccgctctctgtagttggttatccaaacaaaaaccgtttaagagcatcagttttatagaagaaagggaaaggctggctttcagggctgggaagttacttagtcttgcccagaaattgctgtagatcatgcttgtgacactctggctgattctgagcaacaaaataatgcttttgcagaagagtgacctgccctgtgttcaaggccatcaggattgaggcatggagaccttgcaagtccatccaagaggttgggcagcttgtactttggtttttttgtttttaattatgaatcaagcctcggggaaaaccgctcctagcatagctaacactaaggatttcaaaacagagaaaaatgaacttccaagaaactggacttctgcctcaccctatagccctccagctaagcagaacacttaaattacatactatcaggaagattgaaatgaatttacaaactggtgggaaacatagctgatacccacagggcaaacctttagtgggtgggaccatctgcctttccatggcagccatttataacaaaatagcccaaagctaactcaggtctaggttatcccagctgatggacaaggtaggatatccattctctcggggtctcctgcgagcttccaaaagacccttccaaggacagtttctctttcctgttgagtctagcatcttagtgcctggactgttccaagcaggcccttagtgagaacagtgagatggaatcctaccttggattcccctgcacttcctggaacactttctggaaacaacagtattgtagattaaagccaggtgtgggtccacacccataatccccactctaggaattgaggaaaaaggtaaattcaaggctagtctggctggctgtatgatactgagtgtaagaatgtagattctgtagctatccggcctggccctataaacactgctttccaaagacaaaagacagggattgggttattaaaaggtaaacatgtgtcccaaacttctgatcctagcattggggaggcccagtgagggttgaacacctctaatcctagcacttggcagatctctgtgaattcaaagctaacgtggtctacagttgaagttccaggacaaccagagctacacagagaaaccctggcttgaaaataagttgaaattagctcctactatatatataggaactcagagagatctgcccgcctttgtgccccgtaagtctgtgattaaaggcatataccaccatgccctcctcaaaacatttaagcaagttctacttgtttttattactcacgagggtgtgtgtgtgagccagttgtgagtgtggaggtcagaggagactccgtggcagctgaacctttcctcccgcctagatcggggacattcaactccggccctccaggcttggtggcaaacacctttaactgctgagctgtctaggtagctgtcatttcatgtgcatgtgtgtgcttctgtgtgtgtgtgtgcgcgcgcgcacgcgtgcatatgtgtgtctgctactgtgcaaggtggtgtctgcttaagagtgtgtgcatgtgtgtgtgtacgtgcgcgcacacatgtacacatcttcgaaagcgcccatatgaatggcgtgggtcagaggatagccccggggagtcttctcagtaacacctttacatgggcgtgggacctagatgactgttcagccacagtctgccttcgcctgagccagctcattagtcagatccaaaaaagagcatgtaagcagcctactgcatgggggtccacttagagctcaaagctctgtggcctgaaggaagaggctcaggtatattccagttcatacctgttgctatccatggagggattcatgtgagtcacgggaaacctgctggctgccatttctgatgtctggaaagcaagagtggactggaccagcttatttgaagatctttcttttttatagcttttttttttttttctgagacagggtttctctgtgtagttctggctgtcctggaactcactctgtagaccaggctggcctcaaactcagaaatctgcctgcctctgcctcccaagtgctgggattaaaggtgtgcgccaccacgcccggcttttatagctttttttttttttggcttttcctcaggacgatattttattttatttttccattttttattcttttatagctttttttaaaaaaataatgttctttctcatttaattaattaattttttaatttttaaatttattatatgtaagtacactgtagctgtcttcagacaccccagaagagggcgccagatctcattacggatggttgtgagccaccatgtggttgccgggatttgaactcaggaccttcggtcagtgctcttaactgctgagccatctcctcagcccctcaaagatctttctagacacccaggagtcagagacacccagcccattgaacggatggggctggtttcctttatttttttgagacaggttctcgccatgtagctcagaatagcctggaactccccttgtagcccagcagagcctctaactcattggataccgaggctttaagtgtctctctcttccagagagtggcttatgagagtgaaaccttttaaaaagaactttgtttgttttaggtgggacttgtacttaattccagcactcaggaggctgaggcagaaaaattggctagcctgggctacctatggagactatgtcacacacaggcacattctgctgccctggagccttgcccatacagtgcttctggcatgcatgctagccctgctattgctcatggctgactaatgttccttccaacgctgcctatctgagctctgtcacagacaaggaactggagccctgcagagcatggggtctgccgggaggagtttcacagctggaaggtgctggaagcctccagggtcctggctgatcagttgctcttgctacattttgggtccagagagggtattagccataggagccaagggagtgcctgaatgtatgtggggcagcatttgcttggtgctccaaagggttccggtagctgtggctctgctgtgacctgacccatatcccgatggatgactgagtgtggagcccagccctgctccctgatgatgccgtggttctgtgctggcggctcggagttcctgtgccttgctggtgaaatgggtttagttatttggatttagtggggagggctattggtgaaagacccccgacgtgggtagtcaatcaatctgaggagaccctctcaaggaccagcgagaccacgattcggatgcaaacagcaagaggctttattgggaacacgggtacccgggcgacgcagtctatcggaggactggcgcgccgagtgtggagtttttaccctttttatagggctggggctggggagcaaaaagcgcggttacagaagcgagaagcgagctggttggttagttcgaataaggcttggggtatttctcggtcatttggggaaactgaggtgggactttttagttctaaacaatgtctatttttaagaaatgggtatgggaggggtacgaggaaagggtctaatgaaggttcaacaatgggcacacacctggtcagaacattggcagacacacaggttcaaggagtggccagagcactgtgcacctctatttttttaaatcagtgaagctagttctgctaacactgacgtctgagagccatctgttcttggccctgagccggggcccaggtgcttgaccaccgatatttggcccctgtcccagtattattcagccttaatctttaactgttaatctttaactgaactttcttgtaacttttgagaactcagctctggtactttttcatgccttgcaaaatggcgttactgcagctagcttgctaagcctgatggtggggtctttcattcccccctctttctggaaactgaataaaatcttttattcacgtgattccacttcttctggatctattgatttgagttggtgatactgttgggtcaaaactagggcctgcactaccgaaattctgtcttttacaaactggaccaagcggttgagaatacagggtccgaagagtaggattaataaaagtattatcaaggggcccataatggtggatattaaggtcgtgaaccatggggacctgttaaacagtccctcaaaccacccttgtcctgattcgaacaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttttggggtttgatggtgctagggaccaaacccggtcctccagcctgttaaccattctaccactgagctacacgcccccccccccatcccccagaatataagtttttatgaagacacttcgtcagagctctgtgtggaaccctaccccaacccctgcaataaacactttaattagtaagataagtagactgtaatgtgccgcggttgattcgtgtctccttgttaaatgcagggactgtgccaggtgattcttaggaaaaacctgacttaaacaaggtctgcctaataggtgtgcaggtgtaggagtttacctggggaacttgaagcccacccctgacctcattttagactatgaaatgagaatctggggtctcgacggtgacctctgtgctcacagattcacccacctgctgaattttgaaatgtgaagaatggaaatgacctgtgtatcctgatggtgccagcttgccctccgt

SEQ ID NO: 1028 - DNA, 4780 bp, Mus musculus
gtgctccagtgaactcccctgggaactgcgatgaagcctcagaggactccataccggtgaagcggccccggcgggaggacactcacatctgcaacaaatgctgtgccgagttctttagtctctctgaattcatggaacacaagaaaagttgcactaaaacccctcctgtcctcatcatgaatgacagcgaggggccagtgccttcagaggacttttccagagctgccctgagccaccagctgggcagcccaagcaataaagacagtctccaggagaacggcagcagctcgggggacttgaagaagctgggcacggactccatcctgtacttgaagacagaggctacccagccatccacaccccaggacataagctatttacccaaaggcaaagtagccaacaccaatgtgactctgcaggcgctccgcggcaccaaggtggccgtgaaccaacggggtgcagaggcacccatggcgcccatgcctgctgcccaaggcatcccttgggtcctggagcagatcctgtgcctgcagcagcagcaactccagcaaatccagcttacggaacagattcgcgtccaggtgaacatgtgggcagcgcacgcgctccactctggagtggcgggggccgacacgctgaaggccttaagcagccatgtgtctcagcaagtgtccgtgtcccagcaggtgtcggctgccgtggccctgctcagccagaaagcctcaaacccagctctgtcgctcgatgccttgaaacaagccaagctacctcatgccagcgtcccctccgcagccagcccgttgtcctcggggttaacgtccttcaccttgaagcctgacgggacacgggttctccccaacttcgtgtctcgccttcccagtgccctgctacctcagactccgggctctgtgctcctgcagagtcccttctccgctgtgacgctcgaccagtccaagaaaggaaaggggaaaccccagaacctctccgcctctgcctcggtgttagatgtcaaggccaaggacgaagtcgtcctcggtaagcacaagtgtaggtactgtcccaaggttttcgggacagatagctcccttcagattcaccttcgctcccacaccggagagagaccttacgtgtgccctatctgtggtcaccgcttcaccaccaagggcaatctcaaggtccacttacaacgacaccctgaggtgaaggcaaacccccagctgttggccgaattccaggacaaaggggcagtgagtgccgcttctcactatgcactccctgtccccgtccctgccgatgaatcgagtctctctgtagacgccgagcctgtcccggtcacgggaaccccttctctagggctgcctcaaaagctcacgtcagggcctaattccagggacctcatgggtggctccttgcccaatgacatgcagccagggccttctccagaaagtgaggcgggccttccactccttggggtggggatgatacataatcccccaaaggctgggggcttccagggcactggggccccagagtcagggtccgagaccctgaaattgcagcaactagtggagaacatagacaaggccactactgaccccaacgagtgtctcatttgtcatcgggtcctcagctgtcagagttccctgaagatgcattaccgtacccacacaggggagagaccattccagtgcaagatctgtggccgggccttctccaccaaaggcaacctgaagacacaccttggggttcaccgaaccaacacgaccgtaaagacccaacattcgtgccccatctgccagaagaaattcaccaacgccgtcatgttacagcagcatatccggatgcacatgggtggccagatccccaacacccctctgccagagagtccctgtgacttcacggctcccgagcccgtggccgtcagtgagaatggcagtgccagcggggtctgccaggacgacgcagcagaagggatggaagccgaggaggtctgttctcaggatgttcccagtggcccctcaactgtctctctgccggttcccagtgcccacctggcatcgccctctctgggcttctctgtgttggcctccctggatacgcaggggaaaggggctcttccggcgctggccctgcagaggcagagcagtcgagaaaacagctccctggagggcggtgacactggtccagccaatgactcttccttgctcgtgggtgaccaggagtgtcagagccgaagcccagatgccacggagaccatgtgctaccaggcagtgtcacccgccaatagccaagccggaagtgtcaagtcccggtctcccgagggtcacaaggccgagggcgtggagagctgccgcgttgacaccgaaggtcgtaccagcctccctccaacatttatccgagcacagcccacctttgtcaaagttgaagtgcctggcacctttgtgggaccccccagcatgccctcgggtatgccgcctttgctagcatcgcagccgcagccacgccgccaggccaagcagcactgctgcacacggtgtggaaagaacttctcgtctgccagtgccctgcagatccacgagcgaacacacacgggagagaagcctttcgtgtgtaacatatgcgggcgggccttcaccacgaaaggcaacctgaaggtacactacatgactcatggggccaacaataactccgcccgccggggaaggaagctggccatagagaaccccatggtcgcgctgagtgctgagggaaagagagcgcccgaggtgttttccaaggagctcctgtcccccgcggtgagtgtggaccccgcctcctggaaccagtacaccagcgtcctgaatgggggtctggccatgaagaccaacgagatctccgtgatccagagcggaggcatccccacgctgcctgtgtcgctgggggccagctctgtggtgagcaatggcacgatttccaagcttgacggctctcagaccggtgtgagcatgcccatgagcgggaacggagaaaagctcgctgttcccgacggcatggccaaacaccagttccctcacttcctggaggaaaataagattgccgtcagctaaggaggaagaggagaggagtcttctgcagggagattctagaatctgctttattctttagtttttttttttttttttttttcttaacccacctcctttttttattttcttcctcttcctgatatgcaagtgatgtggcttgtgaccatagccttgggcaatcctacaatcacgagagttgctatgctgctttccaaaaaaaagatgaaaaatggaggaaaagtgaaaaacaacaaaaacaaaccaaaaaaaataatgataaaaagccagactttttatttttgtttttaaaccattttggaaagaagcgggttttgaaaaatagttctgttaatttgggacaaattatattctagaagctttgtgtgacctcatggctgtttccaaagactgtcatcaacctgtttcgaagtgaaacagttgggactcattggaccacagtggaagtgacaactccttaacccagtcctggggtgagggtgtggtgtccttctgtggtgactaatgcgggtaaatgtagggacctggttttatgcctcccgaccctgtcttcatcctctgttttttttttttttttgtttttgattttgttttttttaaatgtactttaagagaaaaggagaagagaatgccagaaaactaagatggttcaattaatccacttccttcagccttatgcccttggataggacatcctccatacaccggccatggtccctcggaaagcccacaatttctcctgctgcttccttaaatatttcagagcccctagagtatgcctccaacccctgctaccccatctcccacaaaccaccttcccaggccccagggtggggacaggcaccagagtgggcacctcaggagattttccgaggttgtcttcagtgcccgctacattggaaaactgcctgtttcctagtggcaccaggagggttgcctcgactccacgtgcatgctatcctttctgtttatttcggttattccaagacccaaagaccttcacacccacccaccctccgccgcctgccgtcatgaaggttatagagttgagaccagcaagtcttggatgtgagggctttaatttatctacctcaattatctttatttttgtagccaaaagtcttctctattttgctatttttgcgaccacccaagtattgccaggtcttaaacctaagagttcttatactggtaagaaggccccgaagctcaagaagtcttcgtggttggttctgtgggttttgtttttgtttttaattacatttttgttcgtgtaataattctgaacagctgttgtaacagtgttccgatggtttagtgaggtaggagagatttctccagtctctgggtagaaaattctgcctgccgtgttgaatgcccttgccaaatgaagatggagactctcgcccagtgtttcctctgacttgttgcacctgattttaggatccaaaacttgttttgttgttacttctttctttttctctttctttttttcgccaagtcgtgcctttccttctgggattgtaagtgaaccccgtgatcaagtgttcaccggttcacctgtttacactgtgaagtgggtatcttacggagaacacaccagccttggttttctcacgccccgtgaatgaatgtgtacgccacagttttacctgctgatactgtaaggtctgaaaataaagtgaatgttttccctc

SEQ ID NO: 1029 - protein, 1027 aa, Mus musculus
APVNSPGNCDEASEDSIPVKRPRREDTHICNKCCAEFFSLSEFMEHKKSCTKTPPVLIMNDSEGPVPSEDFSRAALSHQLGSPSNKDSLQENGSSSGDLKKLGTDSILYLKTEATQPSTPQDISYLPKGKVANTNVTLQALRGTKVAVNQRGAEAPMAPMPAAQGIPWVLEQILCLQQQQLQQIQLTEQIRVQVNMWAAHALHSGVAGADTLKALSSHVSQQVSVSQQVSAAVALLSQKASNPALSLDALKQAKLPHASVPSAASPLSSGLTSFTLKPDGTRVLPNFVSRLPSALLPQTPGSVLLQSPFSAVTLDQSKKGKGKPQNLSASASVLDVKAKDEVVLGKHKCRYCPKVFGTDSSLQIHLRSHTGERPYVCPICGHRFTTKGNLKVHLQRHPEVKANPQLLAEFQDKGAVSAASHYALPVPVPADESSLSVDAEPVPVTGTPSLGLPQKLTSGPNSRDLMGGSLPNDMQPGPSPESEAGLPLLGVGMIHNPPKAGGFQGTGAPESGSETLKLQQLVENIDKATTDPNECLICHRVLSCQSSLKMHYRTHTGERPFQCKICGRAFSTKGNLKTHLGVHRTNTTVKTQHSCPICQKKFTNAVMLQQHIRMHMGGQIPNTPLPESPCDFTAPEPVAVSENGSASGVCQDDAAEGMEAEEVCSQDVPSGPSTVSLPVPSAHLASPSLGFSVLASLDTQGKGALPALALQRQSSRENSSLEGGDTGPANDSSLLVGDQECQSRSPDATETMCYQAVSPANSQAGSVKSRSPEGHKAEGVESCRVDTEGRTSLPPTFIRAQPTFVKVEVPGTFVGPPSMPSGMPPLLASQPQPRRQAKQHCCTRCGKNFSSASALQIHERTHTGEKPFVCNICGRAFTTKGNLKVHYMTHGANNNSARRGRKLAIENPMVALSAEGKRAPEVFSKELLSPAVSVDPASWNQYTSVLNGGLAMKTNEISVIQSGGIPTLPVSLGASSVVSNGTISKLDGSQTGVSMPMSGNGEKLAVPDGMAKHQFPHFLEENKIAVS

SEQ ID NO: 1030 - DNA, 39768 bp, Homo sapiens
aaattaaataactccgactccaaaactatcatgtatgttgtgcgtctgcttaatattatgagaaagcttaaacattcctgctgtaccctgaaataattcatgtggtaatagatgtttcctaaacactaattatatgccaggggcttcacacaaatcatttctgatttttgcagcgaagccacaagcagcgattaccctccccattgactagggaagaaatcaaggcatagagaggttgagaacctggaggaaattatccagcccagatggaaactgccaagaagcaagatctacatctgggtctgtctgactgtgcttgtcgactctgctgtctttaagaaattaacttgcagatcatttggagagtgaagaaagggagatgactcctttcttattctctgtgtttaactcttgttctgtttcctaggggtttatgccttctgttttggtttttccctttattcctctacatttatcatcctcctttgtttttcttcttcttcagcatttgctctcttctcttctcgcctacccagttggcttttctctctttccctccatttctctctttagttacccacaccagactagggccaagtcatttgtttacttgagcgtctgagcgagaaaagaagtttaaaatctctccacacattaaaacaaagaaaagaacattttatattccctttcatggtcaaaagatgatcctttcttccccttcacagaatccatttaggtgtttatagagcagttatcttaacaatgactgtcctttgcttttctctgtgttccaattaacattcttaattgcctcgttctaaacgtctcactttttgtgtgttgcctagagttctctgacaagtttatttttaattataatttatattgcaaagccggatagatatttataacagtcaactttccattgtgccgcgcttttagctctttaagctttgttataataaagtttgcagcgaatttgaagaagcgccttctcagtaatagtttttaaacatagagtttacaataggcactttttaggggactaaggggttggatttgtgcctggtagataacaaaaaaaaattttcttttaaggcaagagaaaacttttaagaagggttttggacgccagtacagaaatatttaagtaaagagtgaatcagacttatgtaaaaaggaaatgaaaaggaaagcatttctagcagaaaaaaaaatgttcaatcaattgaacctttgacttgtttttgaaaatctatacatttctgctgtccagttacgcaatatgtgagtgtcccgataagcatgtttatgagatgacccatttagcttgatcactcatgttactgaggccctggtcttgcacaagagcctacaaaaggagtaagatagtatttgaaaaaagctctcaaagggctgtgaatctgtgaaattcatttcaacattcacttcagaaagactcaagatggtaggccttaaggcaagaaatccaaaatttggacagagccgtctatgagcaaagacgttccctgaaatgttactaaagtaaagacaaagatctcaaatacacaacaggggttggttaagtgaattaaaggttcatccacagagtgaaaaaataacaaaacacatttacaaagatttctttcaatgcggcaggagaatcttatgatagcccattcagtgaaataaacagaattccaaaatgttatctttctctaatctgcaggcggagaagtagataaattactcaaatcatcacatgagtgaatataagacggtaattgtgcaatctttgagggaaagggtcgaaatgctgaagtttgatttagttgggaaggttaagaagcctcccctggagaagataagaggatttgattgtgacttaatactttttagaaaggactttactattttttttttaatggtattagttaggtgctaatatagccttgaaatcatattacctgtaagcctcgtttctcatctctggcaccgttgaccttttgggtcagctattcctttgttgtggaggttatcctgggcattgtaggatcttaagcatgaccccgggcctctacctactagacagtagtgacaaccgaaaatgtctctagacattgccaaatgtcccctggtgggggaaaaggcacattgtccccattaagaactgctgctgtggacttagagaaccaacattctcgactgtatgtgtgtgcctgagattgaccgaaagactgcatgcttggactagcatgagtttcaagcgactgaggagtaaaaaaagctagtcacacaaactattttatttatttattttttttgagacggagtctcgctctgtcacccaggctggagtgcagtggcacgatctcggctcactgcaagctccgcctcccaggttcaaacgattctcctgcctcagcctcccgagtagctgggactacaggggcccgccaccaagcccggctaatttttgtatttttagtagagacagggtttcaccgtgttagccaggatggtctcgatctcctgacctcgtgatccacccacctcggcctcccaaagtgctgggattacaggagtgagccaccatgcccggccaaatcttttattcttaatccatttagtctttaaccagcaaatttacagaagaaagtatcatttctgacaattcactcttgctttaataagcttgttggaaatttttttttttttttttttggagacggagtttcgctcttgtcgtccaggctggagtgcaatggcatgatcttggcttactgcaaccgccgcctcccgggttcaagtgattctcctgcctcagcctcccaagtagctgggattacaggcgcccgctaccatgcctgctaattttttttttgttaagtagagacagggtttcaccatgttggccaggctggtctcgaactcctgacctcagatgccccacccacctcggcctcccaaatattgggattacaggtgtgagccaccacgcccagacagaatttttttgtttctttgagacagagtcttactctgtcccaggctggagtgctgttgcgcgatctcggctcattgcaacctctgcctcctgggttcaagcaattctcctgcctcagccttctgagtagctgggattacaggcgcaaaccaccacgtctggctaatttttgtatttttagtagagacagggttttaccatgttggccaggctgtctcgaacttctgacctcgtgatctgttggcctcgacctcccaaagtgttgggattacaggcgtgagccattgtgccaggcccttttttgtttgtttgttttttaagactgactctcactctgttgcccaggctggagtgcagtggcatgaacaaggctcgctgcagcctcaaactcctgggctcaatcaatccttccacctcagtctcctgagtagctggaactacaggtacacaccaccatgcctgattaatttatttgtttgttttgttttgtttttctgaaacagggtctcgctccgtcacccaggctggaatgcagtggcacgataacagctcaccgcagcctcgacttctccaggctcaggtgatctcccacctcagcctccagagtagctgggactataggtgcgtgccaccatgcctggctaatttttttgtggtttattttctgtagagatggggactccctatgttgtccaggctgctctcaaactcctgggctgggctcaagcagtcctctggtctcagcctcctaaagtgctagaatacaggtatgagccacggtgtctggcctggaatatttttaccattttttttttttttttgaatacacagttgtaggcttcaatacatcagctgcaactaagaagactaattggagctagaaattgttcaataccaatttggaattgatgaaatggcaacaagcagagagatattaaaatgggggaaatatcatcagttaagtggtgattattgcaattagccaactttgcgaacataaatcgtcccagcagaagggctctgggccaggacactcagaaaagtggacatttggccccataataaaacagtcccattgaattacaagcatgattttggaggcaattttagcttaacttctaaatctctagaatttgaagagtgccttccagacatcaagccttccatttggggtaggcagatatcaaatgtactatgatacataaaagtccatagactctaagacgttggtccatgttaagatacttcccaaatccaacccttacatttcccaaattgaagcagctgtggttaccaagtcagtcgactttgcttcctggcatgaataaacagaggtccaaaggggcaatacttttgcagtggcagatcatgatttatgggactcaacctcgctactttagtcatttcgagcttaagatgctgggaatcccacacagaaaaaaacacacacataactgtggtcctttcaatgacagggatagccaagtatgtaattgtcttcctaaaaaccatttcatgtacatatgctttacatatcatgaaactcactcactgtgagtgtacagttgaattatttttagtaaatccatacagtatgcagccatcgtgataatctagtttgtaattgcctttttttctctgcaattgtgttaaaatacacttaacataagatttactgtctgacccatctttaagtgtgctgttttgaaatgttgagtacattgacattgttgagcaaccaatttccagatctctctctttcttttttctttttttttttttctttcgagttggagtctcgctttgtctcccaagctgtagtgcagtggcaccatctgggcaacctccgcctcccaggttcaagtgattctcctgcctcagcctcccaagtagctgggattgcaggtgcccaccaccacgcccatttaatttttgtacttttagtagagatggggtttcaccatgttggtcagggtggtctcgaactcccgaactcatgatccgcctgccttggcctcccaaagtgctgggattacaggcgtgagccaccgtgcccagtccagatcttttaaaaaaaaaaattattgtgtatatttaaggcatactacatgatgttatgggatttatatagatagtaaaaagattaccagtgaagcaaatgaacctatccgtcttgcattgttacctgattttgtttgtttttgtggcaaagcagctaaaatctaaacatttatctagatcccttttcatcttgcaaaactggaacttcatgcctattgagcagaaacggcccctccaccccccactctccctccctccagcccctggcaaccaccattctactttttgtctctatgaatttaactactctatttgtccttctgtgactggctcattttacttggcataatgtcttcaagtttcatccatgttggctgggcatggtggctcacgcctgtaatcccagaactttgggaggccgaggcgggcggatcacaaggtgaggagatgaagaccatcctggctaacatggtgaaaccccatctctactaaaaaaacaaaaaattagccgggcgtggtggtgggcttctgtagtcccagctactcgggaggctgaggcaggagaatggcgtgaacccgggaggcggagcttgcagtgagccaagatcgcaccactgcactcctgggtgacagagcgagactctgtctcaaaaaacaacaacaaaaaaacccaaaagaaaacaaagattcatccatgtggtaccatgtgtcagaatttccttcctttttaaggctgagtaatattccattgtatggatagactgcatttactttattcattcatctgtccatggacacttgagttgtttccactttttggctattgtgaataattctgctgtgaacatgggtatataaatactgcttcgagaccctgctttcaattcttttggatatatacccacatgtggaattgctggatcatatggtaatccttttttacatttgttgaggaactgccatctagagtggctgcagcattttacattcccacctactatattgcctttaacacttcatttcatattcaggcctctaaagttactcagcatggattgagtccatcgctatttatttgttgtgacttctgtgttccattactgtggctaagtgctaaggacaccgtgatgacggtgtctaccctcacggagcctgcagtgtgagaaataagcaataaacagatacatgagaaagtctgtcattatatattttgaagtgcgctataaaaagaaagatatggtttcttgaagcctgagagaactaataaatgagacctagtttggaagagggaaggctggtttcaggaagggaaatttgaagagattataggctttttaggagtgggccaggtgaagagaggcaagcagtggaaaggaagacgattccttgtagaaaagagcagaggtggggttttcagggaaagatctgccttccactgagacctgtgcaaagttactgaatccataatttggcatgcattcgttagtactcgctaggagctgatgggagcaatgagcttctgtttttccataaatgaagtagaaataagccggacacggtggctcacgtctgtaatcccagcactttgggaggctgaggtgggcctcacttgaggtcaggagttggagacaactggtgaacatggtgaaaccccatctctactaaaaatacaaaaattagccgagtgtggtggcatgtgcttatagtcccaggtactcaggaggctgaggcaggagaatcgcttgaacccaggcagaggttgcaatgagcagagatcgtgccactgcattccagcctgggtgacaagagtggtctgtctcaaaaaaaaaaaaaaaaaaaaaaaaggaattaaaaaaggatattagtgaggataaaatgggattatgcatcccaaatctccttataaacaataagactgctgaaaaatataccaagaagtgtattttttgaatattcctgcctggcacaaacattgaacatgactggattacataaacattgacaatgactggattatataaacccagtcacctaacaaaggacgttaacatgaaaaagtttaatatcatcctttactctgaacattttcttttcaagcttgggtcccaaccaggtcctttggtttaataaataacttttttgttgttgttttttcatgagacagagtctcactctgtcgcccaggttggagtgcagtagctagatcttggctcactgcaaccaccgcctcctggattcaagtgattctcctccgtcaggctcctgagtagctgggattacaggcatgcgccaccacaaccagctaatttttgtatttttagtagagatggagttttaccgtgttggccaggctagtctcgaactcctgacctctggtgacccgccagtcttggcctcccagagtgctgggattacaggcgtgagacactgtgctcagcctgaaacaacttttgattacggacttgcctgttgctatgccctccgttcatcccctgctttgctctaggacttactttattttccaccaactggctcctggctgcagctgttaaactgggggtagattcaaaacatgtactgtgtcctgcttttcttgatatgacatttgtggaaggtttccatttgagggaaacttcttgacttcatctgttggagtgatttctgaagacccaagatttttctaggacactttaaatttagtttactgtactccgatttttcttctttagctatcttctctatattcagctatagttggaagacaggtattaggatgtgatagaattttggagtcagacttagaaactgaccaccggcttagaaactgaccaccagctcagccagtttctaattaagtcacttcatgtctttgagcctcagtttcaaaatggagaggacaatagggccaacctccatgggaagataaaacaaggcggtgtgcattcatttaatgcagtctgtggcatgtacaaggggctcaatcaattattattattactatcacttggagagtcaagcggcacaattttgtctcgtagtaaggctaacatgttacaactatcatctactaaaataaatataaacaactatataaatgaaattttccttaacccaatagtattttttgagccataaacccactgcacattcgtttagatttgtaagttagatctcctgccacactatcttacacagaaaaggtgttgagaatattagtagattagtcagcaaggcaggtgctaattggcctttttactcagtatcagaattctaaactgcttctaggtattattaaaccaaattcttaccttttcaatctggctgttggctataattctgtcttacttgctttaaatattatacataaaataaggcaagactttttcagagactcaaaaattgaaggttaatcttccttcaacaagtttttactgatggccacgaatataaaaaagatgatcaagctgatttattttctgccttgggttgtccaaatacccaggtgaacacattgatgagcccagcattccattttgcttgtattcctgatgagtttacaagctgggaacgtgatgaataactaatcaagagaatgcaatgcacaaatgtggagggagggtttatatctgcacagtcccttacaatgaagtaaatgccaaacaaagacgcatgcccagagcagttatggaaagaccaatcaaagacttagcaggttgatgatttcatcattcatttaacatttattgagcatgtacattgtgtaaagcagttagccaaattaagtatacatgaatttacggtataaatgtgtatacatgtaatatatcatatacacacacacaagccccactttaaaaaattccaggcatcatgtgtcaatgatacaatcactttgaacgatacaccttttctgtaataatgtgtgtattgcacaaaaaaattccaatagtgattagtaacaaccagatactgtgacagtgccccattgccattccatgggagatgcaagagcattgtctcagtaataaaatatgatgttatcaggcatttatggctcctggggaaaaaaatgcaattgcttgctgttttgatattatctctgactatgcttgcttatcatttgccatttctatatttagtagccagtcattttgaagttaaaaaaaaaatcaaggtttgcattgtaaccacaaaccagtctttgtgaacaggaatcctggaggctattaatcagcttttaaaggaggtaagtcatggtggtggtggggtatctgaaattttggaagttccgagctcactttaagagttgagatgggtgggagggctgaaaacaccaccattcatcattcttcagttatctcgagactcaacttaaacatttttaatcaaaaagatgggaggggacacgggtcacatctcaggtttgggggaatgtgtgtgcgtgtagatgtgaaaactgagccaaaatattccactgtgaagagatctcccttctcggctggtggacatcaaccttaccaagtaatctttggagcaagtaactaccaaatacagccgttccaaaacttctacgtaagctcctactttttaatgagtacgcatttctccccattttcttttcctctccaaggactgagatagctggagcaaggatgggtccccctctgatttcgtccccgccccagccaatctgagcccggatgctaattagctgcgctcccctgatgaacacgcctttgtcacaagtaggcccggactacaaagcccagaatgcctcacccctccctgatcaatgagggcttatttaaatgatctctgaggtcttggacccaggccaatcagctgtcagggctcatgataaatcgcaatgcattattgataataataattactgggacatgcgcgttccggccgaaggggggtaaatttcccaactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgagtggggctggggcgcccgcccggggaggggagcttcccggacgtacgcgggatcctcgagggcgcaggcttcggggagcgggcggcgtccagcgcaaattcaggagccgagatttgggggctcagtgcccgggaggagaggtctcctcctctccccaccaccccgccttttgcacatttcacacttttttcctcttctcccctcttgtgtaagtttcacccccagctttctcccctaattgtaaaattgacccccactcgctcctctgttctcgctcccgaaaggttcccttctccttgtcctctgcccctcacttaattggttccactcccctcactggtgttacccccccccccttgtaacttaggtccccctccctcgcgtcgctctcaaaagaaagaaccccgggggatccccaccctctccaccagccccttggggcttttcttggaggctggaggaggggcgcacccctggaagaccccccggaggaggacgatctgttgcacgcgcccctcccgggccaagtggggggagggggcgcgacctctccccaccctcaggagctggggtgcgggccacccgcgctgcgcaggggattggagggcccagagaggtgggggaggagggctcaatgtttccctttaaaatttttttcttttctggatttcgccttttctgcccgggctgcgccgcctgccgatcttcgccctaacctttcggggcctgacctccagccatctttgatttccgacttcctaaaaataaccgcggcaagcccgagggtgcgagcccccagtggccggggtggcgggcgcgcggcagccccactggggtgcaccggcctcccgttttgcgtggcttttctggagcgctcggctttccacatttgcgcttgggtgtgaaaggggagaggtggggggccagagcgaactcccgcggctgacctggcccacgcttccgcggccagcgtttcccagatcgaggggagttcgggaccccagccgcgccaggaacggcggggccaactctgttcccacttcatcacttcaccgcggaggttttaggagcgaggcggttttccactatctcgtctccatcccggcccgccaaattgtcgcctgataagtttttagcgtgcgcgtggggggaggggggatttgtagcctcctctccggccttgttcgtcgctccgctccccgcctgctttctaatttccctgcagcagacgggtgtgcgcggcaaccccggaggactctcagagaccatctctgatacccggggtttcccgagaagacggtcgccactttttggcttccgtatccccgcctttttgtcggagactgaatgtaatacatttcccaagtttataatacgtcaatagaattccccgtttaacatttttccagggcaaattaaaaggatcggcttgacggagtggatggctgggcgttttcggggcgccgggtggtcagcgcagcgcgcacccgaggtcccaggcgcctggagggactctctttgtgccttggttgggggcggggtggggtgggggttgaggggagcgtgaaggcttcgtggcctggcccacctggaacaaaagggttaaccctcagcccgcctgcttcctccggagaggaggggcgagctcctggctctgacccctcccctggtcctacgctgacctccccttcccccttcattttgggtgggcgcacacacgtggggcttttggtggtgtttggcacctttcgggagggaagcttgttacgagagggcttctgaaattaacgatggttggagtttggaatcagagtcaacctgagctgagctaaaacctcgggcctggccgtgcgctgccactgcgatttgggagggaggggagttggctattgatcaccagggttgtcgcggacagcccacccggcttgcgcgcgggcgccccctggaggcccagcttgaagcctagccctttgctgggaggcggggtcccttcgcaggtactggctcacacctggtgggtgggacgggttgtgggggtgaatggagagtgctgggctgggccaaggatgggtaccctaggggattcgtgccggtcgcctgcttgatcgtcgtctgtgcccgctgttctttgccaagtgtggaattcttggtaataactcctggcggctagaatgtgtttgcagagcctccaattgcctccttgggagagaaggttgttttcccaagcagtgcgtttttaatggctgcgtttgggttgtttgcatttgagctgcctaaaattatatgtgttaggtatataatgtagacatacatatctaacttagatgtatgtatatgtctcacataattttttagaatgcagattgagctggtcttattttgcaaagccattcgagaatgcagtttttgagggaggaaaatgacgtctggcgatcaattagcagatcaaaaaatctgcaggtggtcgcagggctaacactacatacaggaaaaattagcattttctcaaaagagtttcaaatgccctttgtgctaaactggattacaaacatcaacgattaggattcccaagtttcgaataacttcctatttccaattactcaccaaaatgacctacgctggcttagaaggattttgacgttagttaacgtttcaggtcaactttctacgttagacttcatgtgggtttcccatagggagagaagctacaatttgccaaacagctccttttgttgaataaaaatgtgcagtgcagaagcaaatgatactttgtcattcgtgctgctgttagtgagcttcctcctgggctgtgggttggggaaccatcttgggaggcagaaggcagttagcatttccttttttaaaatgtgaagtgttaggttgatgcctgggaagtcaggttttagaatgggatccgcgttccactgtggctgtgtgactttcagctgtgtaaccttgaagccagcttggtggcgttttctgtttttttgttttttctgagtttttgggttcctcctctatatagcagtgataaaatgccctgtttagataatttcaactatagaagggctactatgaattgggaatgtgatcagtcttaattttgttcaaaataccaaaatgtttttatttgtgtttattgtgtcaagatggtgttgagctgccagttgaggcaatctagcagaaatggcagtgtgctgcctgccagacaccaggctggggactcgagtgcgctatctttaattcaagatattaaagaccaaaagtgatagtcatgtttttactcattttaaattgcagcacctgtttgaaatggctttgcccgtggtgccttgccctgcttgatggcccatggtgtcttgtcctgcctcgccccagagcccaaggaactgttttttttgttttgttttgttttgttttgttttgtttttattggttttttaaaaataaccttaggtcagttggtgatgtgatgagatgttctttttggcatcttcgacaagggagccgtgattggtgcttggctggttgggtttggtggcctctcctctgccatcttaaatgttgggatgtgccttcacacggtttagatgaagaggtcccagaaataaaacaatgttggagtttggtcggcttctctgggttgtactaccctggaaaaattgatggcgaaaagagttccagaagttgtcccttcctcatcacctttagcctacagtacttttgactattttttaaaatgtctaaacatttttaaaagccactaaatccagataagaactgcatcgccagtcaccacaatccccccccacccccgccccaacaaattgtatgtctgtgtcaggatttgttcaggggggctctggagacaggcgacaaaaacccctgccctcatggagtttgcaaacttgcctgatctctagttggggacgagtgggacacttccctaaccttggaagcaaacagaagtcacacgccttagcgcctgtgaaactttctttgagccatttactctttttttcctctccagcagcatccccgaattttggttcaaggctgtttgaaactttgccttttttagatcttaattaggtggaaacttaaagtcttatctgccttctatgaattgagttgaaggctttttgactgctaaaattaagctgctaaagaggcagttttctttcaactggttaaatacttaagaaggcacataatttccttttgttttttggtaagcaattatcctggggttgggggagggtagaagatgttgtgtgctttagataatctactcattgtcgttctttaaatgtaggaatgaaaaaaagataagcttgagtcataatgcttttatcaagatatacaggttttactttttaagcatttcagtgtctccagaatttgattggccactagtagatgaactttcttcctatacaatagtaagagtattttctatccatttggcagtgattgaatctaagacccctgctgggtttactgcattcttccaacttattggataactagatgctgcaagataacattcctaaaattcggggtgggggtggggtggagaaatggaagaactagttgctgtgtaatccctctgaactttgctttttttttttcctttttggttaacttaagcatgcccagcaattgttcataacagaatcttcttactccttggcaaatacagttgcggtatttaccagtggtggcctggatgtagaagcactttttactgcacaagcaaacagagctgctgctgttttaagagtcaagtgggatgttgctggtggaggctacagaagaggcaagcttgtgtatacagcaaaggcaagctggtattcaggctgtaaatcactctgggaactgctggatccttctaggggagggagcttaaccttttttgtgccatagatcccttctcaacatagtgtataaaatacatagatgaccaaggaaataaattgcattgaaatacagtcatcaaaaatgaaaacatttttaacttagtaatatcagctactttattaatacaataaataacaagatctagtagcctgtcagataacaagaatttccaagtcataacaacttgtaacactatatgaaaatatctgtggtctccactgatgacaaagtcacaagttctattaataccactgtggtatgttgcttatattcatcattgaaagaaaggttgaattttagttcagcttagtgaaaattagtatttttttcttatctaatttcatagaccccctgtttaaaaatgcctgtgttaaatagaacatgcattttcaatcaagtgatattttcaccaatgggatgaaaacgttttattgatagtacagtggtttgtggccttccaaaggagataaatgtatataatatgtttgtgatattagaactttataagtggggagctattagggaaaaataacttaaaagcctccatagaggggcaaaataaaaaagtttctcccacagaggggagaaactccgctctagaagaaacgattatgaattgggccactaattttagtgctgttaaatagtatttaagtcacctctgtattgtgactagcaagcagtatgtcatcttgagccatttagttctgagcctgttttccacatctgcaaaatggaaacaaaggagcttgtttgattatgtggctatgaagataagcgacctaaggcaagggtgtctaatcttttggcttccctggtccacattggaagaagaattatcttgggccacacataaaagacacggacagtaatgatagctgatgagcttaaaacaaattgtaaaactatctcacgttttaagaaagtttatgaatttgtgttgggctgaattcaaagctggcctgggcctggtttggacaagcttgccttaaggtgtaagagtatgaagtatgtttttgttcttgcttggagaggttggtggtggttagctttggcctctaaaaagtagtatggagtggttaatgtttttgcatgggctttattgagggttttttttttcttttcttttctttctttctttctttttttttttttttttgagacagtcttgttctgttgcccaggctggagtgcagtggcgcaatctcggctcactgcaacctccacctcccgggttcaagcaattctcccacctcagcctcccgagtagctgggattccagcgatgcgcacaccatcacacctggctaatttttctatttttagtagagacagagtttcaccatgttggccaggctggtctcaaactcctgaacccaggtgatccacccacctcggcctcccaaagtgctgggattacaggtgtgagccgctgtgcccagccttggtcttctttatttctggaggctataaagcgttcgccttttctgcaccctaacttatttaaccaaaatcttactgatggaccaaggtgcatccattttgttgctgtttgttaacatgagaaatgctgcaagtacattgaggaaattcctaaagcaggaattgctgggtcaaaggaaaattgtactaaaatgaagatgttgccagatgactccctgaaagagctgtatctgtctatacactcgtaccagcagcgtgtatttccttccctaacaagagaaactgttttaaaaagtttcacttcttaacattcttgacacataattgtcaaaattgcttttctagaaagattgtgccacctagcactcccactagtgctggtttccagtcttggaaaatcatacagatagatactatttatctgagagttggcggttcccagataaatagttgccagggttctgggaattgacgaacatttttatctgtttttgtttttgtttttttgacacggagtctcgctctgtcgcccaggctggagtgcagtggcactgtctcggctcactgcaacctctgcctcccgggttcacgccattctcctgcctcagcctccccagtagctgggactacaggcgcccaccaccgtgctcggctaattttttgtattgttagtagagatggagtttcaccgtgttagccaggatggtcttgatctcctgaccttgtgagccaccgtgcccggccgaacatttttatctggatcactgaagtgaggcagattcgcagcagtattggggccttaagaaaggagagtttgtgctggtacctgctactagaactctacctggaagtagcagcatcgcactgcatcttaacactttcagagcaacttctggaagtcctagaaatgagacaggaatgggtggtcgactcccaccccttcctaaccaaggcaacctcccaggctttcctgtcccatcttaacatctctgtgagaggaaagaaagttgcaatctttacagaagaaacatgatcagaggggtacaaatgaagggttccaatagagggtgtgggaactgcatgtctggggtttaatactggctctgcagtttacttaacatgttagcttgggcaagttcatgtcctctgtgcctcagtttccccttctgtcaaatagggtaatagtttctatttcagagttgttaatataacaaattgtttagaatcatacctggcacatacaaagtaagtgctcaaaagttatctgtcaataacttttgttatgttgcacgagtgacattatttctcagagtctctgtttttcacatctttattttttcattatttatttatttattttttgagatggagtttcgcttttgttgcccaggctggagtacaatggcacaatctcagttcactgcaacctccgcctcctgggttcaagtgattctcctgcctcagcctcctgagtagctgggattaggcatgcgccaccacgctgggctaagtttatagttttagtagagatggagtttcaccatattggtcaggctggtttcgaactctcagcctcccaaagtgctgggatcacaggtgtgagccatcacgcccagcctttaatggagctgatatttaataggattgaatgattacagtatgggcatctgctggtacaaaatctgaattataggaagataatggggctcatcttttcaccattgggtccccaacccctgctttgcacgcagtaggaggttagtattgtggaacgagaggcattacattgttttattgtaaggcattgttctcagcagtcctggttgaatcagtaaatccaggcatctacctaatcatctaatcacgaggttgtcatctcgcgattacgcgtgcccagtaggctttcttaggggtgtgccgacttgcctatcaataactacctgttattgataggcaaggctaggttggccctgcctagctttcttaactctggcaggccagacctgcccatggctgttgtctcttcccctgacccacccccagcctacacataccttgcaagacttcatattgtgacccagtctgaaataagtaaagattaaatcagtttgttaaggccatgcttcaagatcagcccctcctggaaacccgtgggtggactgtgctgtcaaaagtccgtggctttggccgggcacggtggctcatgcctgtaatccgagcactttgggaggctgaggcagacggatcacttgcacccaggagttcgagaccagcctggccaacatggtgaaaccccatctctactaaaaatacaaaaattagccagctactcgggagactgaggcatgagaatagcttgaatccaggaggcggaggttacagtgagccaagattgggccactgcactccagcccttcctggccttttccttgtgcatttgtactttttttttccagacagggtctcactctgtcacccaggctggagtggcttgacttcccaggctcaagcggttctcctgcctcagcctccggagttgcttgaactatacatggacgctgccatgctcagctatttttatcttcttattttttttatagagacggggtgtcactgtgttgctggtttcaaactcccggcctctcaaaagtggcctcaaagtgctgggatgactggtgcgagccactgcacccagccacatttgtacatttcaaacacaggttttgttttaagcaaaatggtcatgttgtacatattgttgcgcaacccgtttctttcacttaatttctgtggcatacagaaattctgcatatttctcacactatgggtgggtgggccaaaatttacttctttgctgctgtgaacatttctgaaaaaacaagaaaacctagatcattgtatgctcgtgtgaatgtcttgtgtggtttagatttataggcttagctgctgggtctgagatatgcctgtctttgtcctgtggccccaagctccattgatatcttgatgatggggtatacctgagaggacagcagggaggtgagaacaatgaagtagcttcgagagacttccaggcatcatgtgaaggaccccagcatctggctaaaacacagtcccaagttcggagttgcaatgtgtaggctggcactaaccctaaagtaagtaagccccagttacaaaagaaattcagggatcagcctttttgccttttttttttttttttttttttttttgagatggagtctcgctctgtcgctcaggctggagtgcaatggcgggatctcagctcactgcaacctctgcctcctgggttcaagcaattcttgagcctcagcctcccgagtagctgggaccacaggagcccaccaccatgcccagctaatttttgtgtttttagtagtgacagggtctcaccatgttggccagactggtcttgaattcccaacctcaggtgatctgcccacctcagcctcccaaagtgctaggattatagatgtgagcgacggtgcccggctccccccacatcttttacttgggcagagtccttagctttttctgtcttgttacaggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaacgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcactagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctggggtgggaccaaactataattccccaagggctggtggcttccaagggagtgggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcactggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtgatagagctttggatttaacttatgtccattttgggctcaaggtcatcaaaaaggagcctgggttgaactttacaaacggagagtatgacttgaagcagccccttctatagggcaattagcttttctttacttctgggtagagggcaatagtaactgcctctatcctagtaacgaacatgcttttaatttatgatggttaatgcaaaatgggtatggacagcataccttttttgttggtttttatttttgtctttgagccccttgggacataggggtgggtagtcgttctattttgttatagtttttttctttttgtttctccacactatgattctgtatatgggtgtcttaagagtatgtttgaggaagtggccactgctttttgaccactgaaataagccgtggttccctgactctgaggccccactgcctgatgtaatgttcacaaattagccactcttgaagcagggaaagatgaacccattttaaatgcacatatctattgagaggtttgttgatgtcattaatggtaaaataagggaaaagctgtatcaaagaatcaaagaaagatggtgtctgggcatatgctttaaaggtagtttcttatgcagaaatttgaacttaaattacatatgtgtttatatgttgcccatgcctttaaaaaaaaaaaacccaaagtgataccttttcccaagcatttgaagctttattctttgtgcagataaacaattcaaaggggaaggtgttaattacttacaaagccagctccagactctcaaactagcaggcagttatttttaaagatctcttttgctttgaagagaaagaatgaaggttggatgataaaggtctggcttttttcccctctgtgtactaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggtgggtttgtgtgggctttcagcaggatgggggctaggcaccaggtgtcttcttattggcacaagccgtgatgagttcttccatccttccattcctcctttgggaggccgaggtgggaggattgcttgagtccaggagtttgtttatttatttatttatttttgagacggagtctcactctgtcgcccagactggagtgcagtggcgccatctcaagctcaagctcactgcaagctcctcctcccgggttcatgccattctcctgcctcagcctcctgagtagctgggactacaggcgtccgccaccatggccggctaatttttttgtatttttagtagaggtggggtttcaccgcgttagccaggatggtctcgatctcctgatctcgtgatccgcctgcctcggcctcccaaagtgctgggattacaggcatgagccactgcacccagctgagtccaggagtttgagaccagcctggcaacatagggagacaacgtctttacacacacacacacacacacacacacacacacacaaattagttgggcatggtgttgcatgcttgggtccccgccaattgggaagctgaagtgggaggaccacttgagcctgagagatcaaggctgcagtgatctgtgatcatgccactgcactccagcttagaaaacaaagtgagaccttgtctcttaaaaaaattaaaatgtttacattttaattttaaaaattagaaatactacctgggtgcagtggctcaacacccataatctgagtactttgagaggccaaggcaggtggattgcttgagcccaggagtttgagaccagcctgggtaacataaggagaccctgtcactacaaaataaaaataaaaattagatgggcgtggtggcatgcgcctgtaggcccagctacttgggaggctgaagtgggaggatcacttgaacctgggaggtcgaggcttctgtgagctgtgatcacaccactgcactccagcctgggcaagagagtaagaccctgtctcttaagagttttaaactcttaagaagctgaaaagggccggacgcagtggctcatgcctgtactctcagcactttgggaggtggtggtgcgaggatcacttgaccccaggagttgaagaccagcctgggcaacatagcaagatgccatctctacaaaaattaaattcatataaataaaaaaaaaagaagctgaaaaggatttcaaaacttgaaagccagacaggaaaaataattaaagaaagcagccaggtgctagtaaggtcccttcttcagcagaagccttgcctaccaccttagattaaatagcatcctattcccaccatggccttctgtagctttcccagccagatacatttttctctgtagcaattattagagacattgatgttctctatatttagatgtcagctgcatcagggaatggtcgttttgctctgtcacccaggctggagtgcaacggtgcaatctcggctcattgcaacctctgcctcccgggttcaagcaattctcctgcctcagcctcttgagtggctggaattacaggcgcccgccatcatgcccggctaatttttgtatatttttagtagagtcgaggtttcacgatgttggccacgctgatctcgaactccagacctcaggtgatccacctgctctgacctcccaaagtcctggattgtaggtgtgagccactgcgtcctgccccaaaatttgttttgttttggtttgttttgtttgtttgtttgtttctgagacagttttgctcttgttgcccaggctggagtgcagtggtgccatcttgactcactgcaacctccgcctcctgggttcaagcgattctcctgcctcagcctcctgagtagctgggacttcaggcgtgtgccaccatacccggctactgtttgtatttttagtagagatggggtttcaccatgttggccaggctcgtctcaaactcctgacctcaggtgatctgcctgcctcagcctcccaaagtaatgggattataggcgtgagccactgtgccctgcccacaaattgtttttaactgaaatttttacttaaataagtatagattttcactggacttttgaaaagtaatacagagacatccttgtatgctttgcccagttttccccattggtagcactttgcaaaacggtagtatcaacattgtagcataatcaagatattgacattgttacaatcaacattcagattttcccattttacttgtactcaggtgtgcatgttgtgcactctacagttttattacctgcgtaggtttgtgcattttaaaaatgttaactctaggctgggtgcagtggctcatgcctgtaatcccagcactttgggaggacaaggtgggaggattgcttgaggccaggagttcgagaccagcttgagcaacataaggagatccagtctctacaaataaaaataaattagccggccaggtgcagtggctcacgcctgtaatcccagcactttgggaggccgaggtgggcggatcacaaggtcaggagatcctgaccatcctggctaacacgatgaaaccctgtctctactaaaaacaaaatagaaaaaattagccgggcgtggtggcggtgggcgcctgtagtcccagctactcgggaggctgaggcaggagaatggtgtgaacccgggaggtggagcttgcattgagccaagatcattccaccgtactccagcctgggcgacagagcgagactctgtctcaaaaaaaaaaaaaaaacaattagctgggcatggtggtgtgcacctgtagtcccaggtactcaggaagctgaggtgggtgggttgcttgagccttggaggttgaggctgcagtgagctgtgccactgcactgtagcctgggtgacagattaagactcaaaaaaaaggccggacgtggtggctcacgcctgtaattccagcactttgggaggccgaggcaggcggaccacgaggtcacgagatcaagaccatcctggccaacatggtgaaaccccgtctctactaaaaatacaaaaattagccgggcatggtggcgcgtgcctgtagtcccagctattcaggaggctgaggcaggagaatcgcttgaacccgggaggtggaggttgcagcgagccgagattgcgccactgcactccagcctgggcgacagagcgagactccgtctcaaaaaaaaaaggactcaaaaaaaaatgttaaccctcgcacttggatcaatgcccaggatatagtaggttttcacataggtacacccatgattggtggagcagagacagttggagactataagccccatcttggttgctctggggaggaatgtttgttaggtgatataagaaatctgattttctaaatataaagtgcagacagtccctgacttaagatggtttgatttacgatgatacaaaagtgataggcattcagtagagatcagactttgagcacccatacaaccattctgtttctcactttcagtacatgctcaatcacatgagctatgagctaattttttattttttatttttttttgagatggagtcttgctttgtcacccaggctggagtgcagtggcatgatcttggctcactgcaacctccgcctcccaggttcaagcgattctcgtgcctcagcctcccgagcagctgggattacaggcatgtgccaccatgcctggctactttttgtatttttagtagacagggtttcaccatgttggccgggctggtcttgaactcctgacctcaagtgatctgcccacctcagcttcccaaagtgctgggattacaggcgtgagccaccgtgcctggcctacatgagctgtttcagtgctcatgtataaaataaaataggctttgcgttagatgattttgcctaactgtaagctaatgcaaatgttctgagtgtgtttgaggtaggctaaactgagctatgatgtttggctagttaggggtattaaatgcattttagactaagaatattttctactttcaatcagtttatctgggcataaccccgctgtaagtcaaggatcatctatatgttaaaacactgggtagaatgaaatccatatgcagattgattcttggcttgccagtgagcttcaaatctctattttggtaaaaacctttctgtcctgttcccataggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaaaatgcataccaaaacaaatacagactctttttttttgagatggagtctcgctctatcacccaggctggagtgcagtggcatgatctcggctcactgcaacctccccattctgggttcaagtgattctcctgccttagcctccagagtagctgggattacaggcaggtgccaccacgcccggctaattttgtattttgagtagagactgggtttcaccatgttggtcaggctggtctcgaactgctgacctcgtgatccacccgccttggcctcccaaagtgctgggattacaggcatgagctaccacgcctggcactttttttttttttttctaattttggaaagaagcgggtcttgcaaagtagctttgttacttgtaacagacgtatacatagaacctttgtacaacctagagtgactttttccaaagactgttacctatttcaaggtagaatcgttggaacttactgaacaacagtggaaaagacaactacacagcctcattgaggggagaggggtactgtatacttactggtaactggacacgggtaaaaggacaaggtctgtcatctctttagggacctgttttatatgccccaaccctgtccccatcttattgtttttttttgaatgtacttaaaaaaggaacaacaaaaaactagggttgtagaattataaaactgcttcaaccttagaaccttaagtaggaggccctcaaatggacttacgttagtccttagggagtcaatgtgtgtgttgctgcttatttaaatacagttcagttggagccccgagagtgccaatgttttccccacacctcttggatgccttcctcttcccaaatcccagaagaggtgggcacctgagcggggaatctcaggtgacttagtttgccagtgcctactctattgaagaactgggttttcatgctcgagaagaaactcgtggaagggcgtgtttcccatcacaggttcacatactgattgcttttgttgaatttccttggtgcgacttatgccaagtaattatgacgattttttgttttgttttgtttccttgctgaatatttcatgaaggctacgaagttagaacaggcacgtcctgggtgtgaaagctttaatttatctacctcatttattttttattttttgtagccatagtgtctattttcctattttaagaccgctgaagtattcccaggccctgtctaaagcctaagagttgatgtattggtgggaagaggtgaacgttcaagatgattttgtgatgccttttttttttgtagtttcctttgtaaatgtgatattgagcaaacgaaacattgctcttggtttaacaagaaagaaagaaaaaaactctaatttctgggagaaaagtctttcccctctatgtggaaggtcctgacggaaatatgcatccaagacgattagccaaagtgttgtctcttcatcgttgcacctgactttaggattccgccccccttttttttttttttttttttttttgccaagttgtgcctttccttctggaattgtaagtgaacacgataatagtacctgtttacactgtgaagtggatattgttacagaaaacacaccagtggctttctcactgttgagctaataatgccttgtgaatgtatgatctacggagaaacccctgtagttgtacctgctgatgctgtctgtctgttggaaaataaaatttgaatgtttttttttctcacccaggtgtatataaatttttctggtactttctgctctatacctgagaatctttacttgacaatcactttcagctgccttgtgacactcttgttcctagcgtcaaaaagatgcacacctggctatgtccatacttgcctcactttttttttttttttgacagtttccctcttgtttcctaggctggagagcaatggcatggtctcggctcactataaccttcgcctcccaggttcaagcaattctcctgcctcggcctccggagtagctgggattacaggcatgcgccaccacactcggctaattttgtatttttaacagagatggggtttcactatgttggtcaggctggtctcaaactcccgacctcaggtgacccgcccacctcggtctcccaaagttctgggattacaggagtgagccaccgtacccggccttttttcttttttttaagacagggtctcactctttcatccaggctggagtgcaatggtatgatctcagcttactgcagccttgacctcccaggctcaagggagtgcagtggctcgatcttggcttactgtatcctccgcctcccaggttcaagcgattctcctgcctcagcctccttacttgggattacaggtgcccaccaccacacctggctaatttttgtattttgagtagagatgaggtttcagcatgttggccaggctggtcttgaactcctgacttcaaatgatccatctgcctcggcctcccaaagtgctgggattacaggcgtgagccaccttgcccagccttttttctcccctctcacatatttcagacatctttccaaggtaaaacccaattccagctaatccttttaaaataactgcaattacgtaacaatgatgtctagtcatctattgacaacactgctggtgtttacccataaacgtccctatcactcaggctgcagtgtagtggcatgatcacagctgactggccttgagctcctggactcaagtgatccttccacctcagcctgtggagtagcaggcacacaccatcattcttagctaattttttttttgcagagatggtctcatcatgttccccaggttggcctcgaatgatccactggccttggcctcctagagtgctgggattacaggcatgagccactgtgcctggccccgtgaacttttttattttgtttttgattgcctttgtggtatttcttttcttatacttgagttcacttccagggtaaattcctgcttgggatagctggggaaaagattatcattgtctttgtgtgtgtgtgctgttttccataatacagtgtgtagtgtgtatatgtgtgcatcattcctctcagccttaatctttgaagtcagttctaaagggtagattgtgattgtacctatgcaagtagattatgcccgcatagtgtggccataactttgttttgtcagttagagaccgcatatacaaccatggtcccataagattgtaatactaatttttactgtaccttttctctgtttaaatttgtttataggccaggcgcagtggctcacgcctgtaatcctagctctttgggagaccaaagtggacaaattacctgagctcaggagttcgagaccagcctgggcaacacagtgaaaccctgtccctactaaaatgcaaaaaagtagctggccatggtggcattgcgcctgtaatcccagctactgaggagactgagacaggagaatcacttgaacctgggaggcagagattgcagtgaaccgagatcacgccactgcactccagcctaggcgacagagcaagactctgtctcaaaaaaaaaaaattaagtactgcttaattttttaacgtctgcctcccgcattgaagtgattctcctgcctcagcctcccgagtagctgggattacaggtgcgcaccaccacacccagttaatttttgtatttttagtagagacggagtttcaccatgttggtcaggatggtctcgaacttccaacctcagatgatccacccgcctcagcctcccaaagtgctgagattacaggcatgagccactgcaccaggcccaagaagacatcttcctaatataaaaatgcagctgggcgtggtggctcacacctgtaatcctcacactttgggaggctgaggggggcagaacacctgaggttgggaattcgagaccagcctgacaatcatggagaaaaatccatttctactaaaaatacaaaagtagctgggcttggaggtgcatgcctgtaatcccagctactcgggaggctgaggcaggagaatcacttgaacatgggaggtggaggttgtggtgaaccaagattgtgccatcgcactccagcctgggcaaaaagagtgaaactctgtctcaaagaaaacaaaaaaaaaaaagcaaggtaaggcagtaaatgctgatgtagaagctacagcaagttatccagaagatctagctacaataactacagtagctacactaaacaacatattttcaaagtagacaagacagtcttctattggaagaagatgccatctaggactttcatagctagaaaggaaaaaaacaccttgcttcaaaggacaaggtgactcctgttaggggctaatgcaggtggtgacattaagctaaagcaatgctcatttaccattctgaaaatcttagggcctttaagaatgatgctatttctactctgcatgtgctctggaaatggaatgacaaagcctggatgatggcatatctcatttttgttttgagatggagtctctgtgtcactcaggctggagtgcagtggcacaatctcagttcactgcaacctctgtctcctgggttcaagtgattctcttacctcagcctcctgagtagctgggattacaggcacctgctgccttttgtatttttggtagagatggggtttcaccatattggtcaggctggtctcaaactcctgacctcaagtgatccacccgcctcggccttccaaagttttgggattacaagtgtgagccaccgcgcccagtttagcatatctgtttatcacatgatttactgaatattttaagcccactgttgagacctactgcacagaaaaaaaaaaaaaaagatttctttcaaaaattatggctgctcattaacaatgcatctaggccgggcgcagtggctcacatctgtaatcccagcactttgggaggccgaggcgggtggatcacaaggtcaggggttcgagaccagcctgaccaacatggtgaaaccctgtctctactaaaaacacaaaaattagctgggcgtggtcatgggcgcctgtaatcctagctactcaagaggctgaggcaggagaattgcttgaacctgggaggcggaggttgcagtgagccgagatcacgccactgcactccagcctgggcgacagaggaagactcccgtctcaaaaaacaaaaaaacaatgcatctaatgcatctgtcaagagctctgatggaaatgtacaaggagattaatactgagattaatactgtttttcatgcctgttaacacaacattcattttgtagtctggatcaaggagtggttttgttactggtaaggagtctggatccagaccctaagagaggattcttggatctcacgtaagaaagaattcaggatgagtccataaagtgaaagcaagtttattaggaaagcagaggaatgaaagaatggttagtccatagacagagcagccctgagagttgctggttgcccatttttatggttatttcttgatgatatgctaaacaaggggtggattgttcatgccttccctttttagaccatacagggtaacttcctgatgttgccatggcatttgtaaactgtcatggcgctggtgggagtgtagcagtgaggacaaccagaggtcactcttgtcgccatcttggttttggtgggttttagctggcttctttactgcaacttgttttatcagcaaggtctttatgacctgtatcttgtgctgacctcctatctcatcctgtgactaagaatgccttaacctcctgggaatgcagcccagtaggtctcagctttattttccccagctcctgttcgagatggagtggctctggttcaaatgcctctaagagtttcaacttccaggtcttattatttcagaaatactacattttgtaagctgccatagtttgttatttctctgatgggtctgggcaaagtaaagtgaaaacctggaaaggattcaccattctagatgttgttaaaaacattcgtaattcatgggagaaggtcaaaatatcaacataaacaggagtttggaagaagtggcttccaaccctcatggatgactttgatgggttcaagacttcagtgaaagagccaggcaccgtggcttatgcctgtaatcccagcactttgggaggccgaggaggatggcttgagagccaggagttcaagaccaacccagtcaacacagtgaaatcctgtctttacaaacaacaaaattcagtggaggaagtaactgcagatatgatggagatagcaagagagctggaaatagcagtgaagcttgaagatgtgactgaatggtggcaatcttaggagaaaacttgaatgaataaagaactgcttcttacagatgagcaaagaaagtattttttgagattgagacagagtctcgctctgtcacccaggctggagtgcagtggcgcaatctcagctcactgcaacctctgcctcccatgttcaagtggttcttctgcctcagcttcccaagtagctgggactacaggcgtctgccaccacgcccaagtaattttttttgtatttttagtagagatgggatttcaccgtgttagccaggatggtctcgatctcctgaccttgtgatccacccgcctcggcctcccaaagtgctgggattacaggcatgagccaccgcgcccggcctgttgtgggtaaaatattttcagacagtatcacaagttacaaagaaatctcagataaagaatcaatatagccaacatcattgttgtcttattttaaagaaattggcatagccatcccaaccttcagcaaccaccaccctgatcagtgaacagccatcaacatcaaggtaagatccttcaccggcaaaaaaattacgactccagaaggctcagaggatcattaacatctttaacaataaaggaatttataattaaggtatgtacgttgtttttttttttggtttgttttttgtttttcccgagatggagtctcactctgtctcccaggctggagtacactggtgcgatcttggctcactgcaacctctgcctcccaggttcaagcaattctcctgcctcagcctcccgaatagctgggattacaggtgcctgccactatgcccagctaattttttgtatttttagtagagatggggtttcaccatgatggccaggctggtctcgaagtcctgacctcatgattcgcctgcctcagcctcccaaagtgctgggattataggcgtgagccaccgtggccggcctgtacattgttttttagatgtaatgctattacacacttaacaggatatagtgtaaacgtagcttttatatacactgggaaaccaaagtcatatgacttgctttattgcaatatttgctttattgttgtggtctgtgttgatctaaaaggaagaggctgaggcacaaaatacaatttagagtttacttgagccaaagtgaggacagctgcttggaagactcagccccaagtaaccttggatatgacctctgtatggcttttgttaccaacaggtaggttggttgattgattaatcactgccctctagactgggtgacagagcaagaccctgtcacccaggctggcgtgcagtgatgtgaacatggctcgctgcaacctcaacctcctaggctcatgcaatctgcccaactcagcctcctgagtagctgagactacaggcgtgtaccaccatgcccagctaatttttgtattttttgtagagacaaggtctcactatattgcccaagcaggtcttgaactcccaggctcaagtgatcctgtcatcttggcctcccaaagcgctgggattacaggcatgagccactgagtctggcccatttatgtatttatttgacaaggtttcgctctgtcacccagcctggagtgcagtggcacaatcatggctcactacagcctcagcctccttggctcaagcaatcctcccacctcagcttcctaagtagctggcattacaggcgtgtgccaccgtgacccagctaattcttttatttttttgtacagacgggtgaaggagtcctacttcctcggcctcctaaagtgctgggattacatgcgcaagccactggaccaggccataagcaggtatttaaagggtaaaaaagcggacagggagtgggctgatacaaacttgttcatcagaaattctcattggtttacagaaataacattgattagtaattgactatacattgctaacctatggggtgtgggttatagtgtctggtgcagcattattaggttaatttctagctacttgtggcaataacgggcagtttcaggagatgaatacatagctcaaaggagggagtagaacgtgattgctgcttcattttaatgtctctctgggcctgataatttaaaaacactcacattcctgagataaaagttgttttcttttttcatctggagccaaacccacaatatctctcaggtatgcctgtataaaatgaacacatgtcaaagaattattaataaatttacagttgattcagaggagaatttaaaatgagctcctaaattgctggcaattaggaatgttgaaaagaacttacaaacagatgcaaaacatgatcaatatccacaggcaataactgcattccactggacaaaataatttgcatttctatggacaagaatcatttgcataattatcagttttctacaatttatagagttgtaaaatagctcaaggacgatgaaagacacagggaacctgggagggtatgctaaggcaagctatcaagtcatctttttgatgctttcaattttttttttttttttttgagacagagttttgctcttgttgcccaggctggagtgcagtggtgcaatcttggctcaccgcaacctccgcctcctgggttcaagcagttctcctgcctcagcctccccagtagctgggattataggcatgcgcctccacactcggctaattttgtatttttagtagagatggggtttcttcatgttggtcaggctggtcttgaactcccgacctcaggtgatctgccccccccccccccgccttggcctcccaaagtgccaggattacaggtgtgagccactgcgcctggccgatgctttctaagtttttaacaacctttactaggatgtcatctccttgaaacaggggctgtgtctgactgtaccctctatgcatagaccattgtaggtgtttagtgaagactgcttgacggaatgattggacatctgttgatttttttcccccaaccttcttagtgccctttttggaggtgaaaacagaatatttttggatgtaattgctcacgcctctaatcctagcactttgggaggctaacacaggaggctcattagagctcaggagtttgagaccagcctgggcaacatggcaaaaccgtctctacaaaaaaatttcagaaattagctgggcatggtgatgaatgcctgtagttccagcttcttgggggactgaggtgggaggatagtttgagcatgggcggccaaggttgcagtgagccatgatcgcgctactgcactctagcctgggcgggacagagcaagactatctcagatggagtctcgctctgttgcccaggctgtagtgcagtggcgtgatctcggctcactgcaagctccgcctcccaggttcatgccattctcccgtcgcagcctcccgagtagctgggactacaggcacccaccaccacgcccagctgattttttgtatttttagtagagacggggtttcactgtgttagccaggatggtctcgatctcctgacctcgtgatccacctgcctcggcctcccaaagtgctgggattataggcgtgagccactgtgcctggccaactctatctaaaaaatacacacacagcccagaatattattaaattttagctagatattgttgttcatggaaagttctcaacctaagacgttctttttctttccaaaaaaaacaaaaaacaaagggttgggaaaggactggattggtaagtgttagagagagacacagttggttgggcacagtggctcacgccaggcttgtaatctcagcactttgggaggccaaggcgggaggatcacttgaggccagaagttcaagagcagcctggccaacatggtgaaaccccctctctactaaaaatacaaaaatttgccgggcttggaggcacacacctgttatcccagctactcggggggctgagacaggagaatcgcttgaacccgggagatggtgccactgcactccagcccaggtgacagaaggagactctgtctcaaaaaaaaaaaaaaaaaaaaatgacacacacagtcttattagagattttaaaatgatttaacatcacattctagcccagtggctcttaactagggacaattttgtctccccaggagacatttcatgatgtgtgaaaacatttgtggttgtcacagctggtgtgaggcagctactggcatttagtgggtagagaccaagaatgctgctaaatttcctgtaatgcatagcacagccccccatgataaatattcagcccaaatgtcaatagtgccaaggtagggaaactgctttgggggatacctagaatgtttattcagagagaattcatggagagagaattgtaggcactaaaaggattttattttctcactcccagcctgagtttacccaaagcatatttattatttattcccattttccctgcctcctccatctctcatcactgcccgtacccttgacttcttgcccacttaccaccaaacactccttctttacagcaggtccaaagtagcagtggggcagggcgcagtggctcacacccataatcccagcactctgggaggctgaggcgggtggattacctgaagccaggagctcgagatcagcctggccaacatggcgaaaacccgtctcaactaaaaatacaaaaattagccgggtatagtggcgcgcgcctgtaatcccagctacttgggaggctgaggtgggagaattgcttgaacctgggagttggaggttgtagtgagctgagatcatgccactgcacttcagcctgggcaacagagtgagactccatctccaaacaaacaaacaaacaaacaaataaataataaagcaggagtgggcttggaggtctatgaacataaggcttcatggtgggccaagatgagagtttcaaggtatattccggctccagcctgtcatccatcgggcatggatggcatgtgacatagaggcatgtgacatgacctctttgggccacagtctctctgatttctggaaagtagaagttggactagattggcttatccctccaggacctttccactccac

SEQ ID NO: 1031 - DNA, 4779 bp, Homo sapiens
aactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaacgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcactagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctggggtgggaccaaactataattccccaagggctggtggcttccaagggagtgggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcactggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaaaatgcataccaaaacaaatacagactctttttttttgagatggagtctcgctctatcacccaggctggagtgcagtggcatgatctcggctcactgcaacctccccattctgggttcaagtgattctcctgccttagcctccagagtagctgggattacaggcaggtgccaccacgcccggctaattttgtattttgagtagagactgggtttcaccatgttggtcaggctggtctcgaactgctgacctcgtgatccacccgccttggcctcccaaagtgctgggattacaggcatgagctaccacgcctggcactttttttttttttttctaattttggaaagaagcgggtcttgcaaagtagctttgttacttgtaacagacgtatacatagaacctttgtacaacctagagtgactttttccaaagactgttacctatttcaaggtagaatcgttggaacttactgaacaacagtggaaaagacaactacacagcctcattgaggggagaggggtactgtatacttactggtaactggacacgggtaaaaggacaaggtctgtcatctctttagggacctgttttatatgccccaaccctgtccccatcttattgtttttttttgaatgtacttaaaaaaggaacaacaaaaaactagggttgtagaattataaaactgcttcaaccttagaaccttaagtaggaggccctcaaatggacttacgttagtccttagggagtcaatgtgtgtgttgctgcttatttaaatacagttcagttggagccccgagagtgccaatgttttccccacacctcttggatgccttcctcttcccaaatcccagaagaggtgggcacctgagcggggaatctcaggtgacttagtttgccagtgcctactctattgaagaactgggttttcatgctcgagaagaaactcgtggaagggcgtgtttcccatcacaggttcacatactgattgcttttgttgaatttccttggtgcgacttatgccaagtaattatgacgattttttgttttgttttgtttccttgctgaatatttcatgaaggctacgaagttagaacaggcacgtcctgggtgtgaaagctttaatttatctacctcatttattttttattttttgtagccatagtgtctattttcctattttaagaccgctgaagtattcccaggccctgtctaaagcctaagagttgatgtattggtgggaagaggtgaacgttcaagatgattttgtgatgccttttttttttgtagtttcctttgtaaatgtgatattgagcaaacgaaacattgctcttggtttaacaaga

SEQ ID NO: 1032 - protein, 1053 aa, Homo sapiens
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCKYCSKVFGTDSSLQIHLRSHTGERPFVCSVCGHRFTTKGNLKVHFHRHPQVKANPQLFAEFQDKVAAGNGIPYALSVPDPIDEPSLSLDSKPVLVTTSVGLPQNLSSGTNPKDLTGGSLPGDLQPGPSPESEGGPTLPGVGPNYNSPRAGGFQGSGTPEPGSETLKLQQLVENIDKATTDPNECLICHRVLSCQSSLKMHYRTHTGERPFQCKICGRAFSTKGNLKTHLGVHRTNTSIKTQHSCPICQKKFTNAVMLQQHIRMHMGGQIPNTPLPENPCDFTGSEPMTVGENGSTGAICHDDVIESIDVEEVSSQEAPSSSSKVPTPLPSIHSASPTLGFAMMASLDAPGKVGPAPFNLQRQGSRENGSVESDGLTNDSSSLMGDQEYQSRSPDILETTSFQALSPANSQAESIKSKSPDAGSKAESSENSRTEMEGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 1033 - DNA, 200400 bp, Mus musculus
  misc_feature (1)...(200400): n = A,T,C or G
ttacaattagtgttccacttaatcatctctttacgagatggcacagttaagaggccacttcatcatggcctgtttcgagcaaaccagccttttattttatgacactcgtagtaagacacattgagttatatctgtcttttccttgacaccaacacatttatttgagctcagtatgtccaagtagtgtgaccaaggtagatttatgaggactcatttgcatccagaacaacattggcaaaactgaaatatcacagacactaacttttggcctgccacagctcactgagcctttatcactgggcctgtaacgagagggaaatatatttttctggtgtttacagctaattccttgttgccattccactgttgtcgttgctgttgagagctggaaatgaggtttaagagcctcttcatagctaacagcaggagcttatgtgtgaggaacagaaaaatgaagcttcccacttccaccccatcctggatttaaagaactctgtcacagttaaaggactcaagctctttattttcccaacaagttagacctgacttagttgagtcagtacctggatttgatgactccttttcatgcttattcttagagtagattggttttcattgcttctagcccaccactcaaagataggggaagaaaagatggtaaataggacaaggggatgtggacctatgtagaagtagttccttgggggtgattccaatctctgttgtcaggacgtcagcacagtactcttcagtagtgtcaggataccaaacacaaatcagcagtgatggcaggatccagcagaaacagctaggcttcctctgaatcagcacaagtcagctcgagcgactagaaccagctggggtgacagacacctacttctcaggacccagagccgtaagcatctgcggattgttatctcagctcaaaaatgggccatggcatttaacaacctggaccaaccctgcagaagcctgactgtgatttcctgtttatgacctccatgtggatagaaaacaaacaaacaaacaaacaaacaaacaaaccccagccagatgattgatactaggctctttcttatatatctatttgtatatacagaacactgctttatgtgtgtacatgtctgaaataaaatgatattctactgagtgttgagtgtgcctgatctagtcagagtctatttttctgtattgctggttttctttagtagtggcagtttctctttgcaataggccatggagaataatctgtgttagcatgctcagatataataggctagaaataactataatgattattcccaaatactcagtagttgatatatcaaagacttacttcttattgtctgatttttaggcaaggtggcataaggactgctgtcttccttagagtagctcgatccaggcgacttttgttcttttgttttatcatctccacttctggcttctgagttactataagcaacaaagagttctggagtgccatgcatggttttgaaagtgttggcatacttgatacatgcaggggaacatgtgaatactggtggtcctgtgaggtcactgatggtttatatggttcctgaacgggtgtttcctctcttgtaatggcatgttgtaccactggacctataatacattgaaaacatcaggttcttaacacacaagcttgagaacctgagtctggtcctcagaacccatgaaaaaaaacgtgggtgtggcggggcccacttgtgagcctcgtgatagggaggtagtgacagcagagccctgccagctcacctatatgtgttggtgagtttaggccagttcagcggagctcccgaacgaggtggactgttcccgaacagtgtcacgcagatctccacaaagcacacacaactgtacccatgatgaccacacgtgagccaaaatcccttgcctagggaagcgcaccatgagcacccttataatattgatcatcttacagttgggtagattggcctacacaaagctcatttcataataatgtaccgagtagctcatttagtttgtggaatgctacatagaagggggaaattagaatagttgggggttgtggtggaggcgtgttccctccattatacagttgacagagttaggtgaagccattgtgagttgggaccagctgctatttgatcatgtcatgactttggcagccactcttctatttgatggcatttggatcattttcagtactccactttattatgaagaacaatacacaggcatatcttatgtgtatctcaggtgcatgctatagtagtataatcataaaaatagactttccagggaaaaaatatagattgttttcctttttacaaatgaaattaagtgtttcagaaatataactaaatgtgatttcgaggcacgcttcattatgtagacaaagttggcttcagtcctaaggcccgtccaccttagcctctcaggtgatagaattccaggtacgttccaatgggaatggctactaagctgtccttgaaggtgttggtaccactggtttgtgtggataggcagagtacaaaaggcattatatcactgtgatttgcacaatgacagatcacccccctccaatagcgtcttcattacttctggccaagaggcatttcttataatatgttgactctctaatttctagctttgtactatgacaaaggatctttctaatgttctcatgtgccgcattccagagtgatgcctactctgggcaaagtcaagctgatgatgccacattgagggcttgtagctcacagattctgcctccagggggcgcctggcacagtgacatccctttatttgttcccttcctctgtggtgctctttcagctgtctctgcactttgactttgaaaccacagggtgaagatgctctctcagacctgtcattctttagacagagtagctgtctaattttgggctgtgaattttcctgtgcatttttgcctgcttagtcattgtctttgtatctcttggttctctctggccttctcattttcctcctctgcctctgcccccacgtccccaaaggccctgaaatctttatgtgttatttttcttttaagtcatatttcctctcctccttcagcataaacatgcttgctctgtcaaagaaaagcaaaaggatagagcaatgggaaggccattgcacaagtctccaggaagctgcgccaagtccctgcacactccagctggttggggaatggaacacagttcttaaggtagtctgtctgttaaacttttgtgcacaaaaaggacagaaaataaaaattagtccagattttagacaacccctggttctatccatgatcctgggcaaggcacttcctctcctcaaggtttctgactgtaaaggaggaagatagatcccagaggacctttgcaccttggaacctcacaaggtgagagaagatgcctggcagttcctcagcacaggatcagatggcctctgtagtgagtcagtgcacccacttctccttcactctgggagcgccatgtcagggctccacaaggccatgcacagtctatcgggtcagtcgggtcagtcaccgttggtcacaaggggcaaaactcagttataaaggttactagaattggtggaaggcagaggggcaggggaggttaccagactgagttcttggagatgaacaagtcaagactagcatgaatcatggcaggaggagggggtaggctggtagaaggcagggaggtcctagagcttccgaggagaaacagtcctgatggagatgctgccccatgcggaaagagaagtcagggccttggcgtcgtctttccactgatctccaaacaaagtctcaaagtcaagcgttttgcagaggatcagagggcacaaaggcaaaatcaggaagcgtccttgtccattctgtttgtttctttgtatagctctggctgtcctgaagctcactctgtagatcaggctgtcctcaaactcagagatctgcatgcctctgcctgccaagagctgagattaaaggcgtgcgccaccactgcctggtcccacattacttcttgtagttaaaaaactaaacaggagactctagaaataatttacagagtttaaataaccaattttaacatgattgtaatcctattttattgtttatttttccctgttttattttaatatggtaaattaaattttaccataggtaagtatagataggaaagcagagtatatgggcttagtatcatcttcagtttcaggaatcctcctaaatttcaaaccgtattttctagacagcatcctctgtgaattagaggagagtctgtggtaactgggagaaacaagagaaggccctaagtttagtgacctgtgaacttccttttgtcatttgcattccagagttggtgggacacttgaggaccttgctagcttctgcactgaagatactgttgtaggccttaggttttaacatgtagctcttcctaccattcttgtatttctcaggataactctcccttcccacctcctccttcccacagccaacatttcatgcaggttctattcccggtaaaccttcattcagtcttttgaagaggaaagtgtcttgttcatctgtatcactgagggaccgctggaaacatgggccagcacataaacacagggaagcagccatgctagctgatcggcaactatagtcacagaggctttcagttccgcctctgatgcctgtgatgttaacccagtgacttacccggctgctgggattttcttatctgcaagacggttctataaaacacaagcttcttaggctctggtctaggtgagtttggtctgcagtaataatgaccccagatcacagtgtctaacgtccacagaggtttactctttattacacgtttgtcctgagccacttctaggcgtctctctttcaaacttgtggctgatagactgtcgtttattttgaatgctgttgttcctcttgtggagggagtgggggaagaacaaaaaccaagttgaggtggtgagtagtaatctaatgtttgcttggctctgtcacatataatatggcacgtgttcagggcttactggctggagttagtggcatggcatctcctaatttcaacaaaaggaagaaggctgagcatatcatgggtttgcactaattgacagcatggggaatctaatacttgacttcatgatggcttcagccgtcagatcacacgcgcacatggtgaaatgtctagtacaatacagcactcgacaatagcagagcaattaatagaaatggttactattatttatagcatactgttcaccattcattttcttagcaaacttcttacccctaaaagtgcagaaatagacaaagtggttcttgcattgacttagcagaaggatcatatactcacactcatgaatacatatctacatacatgcatacacgtatgtatataacatgtgttggtagatgtatgggtatgcatgcatgtgtaagtgtgtgtgtgttccacaggacaacctcaggtgttgttcttttggtaccatatgcctgatttacttatttatttatttatttatttatttatttatttatttgagacaggctttctcattgatctggaacttgccaagtagactagactggatgactggcaactgagtttttgcctatgttcacctctgagattattaaacatatgctaccttgcctagctttacatgagctctgggattgaactcaggtcttcaatgtacacaagcgcctaagccacctcttgcgcccagcacaagctgttaagaagtggagatgacttagagaagttaaatgtagtcagtgaccctgtcttccaagtttttggttgagcacagtcatctgatgcttctgtaagagggttactttgtgcagtgatagacggggcgttagcacaggccttgcaagtctgcccactgtcttggttttcaatttaaaagcaagcgactttaagctggcattcatttgggtcaatgtagaagcagtcaatatgtattatatgtctttgatgctggtctctggatcaattgcaattagtttgcagcagattgcattaacatatctgaaattaatacggccagtagtctaatgaaaaggaattgaccgtgaccacacagtggctgtttttagtttctctcaaatgtgcttttcaaactgtactttttcttctttagttaatggctttaaattggtatgtcagcataggcctaatctattgatccttcccatttgccttttaaaagcagtccctgataatgacaggtgtgtaacatttaatgttttctttccttagatggcttttactaaataacttaaactcatgtttttcttggaatcttgtgtggaatgcaatagactattaaggccttgagtgtgttcacttatcaaatttgtgttgttactaatgtttcattaagacttagaaagtcagaagtaagactataaagtattaaaaagcagatggtatgagcattgtttgtcctgcatttatccaagtattattaattttaaagagaggttataatccatttgaatattaacattgtaagcaatataaaataattatattaatatatagcctatattaatacatgtagaagggtgggaggagcgatcttcagacttgatcatgtcaaagcttgaatactttacaagtgttcatgtacatgaattatgtttgtttcaagtcctaagggatggctgtgacctttttagtttagaggtaggcactttctggaactggaacattccttgaaacaaaaggtggggtttattcctttggagttacttttgatattttctacctgacaagtaagacatccttttaaggatgtcagaaagtttagaacacactacccttgagtagaagctcatctctatgagggtccatcaggggtacccaactttttggcattgtggtgagacaccatgttccacaaatgtgttggagcatatttataactattctggggtacacgtggtcagtgagtctcagtgggacatacctatgagcctcagaggatccccgttagagagttcatcctagtttggaggctacaggagatgacattttaaggacccttcagagattctgaaagtgactgaagcagcttcaatgactttccctcacttttgaaagtgatcgaatcacagccctcaggccctcagagtgtggtcagtctgacattgccttgcacagtcatggagaccactgtagaagctagtagggtatggatagcaggttatttttttactctgccagctttgaaatctagctatgattaaatatttaatttgtgttaatggataatcatctcttgtaagttcctttacattatgactcatggatgtaaacataaccaaatgtattcctttttcattgaaaatgagatttatagttttggtaggatatgctgttgatattactggataaaatacaaaagtaatttactgggttgtcatcttgttctttatattcttttgacataaattaaaaagtaattgatagcgcattttgaaaaaaaaaaccccacttgtattggcatcttaagcaagctgacataatatccgactgcggctgaatggtagtgtggtaatgagtactctcaggtaagagtgctcagtattggcacgtgagtgagatctcatcattcaaaacacctatctaggcaccactagaaactaaaattaagaagagattcgggagccggaaagattgctcagccattaagagcatgcactactctggcagatgacccgagttcagttcccagcatccataccacgtggctcacagacctgtctgtaacttccatgtgtctgaccccctttgactcccacaggcaccagcacacatttggtgcacagaaacttacacaagctcacatacatacagatttacaaaaaattttaaagaggaaaagaaagaagtgaattagtctgtggctccatgacctgctggagttaaacttccttctcctaccattttcagtcctgagtctgactgatggtttgtattgcttgaagacaatgctaagagctttccgtgtttgcacctggtgactgaagggaggcagagctgtgtgtgtgtggacctttatcatttctccaaagtaacccctgatctgaaagtacttcccagctcacggaaagccacgtacccagtgacagtcccatgatcttcgcccgcctacttcctctgatgtgagcatctgacacaagcctagaacaatatgaaaaccagaaactcacacagatggtttctctgtgcctaagctattgaacttactctgtttttaccatcttgagggttaaaatgaacatctactaagagttttactgtgacagttaaactttatttatttagtttttgcatttataacataattacattattttccccttccttttccttccaaacccttccgtaacccctccttgctctttttctaatccatggctgcttctctcagcaatagtgctgttatatacatatatgcatatatattcctaactataacctgcttattagtctatatagtgttacttgtatatatattttcagggctgaccattgagtattggatatccagttggtgttcttatctggggaagactatttctctagtgctcagcattccttaattgccagtagttctttgtgtaggtctcttgggctttctcctgtccacaatagcgtgtcaattgttgctattcttgttctgcccttgtttaggaggtcctgttggtgagacttattgggtggggggtgtagcttctgatattgctagaagacaagacatcttagcaaattccctgatcctttgggactggtttttttttttttttttggctttcttctgcaataattcctaaaccttaggtgagggggttgttttataaaaaaaaaaaaaaaaatcctttgggactgggcttcacaaccagttttgattggttgtggttttctgtggaggtctgcttgcaaaaagacgtttctccctgaccatacataagcatttaagatgtagtcggggattacactggtttagtaagggtggttgtaaattctcctccaagatccatgattttgctagccatagatagttggtgaggtttctagacctaaacatgatttccctcttgttgagcaagtcttacctatagtcagaggactgttggttattgccagagcctactgcaccctcagggttattgtgccatgttggttgttgtggttcattggtgtcataagccagggaagactgctgtttgctttcttcctgtggaaccttccgtggttccttgtggtaccatgaaagctagtccccagggcggaggcctcaggtcagctccagctcaggggttccggggctttttatctgaagtgcacggtgtccccagcagtagggatttatttatcatccatgtctggggccaaccaagggcaatagcaagagcctgtaatgttttcagagtctcttggtcaaccctgaccagcaacttaaaaggggccttcttatgctaggtgtaggggttttgttagatgtaggggcctttggctctaggaggcaacatcatcagcccaaaatgagagaatttcacttaaaggtatatttataatacagacttatatgtattataattttcttaggtagatacttaatagtatgaaaatgtaatgtgggaatcacattatgacatttaaaaaaatttttatcccttattaccttctcttgcccctccctctcccagtgaattttctcatcttccaagcctagtacctcttctgtttccataccactccccaactctgtccatcaatctgtcagtctctctttctgtactttttttttttttttttgacatttttgatcgaaaaagcctcatggcaggtttatttagattgtctctacgctgagtgttgctcattgctggtggatagtacctgtaagacgacagtgttcttcttcctgttattaagtgtcctctcctctctccctaggccggtcacttaaccccccgaagatggctgaacctgcaggagtaccagagcaagaagctcatgtcagagcacggagtgagagtgcagaggttctttgttgccaacactgctaaagaggctctggaggcagccaagagattgagtaagttgttccagggggtgagcactgactgccatcagtgaagacaggacagggcttcccatttctgtctttgtatcttacctgggttatcttacctgggttatcttacctgggttatcttacctgggttatcttacctgggttatcttacctgggttatcttacctgggtgggaattttgaattgcaaaagcagaagagtacttaaattaggaaaacgtgattctttctcttgagatagtagcacatggggtcggtcaccttgtggaaatttctctcaagtttttctttgtgccctcttctatcaactatagcttagtggtggaaagagatagggcaggtagattggacatgagagtggcatccttctagaaaccccttaaaagctggaatgagtggttggaagagcacggggtaggcaggcggcaacgttagatttgttaggtagtccatgttggccttcgactcgtaattctcctactgaggctgagtgctgacatcacagatgtgtgctggtggagcctgggcaagagcagcgtttcaaagcccaactcttttgtcctcccatgaccagttctaactgtctatgaagtcctcttcatttctgtctctctgattcattagctatagagcaaagctgtgtttcccacccatcattgtcttcagggccttattcattgtagtcatgacaggtctcagctgtacctctagctgatggtggagaatcagatcctgccatcttctttccagtgtaatattttaaagatcctcttattgttacttaaattatctagtataaataaaatggaaaccacatagtatatttaaaatctatagtagtctttgaaaagaaagaaagtaataggtaaaattaattttgataatacattatatgtaatatacccagtcggttgcattttatcatgagactaatattaataagttatcagtatttttctcctatttcttttctttctttcgtttccctgtttttgttttgttttggtttttgtttgtttaagatagtttatgtagcccaggctggccttaaagtcattctgttgctgacgatgatcttgaacttgttcctgtctgcctcccgagtgggaggattataggcttgtagcattatctctggctcatgtgctccaggactcaaacccaggaccgcgggcatcatgtaggtgagaattctaacaaatgaggtatccataggactgaagtctcacaaatcttgttcttatcttatactataacacgctcatttcacatgagtctcacgtcagacgttcagcagatactgtgtcagctgggctatctgggacagtgtagttctggacactagaaggatttgaatgtacctacagccttagggctcagttttttcctgctagtcttggagaagcaccctactgtgctctgtaacccagtaaaggatgattccctagacttatccaaaagggacaagttttgttttaggggtttgaaaatgagaacaaaaaagtaaagtgaagttggtcttagcttttccttggcccatttttcaaggccgaggcagagtcctggtgttgaggcagcagctcattcagtgagcaagcagacaagcaagcaggcaggttcacactcagagagcagctcattcagtgagcaagcagacaagcaagcgggcaggttcacactcagagagtagttgctctagactgagggagcatctagtttctgatgttggattctgttgatccgagaggaaattgatgacatttaaaaggagatgctgaaattgtaggtttaaaatggaacaaactgatagtgagtgtgaaaggaggtgtctgtgtcattgtcactgggattgtctacagacagccaaggaaaagaatctggccgaactccacagtgctcctgttctcaccactgcagagtgacaggagccacaagaacactcttaccaaatatgtttgagggtaagattaaagctgtgaagatgtatgtcttcctgatggtgctgagattttatatatgaatgagagagagagagaggctgggctataaaaccttaagaggtctactttgccttctcaggttttgactcctcaagatttacaacttttcaaaatggccccaccagttgtggtcttcatgaacctatgggtactactttatattttagctacaatggacattttgaagtaaaatgatatattattaaagtttttgaaaatgtgccttgatattaggtatacctatgttccagtgtagtccctgcatcccccttcctacatctctttctttcatggtatctgaacccatatacccggtcgtctggatctgccatgtttgtaactctcttggaccaaacagaatgctacctctcagctcccaaacgttctcattgctccacatcttctgtggtcctcttttgtatttagtcagttaccaaatcttgtcaataattagcttagcatttttactttattgacagagaagcaggcaatgtaaggttaaaacacttgtcaacattgtgaagttaataatcaacatagacgggatttgcccccagctctgttagattagatactgcccctcatgccttttcctcatggctgactcttggtgatgctctagggagatggtttgtgtgcgtcagcatgtttaagatggaaaatgcgtattaataaaattagaaggttgtattaaaacttgatatagaaggatcttagatgcagtttataagacctgtaatttgtggatattaatgattcattttgttgtttctctttgggcaacagaacattttgctgtctggttgtagaagcttgttaaacttgaacatttgttaaagtggtcaatgctaaactattgtttctggaatacaatttatagttataagattttgaacaagatcctcattgccttgcattgaaaacaggtttatgcctaactgaagagaataagtttggcttggtaaattaagcttttaccatatgagcagtttcacttatgcagaagtttacaagagcatctgagtatgctctaaagaaggaccgattgggctggagagatggcccagcggctacagctgcatccacgcctcatccacctgactttgattcctgggaccaatgctagaagtagagaactgattgcgtgcgtgcacacacacacacacacacacacacacacacacacacaataaatatctctaggagccttaataaggcatatcaatgcatgctttcttttcatttggactatggaattcagaggtggtgagagcaaacccactgtgcacaggactggtgtgtacactgccctttagttctctaagctgcacggaggatgttggtataactcagaagtgctgtgatataaacacagataaaacatggggcactgccactcaatcttcagaatctctacaatttgttccttattgtcttcacattgactgaggctcttggcatttcattaagcaggaaaaagtatatatgaaaacctccagttttttttttttttttttttttttttaaactcaggaaggagaattaaatggagaaattaatcttctctgagctagcgacatccatctgagatgcagatgggagctctcactggtatcggctagcttgggctgctttcagctagagcatgtttccattcatcaatataagaacttaactctgttttatataattacatcctgaagcctggcaaattactcgccattaaggaattgtacttcctgtcttaagggagctgctccccactgacactgagtggcagctgctgttgatcctgagacagttaaacacagcagcctccggaactattgaggctttgccatgcgcggttgaggtcttcctttgtactgagcggatctttgtcttacagtgacagtcaaggctagctttgatctctgtgaagtaaatactcattttagcagcctctcatgagtctcaggatcagcaatgcaatgatataatttgagtcccctgggtgtgtgttcccctgaagttcaagaaggtctgctttccagagctagcagtgctggtgccagaatgaaagttcttgggctgagtctaatgtctttctgcctgccagtggcctctttggtgcttttaccatttctgaacctgattctctggccttgatgagtacgtgagcttcctaatactgtttttttttgtttgttagtggtgttgttttgtttttgtcttttttattttgttgcgagtgcctctgtgtgtatatgtgtgtgtgtgtgtgtgtgtgtgtgtgtgtacgtgtacatgtgattatttcatgtggagcaccttttcttttgacgcccttccctcctttcctctacccctttgtgtagcttagtcttgcacttgggctctgactactgctaggccagccttgtaatgaaggatctacatccacatcccacagagttaccttctggttggtgctagtaagcctggcttgtccagatgaaaagcactcaacataggtcctggacatggaggttcaccatagcagtgttgtgctgcaggaagttaccacctatgcaagctatgcacgggttcctaagagtatctgagttgacattaatagttggcctaactgtattcctggaaataattccattcatcagcctttaatgacatttcccattatatgtattttagcagagaaatcgctctcttctaaaatgttctttctcttttttctggttcttcaaatatgaatgggtttctctttggaagacctcagggcagggttatcctttcagtaactgtcttgtgtccctgaacagaagcaacaggagagctgtggagtcagggccatatccaggcaggctctgggaggcaggccgaggggactgactgcacttggagcttcggttcagtctccttagaaacggtgtgaacatgctttggaaacctgagctggcgttcggcagtgtgagaatacaacactttggaagccacaaagattcaaccttctggcccagaccacatgcctggcatcctgtcaaatgtgcgactccattgtttcatgcagtcttcacttaaaccaaaggaaacgaatcagatttctgtgtgtccttccgtgtgtctctattatgtgcctttcgtggagtcaggtatcaacttgtttttaaaacctgctcattgccagtgaacaggagagttgtgttccacacagcctcatctcccagggcctcatcttccagaactttgctatacattatttactctgctctgtcttagttcatttgtgggctgtactcgtgagtgttcgctgagtgtcttagacagttgaaattgcagaaaacgtgcttggaggaaatggcccagggctcgtgttgtaggacctctctgtggatgttaggacttttaaaaagaaactttaaacacataaacctctagtaattttcaagatgtttaaatacatacagctctaataattttcacgatgttttaatcttggaaaacccagaaaagtaaaaagcaacatcaaaactaaaaattttttttaaaaagaaaactaaaaatcttcttttattccattatccaaggggaacctgtattaacattaatatttcctttcatattttcatgttaatatattttttctttccttcattatttgattgtatctatatgattaaatagtataattgcaaggtaatgaatttgcttataaatttagaaaacagtgaacattttaaaaaatctgcatgcttatcacttaaatagtatttttttcttaaaagtattatttttattattgcatagtgtccgcattgaccatcatatttcatgctgtgaatcttttgtcctattgtcatatcggtggaagattcgttagcattccctagcccagtttagctcagataagaatgatccccacgtgggaatccccacgcggcgatcttattcagccccagcgactttcactccctttatcctctcactctgcccccttcaacaagtgcttccagagatgacctggcaaacttgccgtggcagccactgagggaggaaaggcatggcgagctgccaggggagatctgcttggactacctgccttacctcacctaatcccattgtctgagactggctggctccgggctgtgtagaccaggctggtatggagttcacaaatatctgctttcctttgctgcctgagtgctgggattaaagatgtgcaccaccacagctggcccagtatttagacttaacctttttctttttctactccttttctctcctttcccctcccctcccctttctcttcctcttctttctcttcctcatcctcctcctagtattgcatttgtttatttatttgtgtgtgtgtgtgtgtgtgtgtgtgtgtgtgtgtgtaaaagccatagcacttatgtggtgatcagagggcatcttgcaggagtgggccctccattcaccatgtgggctctgggtgtccaatcataagccatcagggttataggcaagcacctttccctctttggccccagtatttagacccatgagagaacctttggtctttgattggaggctgatgtgataatgggccacatcatcaggatgctcatccccctctactttgctggttattttcagcatacagtttgcttggctgtaaagttgtgactaatatgtacctaacagctgatttagatttaggaagaaagaaggaaagcctagtgcatgccttgtagatgagagactcactaagttcccttttctcttcagagtgaacaaaaccagtgctttgagctttcatcagaagaataaaatagctattaacaatgccaatagcatataaaaaataaaatttctcagtgcttttgtgatagcagctaagtgttaaactcaatttatttacattctcagatgacttgatattgaatatattattactcatattttgctagttggtattttctaggaagatggtggtatatgaagtccaaagctgcataatttttaaagaaaatgaaaatcacattgcaacagaataaatattaccaaaagaattatgcttttaagatgctgtgccattctccaaggtggttattatagacactgacagtgtttagcatgctcataaatagcactaactctccacctgcattttctaggttatctacaaaatatagaaactctggaaataaattagaagctttaaagggatgataccgcttcatctaccttagaatgaaaattgatgtgtaaacagccagcctcaattatgtatttttttcttcattcagtgtagaataaactaagacatttgggagcctgttatttctctcaaattaaatgtgaacccagtattgcaatttttcttttctctttagccttttgagtgaatgtaatagttactgctgtatgaggaaaaggaaacagatggggcgtagctaacatccaaataacactagaagtattttatatgcaaaattggaacttctcagtgtcttcagctgctgtgtgtggaagaaaaagaagcagctgtaaatacatacataatttctgtcagtaacttcaccagcatcatacacaggtgaaaacatctagattctttttggacactcgctcagactttctttttccccttctgtggatgcagtttacagtcactgttggcatacaggacagggttgcagggtggcagggtgcctttcacaacccatcacccttttgctccttcccatgtcccctgtgtgtccctgtcttgtcatctttgttcatagttgttctctacagtgcgactacttgtctttttcttccatcctttttattaaaaatatgtatttttctcacataatatgttttgattacagtttcccctccctttattcctcccaattcctcccacctccccttccatccagatccatccttgtctctcataagaaaacaagcaggtttttaggtatagtagtaaagtataataagataaaaactaacacatcagaataggacaaaacacacagaaggaaaagaacccaagaaaaagcacaagaaacagatgcagacccagagactcactcgttcacatacttagaagtcccataaaaaacaccccacataactgggagttatatatgcagaggacctctagggtaaaggtagagaaaaaaaaatctcaatatattaataaagtaaaattaaaaatcaaaattaagatagaataaaaagtaaaaaaaggaaaaccctgtggcagccttcaaaggtgccattgagtctgtgttctggtggccattcgctgctggcatgttttgtttgcttggtgtggtgatttaattcagcatggctcccatagacttatagatttgcatgcttggtcaccgggaagtgggtggcattattaggagatgtggccttgttgctttgttgaaggaagtgtgtcactgagagcagaccttgaggtttcagaagttcaagccaggcccagtatctttctctcttcctgctgcctgtcaatccagatgtaaaactctctcagctacctctccaggacagggtccacctatgtgtcaccttaacggagtaaagctctaaactgtaagccagctccaaataaatatttcctttataagtgttgctgtggccatggtgtctcttcgcaacagtagaacattgaccaagacactagtgagagtccctcgaagcaaacaagcttcatttgcaatggttatgaattagctctgggttagggggcggggcatatgcccgcttgttctttcagctctaggaccccatctggtacagacctgtgtaggccctgttcatggagcctcatgagtttgtacgtgcattgatcttgttcatttagagggtcttgtttctttgatgtcctccatcctctctggctcttatgctctttatgtcttctcttgggcagggttccctgtgccctgaggggagggatttaatggagatactttgtttagggcttgagtgttctaaggtctttctgcatgttatctgacgatgagtctctatgttttgtcccatctgttgcaggaggaaatgtctctaatgataactgagcaaggcactgatctatgaatatagcacaatatcattaggagtcttttaattgctatatgtttttaaacaattgtagtatttggttttcccttaggtccctgggctttttagtctcagattcttggtcacccacagagatatttgctcaaccatgttctttgttgctttatttatagtagctagaaaatttaagccacctagatgtctctcagcagataaatagataaagaaaatgtggtccatttacacaaaagtctattactcagctgttaaaaaaaatcatgaaatacagagataaatggatgaactagaaaaaaaaaaatcatcctaagtgaggcagtgcatatccagaaagacaaacatggaatgaatcctcttatatgtagatattagctgtcacgtcagtgacactataatcagtaagaagggacttggggaagtggggtggggcatgtgacacacagatagatatccctaaaaaggaaatagatggttatagacagatgaggggaaattgaaagggaggatcgagtggagagcggaaggagagagaagaatgaggggggaaattcagggggaaccagctaaaattaaggaccattcgagaggtagtatgaaaaactaatacaatagaagcttcgtaagtatgtgtgtgtgtgtgtgtgtgtgtgtgtgttatctacagaaaagataaaataggatctaaatgaagtcgcccaataaggagggagactggacgtggctttttatcaaatgaagcttccagtatgagggttgggttgatttaattgagttgttgaaaggggttcccatgaaacaacccaggctgttgccaagactattagttgctctccccaaacagacagcaaggccctattgctgaaggtaacacgtcccacaactctctaaacatggagaagttgagctggtatctacagtaatccttcacctctatattctaggtatgggaaggtgatctgatgctaccaaaggagaaatgtaagcattaacccagctctacccctgttggttgatttgcaatggtgttctgtctgcaaaatccgctagtgcagtagtgggagtaacctgcaactgtctggtctgacttaaggtccattctatgggatagacgcagtgcttgggcagtggttgggggcagtgtgacttctttcacattgaggaggaccctggtttgccctgatttctcttttgagacagtttctccatccttctttgtttagcctcgactgttattctcctgcctctaatccctgagtgctgagattacaggtgtataccaccacactcagagctaaggagtcttcttatgaaggaacatgatagcttaaatagtaacccattggttcacaaagtgtttaaatgagggttgaagaaaatgaaaataagtggatgggtgaaggcttgctttgtttcagggctgagaccattccattcatctctgtttctcatcctcttactttgaggcaggacatgaattgcaggtatcttgactgtagtggaggttccaaaggtaattactgaatggaaactttaattaaagagcaaagcaagcactgagccttccatcagcagtggaagttgtggtgtgtgtcttctctatgttatgtacttgggtatgtccttaacctttgtttaatgtggaaggcaaaaccaagggattgttatcccttggggcaatagtgagaggggagctttggcctgctgctagccttggcaggcttttctctagagagtctcctcagagtggtcttcatgtcaagtgccacaaaacagccttggtcacaatgtagcagttgttagaacagttgaatctgcttaaacagctcattagcctcatctttgtgagcaccatcagttcacattaatacaggccctggtctacagtggctttttcttcttctatttgtaaactgtgctttcaactagggcatctttggatgtgtgcacatttcattggaaatgtgccccaaatatactcattctgagcctttttaaaaagtcaccaaatcccctgctcctggacaggggtagggagggtgtgtgtgtgtgtgtgtgtgtgtgtgtgtgagagagagagagagagagagagagagagagagagagagagagacagagacagagacagagacagagacagacagagacagacagagagagatctgatattagatctccagctctgcctgattttgtttgtgataaggtgggataacaaggaaaagatgggaagactcacaccttccatagctcttaattcattgaacagctgctgaggttgtaaggatgatggagagtgtggtacttctgaggcagtcgtaacctaatagaggcactgttgcatggcccacaggaatacagggagaataaaggcatgcaggaaggggtgactgccccactgtgactgtggtggtcagggaaacctcctgaaagaggtgaagatggtctccttcttggcttttcgttgaatcgaatgtgtttaatgagcaggccttgttctgtcctttaagtagagacattggcatttctccccttcctgttgagtctcaggaaaatgatatctcaaaataattggcacaaaattaatacttgctttgagcaaagatgttatgactgctgggtttgccgtttgtatgtaaagcttgtttcttggtaaagagcaactgcacactgacaaaatgaagtggttgtctcaagaccgggtatttgtatctgtgctcctgatgtcttagccaagcatgccttgttttgcttctatgtcgtttttaacctctttaagcagagccccatttgacaaggttgaggctttcattggtgcaaatatatgctaggtggcagaactgtgatggttgacgtgcttggagaattttgttcttgttttgttttgttcttgtttttgaagcagggtttctctgtttagcctgtctgtggaactcattctgtaggccaggcaggcctcaaactcagagatccacttgcctctgcctcctgagtgcttggattaaaggcatctgctatcattacttgacccctgatgtttggagaactcaagtgctttgcttacctcatctcgctgaagattgaattttcgtttttgatagtaggccttgaatgtagggcccatgaatgctaagccagcgttctaccataaacccgtgtctagtcttcttacattaaaacaaattgtaacaagttctcacagtgttacccaggctgaccttcagtttgtaatcctcctgcctcagcctcctgaggaactgggattacaggggaatgcccccaggcctggcctcatgggatcttcaggagacctcttggtgatgtgtcattatccttatctatagttcaaaaaagagtcctctatgaaggaggacaaacatctttgcctaagaggttcaggcatagagacatattcagaaacaggggagtaagagacagcactgtagcccctaggatgcagtattgtacctattaggctgcgtatcatcattcaaactcaaatgggtctctttatgctttcttctcccctaagaacatcacagacttgaggggttcccacaaggcccttctttactgttggaggtctgcctgatgccccaggcctccctttctggttgattttcagtcagcattttcagggatcctggttcctttcgcctccaccatgacaactgcaagtatcacccattaactggcggtggagctggctctttgtgtttcatgttccccagtatagaaacatatgtgtcttggtgcaggggtttctatttcatggtagttgggaattaaaagggtctgttttgagtagtgaagtacctgaaaaaggataagagcttacgttttccatgtagccaggatagagagtcagggagtggggctctctccttgcttctgttcggactgtgcaacccaaggcttgcattcctacaccaaggcacacaccttccgtatgcttagtgcctttgactttagcaaagtagttcttactggtgggggcttctgctggtgcagtctgataaagcaatgctatttcattgagaaagaggaattcaattgaaaaaatatggtctacttatttgtggttacagcattatgtcccgttaacattttctcatggatcccctgtagaactttaaaatacaatgatcgataaaaagttatctgtttattaccttttttactttcacttctatttttactcatgaaaatctttagaattcagatcagaagataccaggttaagagattttgtaacccttgggtttgatatctctaacttcattcagaaggtttgctgttgatgttttggttttgagatagtcttcctatatagcctatatatatagtcttcctatatagcctatgcctcagttcataactgttctgctggcttctgggattgcaggtatgttctatcacactttgcttaagaaaggatttttgaatgcattagtttagtatacaaaatttaatcagaccagcaaatgcttatagactttagggagagctgagatagtaataaaattcagataaagtcagtaggactgagtgagggagttgagggtggtttccctggggaggagatttctaagctaaaatagaagatgactgggatgaaggaagcaggtgaaatttgtctcaaatagagatgaggtgcaggaggggctgatgcagtgtgagaaaggagaacagtgagaggggcggtttgagaggagcagtgggggcagggtctgagagtggggagcacagagtgtctaagtttcgtagaagtagttaaattctctgggttctattacaggagagatggagagctgcctgtagttttgataagaccctctcagatttttctttttttagtaaagctagctggcagaccatttctaagatcacggattccatttgtttttgcataaatggccactcattggtagagataggcagcttctcttgacatacaagctacagtttaggaccagagctgctttgttggccattcatcctccttggtgctgcaggcttgctggagtgcgccctttgtagagacacggccacagtgtgagcgaacaagcccaggcagaagtgtttcccaagtgtcttcctgtatccctttggtgaaactcggtcaaaggaccaggcattgcagtgagaggaactgtagcattacagggcagagtgtggatccaggaagggcaaatggattgggaatggaggttcatcaacccaagcactggccctagtgaattcaattgcttagcagtaagcatttcctgggatatgggacttggagtgaccaaacttgggaagtcccaggtagccattgtgaatcgagaaccttggtgaagaaggtggaggactgttgtgtcatccaagtgcacaaagctggcttagatgattgaagtctcacagaagaggactgtttgggacgtggtttggaagtagagctcatgggacttgatgctatttgagatgtgggtgcatgagcaaaaccgtgaagggtatgttcagccatttgaatatgtccttgagcaagatgtaagaagacgctgtaaagtagaattgtaattttgtagttgttagtataagaccatggcagtaaaaccgtgcttgcaaaatcattccacgttatggtttcatcagtgtggtactgaaagaatacgggaggaatgggagcagcaaatggaggttggtgtgctgcacgcagaccagcagagatgccaataaattattgcagaaaagtgatttctactaatgaaataaatgttcctaataacctagaatggctctcccacagcccctgctcaacataggagtttgaaagatcctttcccttacgcactgggacattcagtttccatatgttgtgccttgcaccacttgacactacggaaacacatttacctgtaaaaggtctaactgataaaatggtaggtttctgccagatttctatccaactacttaacctctttccctgttagcagcctcttggaaatttgacctctgactaaaaatcctttccatttctaggctgagagctcagataactttgttaatgtctatacctggcttttctatctgcataaggagcttggactaatgtttgcattggagacttgctgtgagcatcctctttatatgaggtcagtgtgtgaggatcagagaggccatttgtgttacaggctcaccggatattggatgccctccttctatttctgttgtaacttagatgtagacttcctgttgtcctttcttgatttgtaggcctgagaactggaaagccagtgtcctggtaaactttaaaggtaacctgagattcagttccagtatttaatttttgaggttttgaaattttttttctacatgggttggtttcctctacttgataaatatatgaaaaggacttttgatcatgtaaaatggagttgcttttcaagcctaaggcattgaaatttgccttgctttctacttgttctgcatggccagagcctgctttgtctgtgatggccttccatctgttgtcccgccccatgcccccttcttaggtccctggcttcctttgtatgccttagcttcttgtgtatagttcctgtgctcttgacttagtacatctcctttctctgggttgcgaaggaagacttcggacagatgtgctggaagagctaaacagtcccttgggacttcttattctgttcactgcacctgattaaagatgactaaatatgcagtaatgagtatattctgcatgtttactggaatataggtctgtagtcaatgtctgaagagcggagatggctttcttcagtaggcaggtctctacagctgcacaatagtatctggaagttgttgttgttgccctcctcctcctcctcctcttcgtcctctcctccctctcccccctcccctccttgaccctggattcagtcattgtcgctgtagacaacaagagagatgaacctcatgataaaagcaaagcccagaactttctctttccttaatatctgaagtcatgggcaagtgagcattttttgatatgcaaaaaatagcagactgggcctagctctaacactgtaggacttgagccagaagacttttcattgagataatttaaaaagataaggggtttgctttagctcacggttttagaactttcattccatagttagctgcttttgtcatttccgggcatgctgtggtagagcaccatgggaaaaggctgtaagagcaaagttacttattttatggtgacctggaagtagaaagaaagacaagaaggggccaggggccaaggtatcacttccagagacacatttttagttactcgcttttctttgagttaccgtacctctgaaccttctcatcatcacctaataataccattaaattataatattggtggataagtcagttgcttaggccggagccttcatgttctacttatacctcctaatgactggatccaccacccgggcaccgagccttcaacacatgagcccttttgggggaaaactttataaatctaagtatttccaggaaaatgaatgtgtgtggtaggacatatataatcccctcagcctttagacttctcaccccagcatgcaatgattgtgaggtcaggagtgaggtgttagggatacaaattgaatattgttctagttaggtttaactttcaactggacacagccttctgagaagggaatctttattttatttcgttttatatgtgtgtataatgtatgcatgtatgcatgcatgcatgtatgtgtatgggtgctttgcctgcatatgtgtgtgtgtgtgtgtgtgtgctgagctgtctctcctatcctagtttttagctttataacaaagctaagcataggcatgcaagtgaagaaacaagtagcatccctccttggcttttgcttcaaggtccttttttttttttttggcattttcagaatcaaactttaatgcttatttagcttgtagaattgcttatagattaaaatatgaccaaagcttcttgtagcactttggaactgtgagaactttatcaacatgtaagctcctgtgataaacaactgtaatctccctgtcaccacatgaacacacaactcgcccattttcccaattctatgatgttttcaaggtccttcttaagttccagcttgtgttcctgacctggcttccctgagtgaatgtaagccagagagaacctcttctcccccagtttgcttttggttgtggtatttgtcatggcaacagaatgaatctgaacaaatatagatttgtcgattttattctgttataattacagtggtcaggttagtgcaaacagtttatttctttatcagtgtacacctgtatatacacatttggtgctggataatataactgggtaggtatgttttggggagggggctatgaatcgtagttagaaaagatagaaaataaatgtgtgaaaagttacaaaataatgatgcaagtttatcagagctatgaggaaataaaaggggtggtgagatagtgaggggaggatatcgcgggactaatgtggagggatgctgtgctgtgacatgtgactgtgggccactcttgtaagaaaatgggatgcttgggaaatgagcatggtgccttcagcacacagggtggcgttcatgaaagctagggttatggttggtaggggagtggaaggaattcaggttgtagaaataggtgtaacatcccctaggtcattaggtctgtaaaggggtgtggttttgttctgtgggatctcatcgcttgtaatggaggaatgttaacattcctgctagaatcacttcttactttaagctattgctggtccattcaaaccttaatcattttaccaatgttaaatgagctctctgaactgttccttaacattcccactagaatcacttcttactagcagtccattcaagccttaatcattttaccagtgttaaatgagctccctgaactgtctctcagggagagagacagttccccttctcttacaggactggagtgtcacaagtccattgttactttaaaggcttggtgcaagtagttgctcctcacaagtggtgtgtaaaacctggccatatatttaaatatcaggcatcatgtcttctgatgaaaacataggccgaagagctctgagtataaatgcaggcctgctcttgctgttggttatttcagagcttaggtgccaaatgtcttcatcttcgcatgatttatagtaatgtaagtaatgtgttagagactaacaaatcaaaatctcatttcagacgtgtgacactaatgctgtgttgacttattttttcacgtgttagatttctgataaaattacaggaatgctttcttgaaaggagtaaccggaaggacgtgtgaggcctcagatatcagctgttgatgttttctcactaagaggagcccagcagtaagctggtaatgtgttagaagtgtagcagagcccgaggatgtgagcacccagcagtgtgcagttctgggtagcagaggacttaaagtgctgggatgcttaaaagaaaacagaggcgactttagtttaaatttattgttatgattgtttttactattaaaggcatttactcaataataaccagatgtgtaacagaagcggtggcatgagattttcatttttatgcatcatataagaaatcttagacaaaagcttattgtgttatggaaagtgaaatggccttttgttggtctgaacagctgtgtggaacagaatgctaacatcctctcctgtctcctggtggccatctgtctttaaggggctgacaggtaacttactaattttaagaggcttgttttagtgaaatcttggtaaatgtgcaaggaacatccattttggaaaatactgcagagctctgacatttttctgatcttctaaaggcagttagcctctttaagaatttcatgttttaagctattggtgtaatccctgccctcctggaggtagaggcagggagattcgaggttatttttctttacatagtaactttgaggccagtgtggctgctgtaagactctgtctcaaaatgtagattgcttgcctaatatccacaggcctgagttggattcccagtaccacctaaaatccctatatttgggaggtgaaggtaggaggtaggtggatcaggactggctacatatcaaatgagtttgagccagtcattgactatatgagaggtcttaaaagaaacaccccccccccccaaacaacaaggaaacatacccctccaactccccccaccccccttttttcaaaaggacaaaagtgcatccaatgcacgatgttgcgatgtgggcattagaaaacagtttcttttgttttgggccagatttagtaatattaattctattagtaaaatgtagtttacttaaattttcatcacctcaggttgtttctgttgtcttcctctccttggttttgtgtgtgtgtgtgtgtgtgtacttgctgacctagggactcactaacttgcctaggctgctttcagatagactctggaaccaatagaagtcttgaacttgtgagctttctacttcagcctccctagtagttgggattgcaggcctgtaagctagttttcaattgtctttttaatataaaagttaagcacaccaaataagcatggaactcctttcaaactctgtcctcctccagtccagctgtcactgcactttccaagggtcctcctggcagcctctcacactcagaagagatgtgagctctttttcacattcatttgtcacttttaagactccactgaattacccagatggaatgcagaatgagaagaaatgccacgttattatgctgactgcagacacaatgtgggaattctttatgataggcccttactcatgtcttactgctttatttattccagtgtgctaagcacggcagcttggccttgtttctctccaggtagatgaggtggctggaaatagtactacctgttttcatttgggaagcttaaatgtttttaagatgagtgatcatgccgagtgaatagagttagcgtcatcacttcctgctctgcttctcagtcaccaggcactaccaggaggcttaatcatatttagctgagttccccagtctgtaaagtaaggttcactggagtagaggagaaggatgagtgagtgctgtgtgtttgactagatggcatttgctgagtgtggcttttcagaagttaagacttaataaactacatgcacttttaattatcatctccagtgtgactgagagtgccagcgatgggtgttaccatcagcagccacagaaaacgggaaggccctcctcctctaagagagtacccaccccaggatatgggggccagggcgctttagatcacgtcctgttcccaccacctcccaaacttacttatgattctgaaattagttaagtcggattttgcatttgagcctaagactgtctgagcctctgtccccatctaccagacaaggtgtcactttcaaactaaaatagccagagtatgttctagaatgttgaacatttgagaaactcaaccaatagagcacataaaaacaggagatcccagagacacccttaccttctcaaaggactcctcaaggaaggaggcttcccagtgtcaggagcgccacagaccttgggaagggcacattagttggctgcctggtgactgaattcgtgttattggattttactacaaagatggcttatttctggatgctcaaaatcaatgtctcattaatccccctctccttcctgttctctcctctgacccctctctcatccctctcactttctcccctcccccccttagcccctttccttcttacatttcctcctttcccctccactctccctcttttctttgtgtgtgcatgcacatgtgcctttgagtgtggcggtcagaagacagtctttggtgtctgtctttacctcctatcattttgacaaaggatctcatttgcagcttcctccaccagcctagattctcctcacttcaccttcctcatccctataaagcatttcatttgcagaaagagaattctgtttcagcaggaagagaattctgtttcacacagtctaggtcattttagggcttggtgagtatccattgcctttctgttgtttcctggtgttggtcagtggtgttctagcttctgtcctgtggatgtgggctgggaagtttcgctcactagcttaaacctcagtggatatccttgaaagttacatgtagagtttcttgtcttctttacagaaagaaaacaaacaaaacaccaaacgactttaaaaaagtagaagtcatannnnnnnnnnnnnnnnnnnnttatttattgctaatttgggtaggggttggttgaagttggcattcttggaaatattgagggaaacctatgatgaaaataattgcaacaggggaagtccttatgggtgggagtgaccccaggggagaaggcagctcatcgtggaggctgcatgtgcactcagctcttagatctccgcagcttatgtcagccgcttgcagctcgagccagatgatggagtgttctcgttctaaaaaataccccctgcctgatatctaagccttagagatcattttttaccatgtgatcaattttcattaatattcctcttctccataacagcaaaaggaccagagaagtgttgtctgtcctgatcatgttccttccaaggcaaggccaggtcagatgagaattagttcagaaaagagccagatctaaagcagtgctagcctaacccaacgggttagcactggaaagctctagacaggcatgggcgttaagtcgtcaggtgtcagttaggtcagtataacaggatcaggccacagaagaggtcagagtgaggtcaggtcggaacctgggaatagaaattggattgggctttgtgagcagtcaaatgcaggtatatatgccatgagtttacatgaaagggaagaacattttacagacatgatatttactttttgattttaagaagttaagttatatttttatatcacaaacttacctacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacttcctcccctcccctgctttttgagacagggtctcacagcttacctcaaactgtcttcatacttctaccttccaaatggggagcataggtgaactacctatgcgacaggcttttgaacaatgtgatgtgatgtgtggccagcgcctagctctttctctttagtataataccgctgaggttcatgttgttggacctttcagtcagttgttctttatgctgttgagtggcattcgattgtgtagacagagcacatttcattcatctcccacttggtgggtctttatgttctgtattccagtgcttgtggttaatgctgctatcaatgtttatgtttgagatttaaaaaaaaatattgtaacattttttaaattgtgagtttctatttcagtttgtgtatgtgcttgcagttgcccacagaggccagaagacggtttccggcagctgccacacatgggtactgggaatcgagctcctgtctggtagagcagtatgtgcgcttaactgatgagctgtctctgccatcctgagttgttctgcaggacatgcctttatttcttttgggtattgtggtaggccaaaaatctgctctgaggactcttgctgctggcattacacctgtgaatgtgtggcattgtgtgttgaaaaggactctgcagatacaattgaggttgctaatcagttagccttgagactgaaagattatcctggattaactaagggagccagtgtgattataggagaaatcaggaattcaaagaagtataggaattcaaaacaagtagagcaagcaaggactcagtgtactggactgacttcaggagacacagacctctgttccacagctcagaggaacacaatgctgctgataattagtgagctaagaagaggactccgaatcccagatgagaattaaagtcctggccaatagcttgatttagcctgtgcagactgtggagcagaatatcttaccactttatactaaacttctgacctataagcattatcatgcaataagtgactctgactgagtgcagttgaagccatcacacttcagataacttcttataacagcaaaagtaaaaaaatatagacagacccacaagaatttagtgataaatttccactttaagaagctttgtactatttgagtaatatttccaaaggacccacttggttgtgttgaaattagccagtgaggagccagagcagaagcagggagaccagtgggcaaggtgtgccaggtagtgatgttccaatcagggtggaatcagaacggatagaggtggcatggtggaaggtgacacacaggaggcggtgtggtggaacatgatgggcatgtgtaaatgcacaacccaaactgagaggtttcagatggaagctaagaaaaaagttcataattgactcaggggataaaagaaagctgctatatgatattttctgctttatcagtgcatataattaacctgcagagacaacctaattactaataggagttcatgggaaattgacagaagaaacctaccataaatgaataaactcagagtggctttgtgggaaaatagttgtatgcattatagttaaaggtagggtttaggggcagagaatgccattgtacaggtgcatatgtatgtcatactttctgcaaatgcccttagtatcttttaagcattaaaacaacagcagcagcagcaacaacaacaacaacaacaaccaaaaaaacttccaagtgacccaagggcagacatggctcacaacaacaacaacaaccaaaaaaacttccaagtgacccaagggcagacatggctgctgatgtgagaattagcagtggtttttactttctatcctggcataaatcagtatttagcagaggcctgtcctgagctcttgatcctcctgcttctgcttctctgattctgctggaatcacaggtgtgcaccactgcagcaggtctgcaccactgcagcaggtgtgcacactgcagcaggtgtgcacactgcagcaggtgtgcactggtacgcctgactgtttgactttgctaatttgagtattgtaagttaaaatgtagtacttgagcgactggagagatggctctgcagttaagaacacttggtgctcttttagaggaccaagtttagatcccagtacatacatcacaaggctcataactaatgtaactccagcccaagctgctctcttctggcctgcgtgctcatctaaccacacatggaatatacacacacggtcacataaacacacagcacacacacacagcacacacacacacacagacacacacacacacacacacacacacacacacacacacagtccattatatagccctggctggcctagaactccctatgtagatcagtctggcggctttgacctcagaacatcttgtctctgctttccaaatgctgatattaaaggcatgggcccccttacccatccatttgtgcatctgataagcttatgtaattcttgcatattacagactttattcttatcatattgaaacctaccagcaagcttcctgttacttctggatctttataatcattgttcactccttaggttctttagtgttcacatttcctcactggacagtgctctgttacccagaagcctctctgcctttctgtgcttgagttgggcatctctttgggatgctactgtgtggtcagttcacattcacagtgtttatcttcgtttgcttctgctttcttacatgcagtttgaacttcataagttcaaggcttacaattgcttctctggcataaagaacttgtcatgaggaagttcttagtagtactgattgggtcaaatcaaggaggcacagttgccacttgagtgtacacctttctcttcgaaacagcagagtctcttctctcgaagaagaagagtacggtgtctagagaaagccttctcatgctttttacaaaagctggaaagggaactcctcgtgctgcatgaagttgtgtggttacacctggtcgccactgttggggggtaaagcacatagctatgtgtaaagcagatttagtcttgtgccgtcttaatttgactacatttctgaagtttgctcttgaaatgactaccatgggaatgtctgaggaaagtgttatctagcatctttatgccttagtaacacaacaccactcccacctcttacctactagcacacccagctgcatttatacacagagatgtatgcctgagaaccgtgttccctgggaaagggactggataggcacacatttagaggatgaaattttcttgagaagttgccaggcttcactgagcaaggaaccatgaaggtgagaccagccttggtttcagctcctcaaactcaaccaaacagacaggtcatagttacagcaggtcttgctcaggcttcccataagttcttgcaaacagttcaattgtatttgacatttattgggtcatacttgacatttctgagtagagtaggcattttctcttcctgacaacttagttgtgaagctgtgattgacactataatgttaaattcaacttgcttcagaatcaggcgcgatgttgaagggagagtctgctcccaatgttacctgtgatccataggtaatattcttactgaaggagtagagaaaatggttaaacaaagatggcttctgctggttacctggggtctcaggctctctgtgctgagtacgcctttggcctgcctgtacgcctgaggagatccccagcaaggaaagcaaatgcatccacttttaaattgtgcttgctttgacttcttagcaccttttctcatttaaaacgcacgtatgcacacatacactcctgcttccaaactatcaagtttgttggagacttttctcaaaaataagtatagaaaagatcagttagagtccactgaaaacacagtcttccttctcagtttcctttgtagccttcagatatgcctttgaatggaaaagtactcatagatagccatagaatgtccttgtatcatacctgctgtggatctccatagtattcattgcgtgtatgtgtgcatgcatgcacatatgaacatatacaaagttggtaccagatatttatttatctagtggtgtaggatgcctgtacttcgcctctattataaccgtgcctcacaagccatcttagtccacaggctcttgttctacctgtataagttgtactggctagttttatgtcactttgacatggctagagtcatcagaggaagtaacctctgttgagaaaatgtatccttaagattgagttggaggtaaggctttggggcattttcttaattagtgattgttgtgggagggcccaaaccatcatgggtggtgccatctgtgggctggtggtcttggattctataaaaatgcagaataagcaagccattaagcagcacccatccatggcctctgtatcagctcctggccccaggttctggtgggacatggatgcctgccctcactgctttggatgatgaactgttgtaagaaactgtgaacaaaataaacccttttctccccaaggtgcttttggtcatagtgtttcatcacagcaatagtaaccctaacttacacagtagtgctacaggagttgtcttagggtttctattcctgcacagacatcatgaccaagaagcacttggggaggaaagggtttattcagcttacaattccacattgctgttcatcactgaaagacatcagaactggaactcaagcgggtcagaaagcaggagctgatgcagaggccatggagggatgttctttactggcttgcttcccctggcttgctcagcctgctcttttatagaaccggagactgccagcccagagatggtcccacccacaaggggcctttcccccttgatcactaattgagaaaataccccacagctggatctcatggaggcacttccccagctgaagcgcctttctctgtgatatccccagcctgtgtcaagttgacacataaaaccagccagtacaggaatgaacatgctggttgccaagtgtttgaatggaaagtcttctgattcttatatcttcagattgtaccagtgtgcatttataagcatagccagtgactcagtggctcctaacattagtggcttctatacgaggttgtatattattgatctggagtttttaatccaaatagccatgccattgtctagagcactaataatccatgtggggtttttctatagcagtgatcttcaacttagtgactgcgactcctttgggggttgaatgacccttttataggatatcagatagtttacattatgatccataacagtagcaaaattacagttataaggtagtaacaaaaataatcctatggttggctcaccacagcctcaggagctgtattaaagggttgcagcattagaaaggttgagagccactgcttacagttttagagaattttttaagctactgtttatttggagctgaggacgaagccatacacgcgctcagcatacacttgattactgagctgcgctccagccccattattgagtttgcattctttaagagccagcttattgctttatttgaactcttcttttacctctaagtccactctgtaaccagcctaaggacttgggcagcttcctttggattgtacctattacccaaagcaatccgtgtgctgctataaacaattaaaagcccaataacacttttagtggaagaagtttcaatttcttttgcttattaatatccccaattcctttgtatgggcatttcccagtggcttttttgctattatttactatgttttgtagattgtttggtaatttcataaacgtacatagtgtgtcctttctttccttactacctctcattgccccttctcagttccccacgacacctctaagcaagacccctgtcatattttcttcttcatgtattaccctttcctttcctttcctttcctttcctttcctccttccttcttcccttcacctcctcctcctctttttcaacctcctgaagtcagttagtgctgcctgattgtgatatgttgatcttgtgtgagtaaccatagctgcagtgagttcatgagagcaatggtcatgtcgtatttagaaaacaacattttatattcttccctatctgtagcttttctattctttcctctccctcatttgagatggtccctgagccctggggagtgatttgacatagatgtaccttttgtgggtgagcatatagcagcatatagcagtaacttactctcagcagtttgactacttaggagtcatcatgctgtctcttacccattgcagaaagaagcttctctgaccaaggttgagagcagcactaatctatagggctatgtagaaggcagtttgccaatatgcccagttcaaaaaacaacaacaaaacctagactccctctagggcccaagatcctagatcatggcttcttaccaggtccacagttctgtcctatggagcaaccttcagatctcatcagaaggtgattgtttgcctctataaacttcgtgccactattgtaccagtgggcacaacttgtctgtcaggttggtactcagggtacaccagtgtgtaatatctttggtgatttttctcctccatcagcatacacagtaccttctggcactataaaagcttataaagtagtgggtttctataattgtgtgtgtgtatatatatgcatatttatgaatatatatatatgtatatatgtgtgtgtgtatatatttagttaactggctgttttccctctttgcccatctttttataaataaacaaacaaaaaataagtgttatcattcttgtatgtgattctgcttgctttctcccgcctctgtcttatacttgcatctttagctagatgtctttatgtgttcttcatcttcttttagcagatttctatgctgttctggagaatgcattcttcctaagacttgtaacctttgagaatctgtaggtatttatttaatactagctaccaatttttgttttatttgagaagttggtggctatagtttgtataatgtcactgaaaacaaaagaaaatgaaataaaacatgggtgcaggactggtggtcatggtttttgccctctctctgtctcttctatgtttgtgactgggccagacctgttacctcctaaagctctttattacaggtaacactaacaaaaggttcatagtctatgataaggagtgaaatttcatcattacaaaaccttttcagattttacaaagtagtggagagataaagtttcattgtctcccaagaaactccaacaaggaaaccaagaatcagtgagcctttaggaggcagaggtccaggaagtggaaggtacagggtgggtcaataagttttagtcagcgagtagtgggaaagtttgtagaaataacaggctcggagtgagtggggaaagatggtggagtgagctgctggcgaggggacagtctcagggtgtatcagggccagggaaatgttggtgagtggttgatctttgttccataggtggtttgggatctttattacatacagggctggaccacgggcaagtggcagtggagggagagctggggtgtgtgaatatcttcatgaatggaactttacatttatggcatgcgaacgtttatggaatggagataggcattctgcgatagtttccagattggtcatagcactcattagctttaatctgagctgcacatagcagtggtggagtagcaactccttcaccgttggttctagcaaccagaagtctgacactgatgcctggtagctgtggcctttattggaaaccttaaggggaaaatgagctctgtcccctgtgggatgccagccagtcaaagtgttccttgctatgtgggtgtgtaactcctatctctgcttctattgttacattgtgggaatctttctgaagatcactctgactccaatgagatcggaagagaggacatgccactggtggactcaagtcaggacagttcctgaaaggtctcattcctgggtccagtatgcattctcattttatattctaaaaccacaaggtggtgggtgtggacaagcaagcaagcaagcaagcaagcatgtacagaactgtatatagcagtcagaaggttggtaagggcagaagcccattgtttctgctgtttctctaggtctttctgtctcagctagcaagttaagtcatgcttggcaaatagacagtgtaggcagtacttcagttaaatcactaaagaaatcaacaaatcagtatttagtaattggtcttttctaccttattctacttcaatgcccttgtcatccctgtttctgagtctcaggtcacccccatcttgttcctatgaggacacacatcattagagttttagtagtctagtgtgatcacacccggaggtctttagcttagtgcaaagaccatcctccaagtacagtcaggtgcacaagctataggtagacatgttttggagagcggcccttcaacccagtgaaggtagtgatgtaagtaaatagcctggtaatgtacagacttggtaggtaagccttggagattatagactacggctaggtagtccttgacttagcttttattgttaacttgatagagcctcatcatctgagaggaacgcttgattgagaagttggcctgtggagaattaccttgactgtcttcgttgatgtaggaggccccgttcaatgtcccttgacctagttcctgggcaggtgatcctggggcatataagaaagctgagctggagccagcgagccagtgagcagcagtcctccatagtttatgcttcagtttcttgccttgagttccggccctgacttctctcagtgatggatttttatttggaagtgtaagccaataaatctttgctgccctgaggtgcttctgctcatgtcatttgttatagcaagaaagcggaaactggaacattcctgaaaggagcccatacttgtcatttgcaggtatagtgctatttcttgttttttgttttgagatagttttgcaagcgcagcccgggctggcctggaacttaccttgttgttcaggcctgccactttcatcctgctcactaggttctcacgtgctgggattacatgtgggcacccccatgcctggttagcagcccagcttacagatattcctcagcatctgattctctaatggggagacagattgtgaataagagtcaggccttggggaccagtatttatttagcattacaattcaaagcaagagaccaaacctcaatcattgtctgtctgtttgtcagtctgtgtgtatatgtttgtgtatgtgagcatatatacatgtgtgtgtgtgtgtgcgcgcgcgcgataacgtcaccttgacctattggatatctttgaggtgtcacactgaaagtagttagagttcagctaggattattgccaggcaactagaacctttcctacctgttgaagcaaagccaggttagagagccgcctttgagaatcccttggtttgtgatttaatgatagtaagctcagtaaaatatgttcccatttctcctcccagttttatgtgtaatgtgtaagtgataacaccttaagaatgataagcgatattacttgttgttgtggagtgcagcaggcagactaggattattgtgtaagtcacgtccattttcagggtttgtccctgaaaaacaaagttctacctgctcttggcattaattaaattaggtataaaaaagttatttctcacgtaaattaatgccacttgacattctaaattcttctgcccttaaattcataattgcctcattttgccatgatttatccattgtgaacttaggccctgtaacttactgagaacacagttgtaaatgggtttcttaatgaggaagaaaaacatttagtttaaggatgaaacagctttattcccagctgtattttaataatgaattccactattccttgccttccctataacataatagaacttttagttcttcatttttgagcaaattttagaatgtactgatataaactttattctttggaaatgtgatgtattagaaactcatgcgaagctcagtggaggtcatgccagctactcctggatgctgtcacagagttctagcatgtagttgccaagtctgctgaagccttcttggacatcttccactctggtgtcttggatgggcttccttgtctctgctgagggccaagccaagctgcgcagtctacatttcaggccactcccactaatttttggcagacagaccagtgacagcaagcaggaaaaggctaaagctatgatcctgtgctgcctggccactcttttctctctgaacttccctggtatgggttgcactaaacacagtcagagttataactggaaagtttcatctttcataaccaagcaaccagttctgctggctggtgcttcctggtcaccatggcaacttaacaggttcacctcattccttcctctgaggccgcatgccctgactgttcactgggctttcttagaatttcccttcaaataaagaactaccgtgcacattcagtatatgcttttagttttaatacaagatattgtgcgacattaaaattccattactttgtttaaattcttattttgggtaattagatttttttatgcatcagcttattcttgattagatgccactctttctttacctcccaatgcacacaaaaatccctttatgttatatttgatacatagattactatatatttagtatgtaatacatttatgttctctattattacacagattataatcaatcatcttaacccccccccccacaaaaaaaaatagaagtgggaatttgaaatggcagaaatttaaaatgttagttgaccaaatcagagctaaaagctaagagacaaaggaagagtaaaaagttagtaccagccaggcagctggtggtggtgcaggccattaatcttagtactctggaggcacaagcagggaaatctctgaatttgaggccagcctggtctacagagtgagtcccaggatagccagggctacacagaaactccctacaaaaaccaaacaaaacccaaaacaacaatgataaaagttagtacctttttgcttctcctccccccccccccccccacaaccccccaactgcttttaccagtttctatcagctgctgcaaggcactttttacattgcaaatttggcagttttccttattctgttgctcttaagaaaaagataaaaggaggccatctttccctgccctggccctcagttccttgggtgaacagagaagagattttactgttaaaactagaagtagttgacaaagtgtgatgtaccagtagcactagcttggctgttacgtgacttccccttctgttctgatcagggaaagatatcagacagagggtctaatacagcgtttccaccgccagatttctactgtaagcatcaatgaaattatgtgactgtgtgtgtgctcttcagctctaactgatgaagctagagaagaaatcgacttcctaagcagatggggaaggcacagagcagccttcattcccaaagggagaagccaagaggaagaaaggcagtgtggatatgagggagttgtaaacctagcagagtgcccattttaagatttttcagtttaggaacagtcctctgtgtttccctgatgctctcttctctagccctgtggaaactgaggtcccgtgtcctcagtctgctgggaagcagatggactcttgaggacctgagtggcagcctgccccaggaacgcttagtggaaaaatgtgatcgtgtctgttcaggagaacaagaaacgggagtcctgtttgatggattctcatgcttagactttggagtctacagatggagagtcatctacagaaattattgtcacaatctaatagtcttttttttttgtgactattagaaggattatgtgcagagagtttagcagccttgatacggaatatcctcagggatattttgtgatttttgttggtttcatattgtctgagaaatgattagattaatgaatcaataaatgagagtggtaatgcacttgcttgggatttcaggaatccagagagaaggtgttggcaggggacagaattgcacagctcaccagtctgatgtctttcttaaatagattcctaatatagtttaattgtgacactcttaggtctcattttggaattattttctagatagtgctaaatttgttcctaatgctttcagtattcactgtttcaaagcttgacattctgggaagaatgagtaaaagtaaatttaatgagtcagcacttatgttcaaaaaaaaaaaaaaaacagttgtagcttttctttaaaaactaagttgaagttttaagacagagatgacatcattggtctttgtcttgaggtatcagggatttgtggacaatcagggagtcttctgtttcatcctttccctacttgccactttgaagtctctgagaaaacctgtctcctcaatgcttcctttaggactccttttgtatctcctggccccatggctttttctggcatgtgaacatccttgtctttagttcattcaagaccagtggtgagtttgtttgatttgtttttgtaaattttaacaggatcttaatggtcagacctttcattattgtagtcccttcttggcatgcagcaaaagacaaaagtcagaaaagatgggtgtccagtgtgtcttcatttaacattttggtgaaatttcatctgtgtaatgattcctgagagagttgatcagagctgattaacacaagccttttgtcatttgcccaggaccctaaaagggttgtcatcagcatagacatttagttagttagttttagctttgtagtttcaagttaagtatcattgaattaattttccagaatgacagttttaaaaactattttcacaggaacaaaaagacagattttctttgtatataaataaagaacacagtttatgctgaggatggaagtctccttaaataaaacattgtctctcttctccttggactcaactgggaaaaatcaatattaggttcttcaaatgcaaaaaagatgaaagggaaaagctgatgtgttaacagggcaaggtgtgtccttttcctggggctccagttctcctgtgggttttaagtagtctctcttcaaatcgtgtggattaaaaggacacagcggatgtttacttctgtgaaagtagaaacaaagtctggttcctatgcaggttgttggagggtttcctttttttttctttttttcttttttgtccttaaacttctgaaattgttattccttattcattctgcacttattttgatgaatgaaaatataatatttactcctttctctttccttcctctagttctcccattgccttccctcttgccctgcccaaattccccagctttcacactgatcaccttttttttattattgttacacaccacacacacatgactcacgcataaacccaaatatataaatgcaacttgccgagtgttttttttgtctgcttcatagagttcttactacagctacctctgcaagtcaggatgtatatagcataggaggttgcaactagcaggtttggaatggagtggcgggcggcatggattgccttattttatttgcctctgtgtctgcagcgcctgacctgtgactggcatatggtgcttgataagtgcaaccacacagcattctgttcaagctttgactgatttctttaggcccaaggacttactcattacttcttttttcaaatgccacagtttgacagcctgatacttattgttaacaacaacaaaacatggagaagaagaacagaagcagcattagatagactgactaccagttagattttgtttatgaaatggaaaaatgttctaaggctgcagatcacagggcgtgctttatatcaattactaatatctgtatctgtctgtcttaccatatcatctgtagctttctactgaaatactaggattccaagttccagctgctttgtatggcttggaagagagagatgattgtgaccaatgccatattccctcaggcaaggatttcattcagcatgcttgtctcgtatggtggctgagagttcctcctcaggccatttgttcactcctgtagtgacatggtgatgcagttgtgccttgcttgggtagcgatctatgtaggttgccaaaaatagaaattaagatcaaatataaaccagctccagaaagggggaaaaaaacaattcatctcaacactgtgtttctaacacactgagggtaatgctacacggggcacactgtacaaatatggagagcagcctgctttgtttataaaagtaagcatgtattagattggtcagagtgtaatttctaatgagatacatttgatgttccttgaatgaaggagtatgattctcaggaggttattcttttatttaccttctctacacttttacagatattaagttggtgacaggatggtcaggccgtttcttcttggttgccttctactgagagttcacatgcttcagggaaagctagagcttcagggaggcctgctcagcctcagtgtttcccctgtactgtgcccttctcatggacatgtgctggagatcaggacacgggggacatgttcctgcttttcatagttcattctattgtagttcttcaagtatcttttaatgtaaacatcttgacggatcacattcaagactcatcctctggtggctgaagactggaaactcagcaaagaggaacagtagagctcttcacaggtctgaggccttgttcactcagagcaggtagcctggttctgagcacaccccactattgtcccctttacaggtgcagttccaaacacttctcagagacagtgcctgctcactctagatgggtagaaagaacaggtgtttctagtaatttctcataacattgtgaaaggttttgaaaacaaatttaatgcaattcatgatataaaccataactataagtaatagagtataataaatccatttgaaggcagtataagttatatgcattatcacttaagtaatagtaagcaggcagccattttagtaatttgataattaaagtatgttatataattttgaggaattgcggtattaaaataacatttccattaagtgcctgtctacctctaacaagcccacccacctttttgtgactcataatctttcagaagtagaaggtaccacctcaactcagagccagacatttaaaatcaagtcattataaatcttctgcagccacatgaggtgacagatgttgttgcccccttcttacagacaggacaaccgatattgagaaatggatgaagcctgacatgctcttgaccactaactgtgatactggcttctttattacagaaagttggagcaatgtcttgccaattagtttctaaatcaaggaagctgggtgcattaacacaacaagattggagcactcgtacagtgcctgaagcctcagctcatggagaggctttacagggattttactggagccgaggtgtcagtgggttctgtaaagtattgtatggtgcctctgcctcccactggcctttacccatttccccagtacacatgctgagggacagcctgttggatggctcaatgggtaaaggagcttgctgtccaacacagtggaaggggagttctgatggctacaaattgttttctcaccatctcactacttactacatgaatatgtatacacataatgcatgaataagtaaatgtaattattattattttaatggtgatgaatggaggtaaaaaatgtaaaaggagtgtgtccttaatagaaaccaagccttaagtaggagcagcttgttggatggcagagcaactcctttattacaggaaactaggcaagtgcttggtatgttagtatctaaatgtaagaacctggactcttaaggtggacttacagaccgagcatgaaggactagtacagtgtacatgtaggactccttcctgtgaatgtgtataaggaatctgtctatattaaacaaaaagtttgttgtttttattgatatgtatgtgtgtgtgtgtgtgtgtgtgtgtgtgtgtgtgtagacacccatggaggccaaaacagggcagttgtgaactgcccaacataggtcctgagaagtgaaatcaggtcctctggaaaggccactccctcccttaaccctggacccatctctctagcccccattttaaactcttggaaaccaggaatgcagggccctagggtaaccatggtgattagatctctttaatgttctccatgttcttagtatgacccactgaaaagtgaaaccttccaaaccttcccgttggttttctaggaggaggaaagtagacagaggaggctggcgtgtgcatggtaattgaaaatggctggtggtgaggggcgatgtaggaacagctgtttccttctgctggaggatgaagatacacagagtctcccagcctattgttgtttacacggaaacaaccaggtgaggtgctgcagctgctaagttttgcatttttcaccagatagaagaagtatgttttcttttatatttgttgggaacttgaacatttacttcttgtagaatggcaggttttctgaatgttggcaacatttaattgaaacaaagcaaaacaacaacaacaaaaatattccacttttttgctctttttgtttgttgcatgggagtcagtaatagtggtatttacaggctcagttggtaacgtgcctgtgttgtaagagagaggaactggatttgatctctagtaccctgtaacaaaaagctcttgtggtgcccataaaattggaatgctagtttttgcggtgggtggggaggcaggaccaagcagggccatgggactctttgatgagttccaggctagtaagagtcctggtcgatggtgtctgagaggacagcccgacccaaggttgtcctctggccttcatgtggcactacacatatatgaacatgcacacacacgtgcatatgcagggaagaaaagtgcagagtgcgggactcagctcatcgtggaagctggtaacctcccttgcaccccagacgtcacagtggaggcaaagagtcaccctgacacagttgttacgtgacctcacaggcacacagtggcgtggctcccccaccaccaagtacatcatacacatacacacacgagaacactacatttaaactgtatagcccttagcacttattgactcttctttgttgttacaaaattccatgcttgagaactcaagggaggaagggttggtttatttcctcgaggaagggcttatctaggctcctgtcttccagttttttgtcactgatcacttggctacattgtttctgggcttttgtctggtgaggtggcaggaagagtgtggttgctgtgagttctgctgcaggcatcactgcttctcagtgagcagcttcctgagcaagctgtgccctatgcgtgctgcaccccgagagtgctgcgcccgccatgagctgcttctggatgaccttggtctaccttaacactctcctcacgctgaggatggaactatcactgaagtgcttgcttgggaaggactcggggtgcacagagcactctctgaggatctcttccctcagacctcacctgaggtgcttctacagtgtagatgttgattgtggttctggtggtccaggtgtgaagagggctggtccttatgtggtctgtggtatgcagatctgctggtctttaccttcttgtagagagctcacctcggtccccgcctttgcaccaccgcttttctccctgagtgtgcatctctgtcccaggttcccctcttaaaagtctacatgaatgatctcattttagctaattgtccttcagtgactcagtctaaaagtaatgtcacattctgagttatagagatttaggattttaacttaaaaatttgggggtggggtacaatttaatatattaaagagaatttgtttttgttttccattcttaaagatggcatcctgtgttttagctctggcttgtctcacacactgtgtcacccaggctggccttgaacatataatcttaattttcaccatttgaataccgagataagaggtataaaccaccatttttggctaatattcttgcttttttgaagctgtatatgtctgtgtccatgtctgtgtctgtcagtcagcatatatgtctgtaacttaaaatttgaactacaactttaagttcacaaaaaagctaaagagttttgccttggcgtgttaattttcctgcttgccagtgtccccacaagaatgcgacatttgtcatagctgatgtacctacaccgacacagcagtatcacccacgtctacagtttgcattgaggttaatcttgatgttctagtggtttgggcaaaggtaaacattatttataccaaatagtaatatttgtattacttttactatgatttaaaaaattctttatagacctacaggataggcctatatatatatatatatatatatatatatatatgcctcagtgggtaaatattgtcttaaagtcaacaactttgatgtcagagagtgacatggtaaaaggaaagaaccatttctgagacgctgacctctgacttcaacacaaaggccatggtatcacccacctgcccaccaaggaaaaggtgtttgtttttccttctgagatttggtcttgctatgtagccaaggatctggcttgagctcagggtcagtcattggggttccagcctccacgcccagctcccactgagtgtgggagtagtttcatatagtttctcaggcttttacctattacactccctatgaagacgtcaagatggtttcactttcattcacaccagactctgaagggacctctgccctcttgttctgactcttcaggttcttctgccactccagtcctgggggtccctggggaggagactcctcaagaaatgaagtaaactgattaatcatgtctcagaaaagcagttaggcggctcctcagaagagatccacattgatgttgtgtgcttgctcataaagtcaaatttagagctaataattgtgaaacactaatacaaccaaagctctttgtttgccgtcacagagctcctcatgaatagggtcttatattgttttgtttgcaatccccttgatagatttgccaaaattggacccttgaggactgacagaattataccctgtgttctgcactcagttccactccaggctgtttccagagggagcagtgtttcctcatcccagagcaatggcagctgtggcaggaacaaagtcactagtaggccacaggaaatcaactggttctcaaggaaacaaaactctgcttttcatctcacatcacccatacaaggcccaaggcccaatactttcgaaaaaactgctcttcagacactctccggggtgagagtagttgagatccagtgtgctaaaagcttgctggggtagcagacattacccagacaggccaggagtcccattacccatgcctcagacgtacaaattgggacatcctctttctagagagctgcaggtgctgttgaagtttcaattttctctctggcatttaaaccatatgaatttgtgtatgtgtgtgtcaaagaatagaaaattagttttaattgttacttatgaggcaccatatggctacactataattttggcatcccatggagctgcatgtgcatatggaaaatgaaattaattggaaatcacaccctgaaatctattattaagttaatatagctaacagcttgtggggtgtcctctcactcagcatgatgtaattgcacataataacaagtagttataagctcacataggaaacaggcctggatacacagaggtcaaagggacaggcttagaaaggaaaaacatcaataatggatgccacagcaaacattgaaattcctcactgtccacagacccaggaaacatggcgcagtttgttcatgcacaagtggattgatcagcattctttagacttgcacagcaaagggactaattttgttgttcaaagtagtgtggtgagctaagggcacgctcgctggaattagcaacagttattaaagtcagaggcatccagattagatgggcatcgaaatcctctgtatgactcttaaaggcctaatgagcccatttgtaatttttgaaattttgatttattactttggcatttctcaacaattacaattgcaaagacattggtattattgtattgttcaagcacgaagcctggaaaccactggcttaaattctgttagctctgtagcacatgaacctacagctggtgaacattggattttctgagtttgttttcagctttacgttagaataagataagttacagatataagtctagaggattgtttggtgaaatgataagcaatttatatcttgtatttattttaagaagtgtgtcaatttttagttctgcctctttgaatttgtttatcatagtgaccaggatgtggcgggaaataaaaccttcgtgtaatataaatttgaatgtgaaaggaggcaaaaggtattaattcataaatacagtcttcattagaaatgaggtataatctctatccattataaattgattataaatggctgtccactttatcatattagtagttattttcgaaactttaatttctggtaagttcataagtgtgtgtatgtgtgtgcatgtatgtgtgtgtgtgtgtgtgtgtgtgttcatgcacacacattccactaagtgcctattgcaagtcaaagggcagcttttgggagtttgtcctcttctttcactgtatgggtcttggcagcaaacactaaatgcattgggccatttctctggcattaatcatattaccaattcttaaagtgtcaatattagttaactgacttgctttgactaagtacctgacaaaatggaggaagggtttattttggattgcagttaaaggaaggctacagtttgtatggtggggaaagcatggtggtggcacgatgaagcaggaagtgctgtaagctgtaagtcttcgacccccatccatccctagtgaacagcttcctctggttgaggttctcactcttagggtttcacaaccttccacaattgcacggcccctggggattacatgttcaaacacatgctccagtggggaacattgtgctttggagtcacagcaacatcaccaacctattagactgtatgggattaaattgtgtagatttgacccaaggaaggaaactctttctcagttttatttgtccagtgaaaatgtggccatagtagaagctgtgcctccagatagatctaaaatcatagttgggagtggtttggagcaaatagcagtctagttacctgaaaacatttcttcagtagcaagaagcctgtctcttgtcctatgccagttttctttaacacgttgcaaccatgtagtgtgatcatttgctcacctatctcttctgactccagcctccacattcttgattatattacattcttggatgctgtcatgtaaatcactcaataggttcccttcccctaagggtgcatgcgttggtaccccagcaggtctgtttcatcatctcagagacactcctggcttcctcagcacccgagtcctcaaatgcctctccattctttaatgatagtctttggaccttcactaccgtggacctaattgtggacttgtgactaacttatagccagtgtgatttggtgtcattgtgactcaggagacacatgtggagggttctgatggttgtgggattatgacaccaaccctgggactctgtgtaacaaataagcttttattaaaaattttcaagttatcatttaaaaatgttgatcctttacctgctgaatttaatttaatactatacttttgggacaatataaaatgaaaataattccgagtttactaaggaaataaaattttaaaataggctagcaccaaatttgttaaagtaccctaagggtgttgaatttcatctctctaaatcacatggcaaaaccatagaagtatgaaatattgttattacatataaaggattctatggaatggtgttaagatccttagggaagaaaaaagtaagttctaaatgcctccaaagtaaaccagacaacttacgtacaatgtgatagacagttctgacttctgtctgctaaaaccaggtagaattcagcagacataggcagagctgtataacctgaatgagcccagggtatttcaaatcttctccgaagggggtctccatttatcttgtcaactgttaaaaataattttgggggccagagcaatggcttaattagttggtaaagtgcttgccacacaagtgtagggacttgagctcagttcttaggacccggaagaagctagcagtggcagccatgcacttgtatcccagtgctatctgctgctaattcaagaacagagaaagacctcgtcccagaagacacacacacacacacacacacacacacacacagagagagagagagattctgcaagaaacaaaaattgctcacctggctgagatgaagatgtttgtggttcatgaccttggctataacatgaaatgtgaagtgtgcccttacagcttttagccccaggagaatctaaaatttggtaaacagagggtcaatacttgttagtggttagtgacctgctacattggttttcttgtgggtttgcactgagaggatttggtccttcctccagtgactgggtagatagcagttctgctctctgtaccttgttgagtaattgacattactttgtgacttttatgttgaaggataaagtttttgacattgattataaatactattatagtgctttaaagttcacagaatcttttcagtttattaggtaattgcccatgcaacttagtactcacaaaggttttacttgtggtatcagacatttgaagcacttaaaagaaaatggatatactagatttataaatgctgttccagatgtttaagggaaattaaatccataagtggtactgattactgaagggagtttagtgtccaacttaggttgattgaaccttaatcaaaggctcccttgaaagtgaattaaaggtttaaatttagaagtaggacaccaagcattggaatgtgaactcagaggttatgaggggaaatggattttcatgtatttgttattttgttaaaagcaagttcattgaaagccatctgtaagttctgctttggagcaaagctaccccaagatcaccaaacacagggcatacataggacctggtcctggctgtagtggcagcaaagatggacccatggtaggtaagcttgcactcctggcagcctgcatatataagtagatgtctagtaacagcacgtgggcaaagtatggggtctgtcagtcgtcattcatgacctgctgttgcgggaagccaggcagattcacttgagacctccattgggtggcaagtgtgtaggaaagattgaggggcacccatcagcaggatcctcagtgtctttgccatttcagtgtcagcggtgacctggggacggaggtttctgagttatgtggttcctgggaggattagaagtgacattaggtacaccctgtattgattnnnnnnnnnnnnnnnnnnnncccaccgaccccttacagagaaagaaactgaggtttagggagctttggtggcatttccagctctcagagttaaactagaatatgtatttacagaatgtgatgcaagactgttggacacaaggctgtctctcacacacccatgctgaccactctctgctgtagaaaagccgcctttgccctgtagagttgctgtttggctccagtaccctggctggctactgccttttgcacattgaacacacagtacatgcagcaggtaaacatggtaaaggagtgggctttcatcttcttacagaatgtttctttctgtgtgtacctgagggtatatatgtatactgcatgcatttaggcctctaaggaggtcagaagacagtgttggatcctctggaactaaagttacaggcagttgtaagccacccaatctgaatgttgcgaaccaaacctgggcccttttcaagaagagcaagaagagtttttacctgctgagtcctatctccaaacttgaagaatgttccagggcttgcttttgctgtaatgtgggtgggaatcttaattcacagaatatttgccattgtcttagtgcctttaccgattgcttagataagataccctgaaatgagtacttaggagataaagggtttatttgtgctcacagttccttgttacagtcattcataccagggaagctaaggcagccagagtgtgacagtcaagagcaggaagcatcgcattggctctgctcttacatagctcagaaactccttccttgggaattgtgcccatgggcaggctttctcaccccactgtaatgaagataatcagccacagacatgcccacagaccagcctaacaaacctcactgcaattctctctcgggtcattctagatggttcaaggtaacagttaaaactaaccagaccagccatgcatgtagtaaagggcgtagtctgcccttgaacctttactatttggggattccatgatggagggatgagcacagcctattgtgtagcttaaaatgagcgattttgtggtttatgttattgctccttgtggtatctatttttttcgtttgttttcctacaaaataatagttttcatttttgtaccctcatacctgtatggcattatactttttaactgtctccctcaccctcaagcagtccctcctagcacatatgcttgaatacctttaaggttcctccttccctcttgttgttcatctcttttctactttgatgtcctgtatctttatctgtctgcctgtctcatctattttccatccacccatcctacactaatacatctattcatctatgtaaacctgcattgtacttgtaaaataaaatatacccatctttctgaatctgacctattttacttatagtgacctcaagttccatttacttttactttccattttgctgagtaaaattctatttggtctacttaccacattctccttatccattcactgagaaagcaaatcgatcaataaatgggcaatagaaccaaatagtgtgttctcaaggaagaaatatacatggccagtaaggatttgaaagactgttaacacccttagccattgaggaggtgtacattgaactaccattgaggttctatctctgcggtcagcatggctgttgtcaaggaaaggaacagacgcaggtgagaatacgagaagacaggatggaaatgtaacctggtatgaccctcagaggtcagtatggaaatcttcagattctcaaacggactgccacatgaccccgctgtacctttgaagaactccacagcacaccataaagatgcttgtgcatccacacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataacacataggtgtcttgcatattcttgacacttgcaaaatcagcatattattatataatctaatttgtagatttatttattacaaaaattatccagtggtcagtatgttcatcaccattaccatcatctgccatttacatgatacaggagataaaccagagtcaggataagcatcatcagaagaactgctcatgcatctctggtgtgcaagtactgtattggtcaacttcattttgtagcatctaaagtccaggctcttattcctgaccaaagtcagtgattcagctgcttactaagatatgcaagggagctctgatccaaagctataggccccataggcaagaacatttgcactccactctaatccttatggattataaagtagataatccactttctacctagaagggccataagagggatggaactatgtggtcacagaagttgaacaattctgcttggtgctgagactattgatgctaggcaccatctcatgagggcttgctactcctttttgtcgctcataagggatctggtggcttcaggcaaggtacccacaaagtacctgcatggaaagccccccccccctgatttttgccattgtagatacatgctccctggaccaaggatatcctgttggccttaaaacagcagtacagctgttgcattgtgtcttagggttttatggctgtgaagggacaacatgaccatagcaactctaataaaggaaaacatctaattggagctggcttacagtttcagaggttcagtccattatctttctggtggggagcatggcaacaggcaggcaaacttggtgctgaggagctgagggctctaaatatttattcccaggcagcaggagactattccacactgggggagcttgagcagtactagacctcctagcccacccccacagtgaagcacttcctccaacaaatccacatctactccaacaggggcatgcctcctaatattgccatgccccacatgagtctatggggtccatacctattcaaaccaccacaagtttaaagcaacagcgttttattcctgtctttgtcttttcctctacacccgtctgagataggaagaggtggtgctaagccagggatggttgcacggagtctctgcagctcaggaatctgagttgatctggcagacagtttttaaaatggtatttcttccttatttgagtgatttgtggcaaattttcactgcctgtggtggtattatggcgtgtggggctgtgtttaacagcgaccttctgccactaggttgagctagcactcatcttcagtatacatgtatacacataggtactggtgcttaatggtctgtgtctgagaccataacaagccttctctttttttctttccatctttcatttaaatctgaaaagtttttttccccctggttttaaatagtcattagtatgtaggtcatatcaaaactctaaagaagaagtaaaaatgacttgagccctggtaaatactgcagctctatgcttcctgtctttgagctttttagagtatctacagcagtgttttctaaagtttttgggacagtaatgcagtctagtttgtgatgcaaatatttctttggcttttatcttgtaaatactgtctggtgattttctttcataaaccctgtagggttagaaaaggtctgtagttctaaataggcttcaggcaggtgacagtgacttcaatggcacaggaaaacatttgtacagtcatttacatcactctatcacatatgcatcaggccaccgctgcaggcattgccccagcttttctgaacattgtgagtgtgctcaggagaattcattcctcattcaaagtggaagagcatatgatacctggataggcaagacttgaggaaacatggaaggccatctattgatgatagatcccattaagattgcaaaacatcactgcctgaaaaagtcatctctaaaggcattgattcctctatagtctaaaagttgtacatgttcgtagtttgttttttaatacttcttaaagtgatacttgcttgtcattgactgtgactgacttaagtttcaagcaggattctgtttaacagtcttggcatggaggcacccctgaattcgtgcctttttattaggtacccacagataaataggtcagccattagttttgtactaaggtgaagggtttgatatttttgtgacagcacagactcaagaagagggttaagatctttgtgactgtcagtgctactgttaatcccaccctccctcccttcctctctctctccctccctttactcccccatctctcctcctcccccttctccctgcctgtgttcatccctcttttcttctctcatccaagtcaatatttcatgtagtccacactggtctagaatttatagtcaaggatgactttgaactcctgttcttgccgcctctgctgcctcagtgtttagattacatgagctgctgtagtatttgggagcacgtgcagaacatgagaggacagcgttgttgtccctttccttcctttgaatggatactggggatcaaattcaagtcctcatgccccctttcaaatattctatcctgagagtccttttgtggtgcgttttcaggaatagtaaagtccttcttggtgggggcttggccttccagcatggcacattgaatgatagactgcagagctggctgttggactgtatttaaatttcacgtcttcctaaagaaactgagcagatactaaaccttgataactgatatctcattaaagattttaaaatttaaggacagctctcctggtttttcactttacttaaaaatgtgtgagaaaaaatgtgctatgatagatggagagagatgttataaagccaatgtatggaagtggagtagtgtaggcctctgtggtgagggtgtagataattctcaaaggagcagttgagctttctgtgcaattggaaactttctgttggcagggtcagtgtggagtctcagtcttcagatgctctgtgactgcattaagactcaggcacaagagtgttctttcttatgcagagattagccactgctggttagctgtggccccgagaaactcccttaacttcagttgggttgtttcacaggttaaatggagacagtgcatgtgcttactacagatcttattcctagggtgcctctaatagtggtgttaagtggaaagggatggactcattgtgtttaaccattggtaggctctaggatcacctaggaaacaaagttctgaacgtatctgtgagggagtttctaggttgggttaattaggctgggaaaacacaacttaaatctaggtggcactgctccatagattgaataaggaggaagctagctgagcaccagccatcctctctctgcttattgtctgtggatgcagggtgaacccgtgcctcacacccctactcctgtgccctccccacaactgcgagctgatatcaccgtgcaaaggacctcgccagcatgaatgaatggctgtagatagagggcccattgcacaccacactgtctcctttgctttgtttgtttgtttgtttgtttgctagtaagacaatcttcctctgcttggtgctgtgtgtgcccttacattagagattgcaaaccatgaactcgtaaagtacaaaccatgcggagttggagagtggttttattagggtaatttaggcctctcctccctatcccccaacttcctattactgtgacatcactgaaagactcgtctgtgtcctgaagtcagtgctaagttttaaacactggtttataaagattgatcctttgtggaaggaagaaaagagaaatctccttttgggggtgctatctgtcgttttgacagaaatcctaggagattgtcttagggcatcagaatcttctcttttccatgtgaaatcatgttcatggatcacgcagactgtcccacatcatgctgggaggcaaaacccttacagacacgaggcaaaacttgcctgttgttctgtggggggggcaggaagagggtcggggctgttgttcaatcttacttcccttctttaactctaccgtgaattatggtggcaatactttgggtgttagtgcttgttttcgtccatgagtgtttctgggttttgctgaggtcttgaatgtcacatagttatcatttctattaatgtatgtcatgagacatttgatctgtcaggtaatttgcataaaagactgcagagttttttctgaagagctgatgctgtcttcaggaccttcatgctttgtacatagacagaggttggtgactgtttcacgtctgtcgtccagcagtgcttggcagctccagctaagcttcagctgggtcagtgaggtcctcggtgttaggagattgtattctcttttctctagaaattatgttttctggtttactttgaataactatgagattactcatattaatttatatagaggaacaagactttatttttgagatgtatcttatactgaatggaagagtctttctagaggtgatttttatttagcattaaatttttatcatcagcaaggtattaatggttatgcaagcaacaaataatgtcagctctaaggcagaagagtatatgagcttaccaccacaatttggatgatacacacacacacacacacacacacacacacacacgcatacataatgaatcagtatgaaaaataagtgatttttaaaaactaattttgggagttctgtaaggaccaagatgaaaaatctttcccttgaaaacataagcatgttttgtgttaatattacattaagacctttataatcaataaactgctcaatgtagttttatcatgccctcatagtatctgagtgaaggggttgtttttcataatgtctaataagttggttatcacactcagtataaaattttagatttaagttacattaaactcattaagtatttctaaatgttcaccttggatagcttcctgtttgaatctcaaatccctgtcctagaaatgaaggcggtaaaccatcaaggtagggacacaggagtaggaggcaaagaagggaataagtgggtgaacttatatattagaaaggcatcacatgcttgcataaactatcccagtgaaacttgttactttgtattattaatatctgcgggatgcagccgcatgggccaagatggttactgccttgcccgagcatgcgcagtgaggctgcatgcatgggctgcctgccagatccggacctgtcagcctatcggtgacgacctgagcttgtgcctggagcgtgtgtgaattctgattggatgaggtggggtggtgctagatgaggtcagtctgtgtgagtataggagttttgttgtttagcccttgccctaagtagaagctagtagtagtaagagaagctgttgtaaggggactagaagtagaagcagctgctgtggaagagagctataaaggaaaaagccacaagtaaagaagctgttgcgtgaaccctacttggtgttgttcttgtctccatgggcaacgaggactgcagagaccaggacaaatatccactaacaacagtgtacatttacatctgtaacaaaacctgtcttacagactgtcctatcttttgctcccatttaaacttgctatttcaggcatgtgtggttaaagtctgatggtttgctgtttggtgggaggctgagaatccatctcaagaaaacgatgtggacagttttgaggtggttgattctcgagtgtcctggctcactgttgatgggctgtgtcagatatgattaacattggaataaggatgctagtgggcatacagaaagttgtcacagtgtcttgttcttcacatgacctacttacaacctgtagagttacatatcacagtacagaaagtattacagtaatgactgtggattgatgactctcacttttactctttggaatccttaggcctaatgaaaacagctcaactcctctgggaacttgatacttaagccttaaacttaacaacttctctttttaggttcttaataaaaaattcatctttccatgataactttcaacttgtttcttgccttctgttgtcccttctccttgccatctggcagtagggagatctacagtgctgggatagatcccagcagcatcaggtaggattctgtgaagcctgctgagaggtgatccccacacagaagttagacagcactctacactgaaaggttggatgttcccattatgctccagttggcgagccatggaaattagacttctcttaacaagtccagtgctatgggctgatataggtgcttggagtaacactgtatgggctgcatttgacacagggctgtgttttaaaagagacaacctgcaataaaactcagtttggtagtgcaagttcttaatgccagccaactgtgtttaaaaaaatggttcaaaataacatattctcaggcaatctttttgttaattcattcattcatttttgagacaggatcttactatatagctttgggactcattttacagacctggctggtctcaaactcacaaagatctgccctgcctctgcctctcaagtgctaagattaatggtatgtaccaatatgcctggctctcaaatattcttgacaaacatttttattgtgggtgtgagctgtctcatgaacattattttatataaatttgttttcagaatgccacctctgaagagcaaagtgagccatttttataaaacatgcctaataaaaacatgtcttatttatttcgagtgttttttttttcttaatgattttaactttttcatttatatttaacagtgcttccaagagcattcactttgtagaatgagacttgggggaccataaacctggtacaaaaatgtattatcagaataaatcaaaataacacttacagtcaaaatagaggtaacattttcagccagcagagtaatgcaagaccatagtaggacttcctaagcaattctatataacgttctctaagtttggagattatttgagaattttatatgtatctctaggttgactatgtctaatatggctttttccccatctgtatataaaaatcacaataaagtgatttctatcaaactgcgttttatgaccagaaacttactgggataggaataaaatccagtgggcacattgcttgctgaggtcaccacacataacctttaggagtaaagatgatccacgtgggccaactgcagtctaatcctatggctattaatgtatgtatgcagtctgcttctgcagacagtttcctgcttcttacactgtggttgagtaaactcatccagattacgtgagctgtacatgtgggctcctctgtaattctggtcggtaccagacaggaggcaatattcagaaaaccagatttgtctgcgcttttacttttggaaaattagattttacaatgaaaggaaagaatgtcagtaagtgaaatgaacttggtaactactgaaggaagagactggtgtcctttgagtagcatttggccccttaccatgcatttgagtaagtactagttgaattaaaccccttcttgagtctccctcaagacgtgaatctaatgtactactagaggcagctcagttcccatactcagtatttacttattttaatgaacatatttctgactggtatacaagttgtgggaaatagcagactgagtagactcccttttccgtttgtctatttgcactgacttggaggtggagctctcagaatggctcagtggcagagcacatccttagcctgggctaggatgggtcaatccctggattctatctgtgacactccaaaacaaaacaaacccaagtattagtgtcctgatatgtggcttcagttaccaaaatggttgcatgacttatcaccagggtggcatggaaacctctgacacgaggacggagagtgacaggccagttgataaattccatcaaggttacagccatttctgggtcttggaggttgatgactagaactgctttaatcagcctttggggtgccacttatcagtagccagttaggggtgctgcctggcactccagttgtgctgttgaaaagccgagagggaagagcgtctctcctgagcaacaagggcattgaagatgataatgacagtggggtaccctgaggctctaaagaatgtgaaggggctgtaattacaccgttgagcagacagcaaaacagtattttctctccttgaagtcttcagaagacaaataggaaacatctttccctaccatttttggcagtcactgagagtaatcgttccggtgatagccctcatactttgtgaatacaccagccatggaggtcatcacttcaggtcctctaccgagttttgtcttcatgctgttctagcactgtgtgcttcttttcagacaggcatcttcttccatccttttgtgtacctctacaagagttttgtttgcttattgtcttacagcgttgatatgaaacacagggcttgctctcctactgaggcgcgtgcacccctagccctagagttgggcatcttagtccaggtttctgtcagtgcagtatcactgtgtatggactggctgctgtcccgtgcagtagcctaatgaacagtgagttaacttggctcagccgctcttctggggagttctgagagtgagcagcgaccatagcttgtttgtacccagcttatgggtggccaccttgttttaagtcagggatcggctgctgatgtgatggttcctgttgatggcagaagcaagagtcaaaggcgtgacagggctgtgttccaagaaggagctgtgctttggctgagccttgtctgtgggaggaaaggtttatgtgagagacaggagtccagcagggaaagcagcaaatgagccctgcagctgcagcctctgcacgggctggctgatcactgaccctatgccttcagagtgctctgtctcgttatagctccctagaacaaaaccttggtggatctttgaccttcagtctttgcctgattgactgtgagcatcaatggcaatgactcctaaactgaagcagccaagaatgcaacatgaactttggcagttatttttaaagcttttatccatttgtttgaatgcttagagtgcgtgtgcgtgcgtgggagtgcagcagggtgtggacttgatgctgggtgttttccccagttagtccccatcagttcccttgatgagcctggagctcactgatttagagaggctggccagctcctgcactccagggacttcctgtctttacttccccatcactgggataataagcttgtgccattgcccttacttggatgctggggatcagaactcaggtccttaggcttacagagcaaacgctttaactactgagccacctccctctcagcgtgctctcctctgatccttaaaacaatcctgactgttgtttcaagtaataagctgagtctcagaggcctatggttaacatcacctatctgagcaaggaacaccatggtagcctaatggaagatgattcaattctctgatttaaataaaggtgacacacaaacacaaggccagctgtggcctgagatgcatggcatgtgcatttgtttgtttgtttgttttaacgcatttgatttggagcattcctcctgcccccaaatcgggaaagggagctcttgcttgctaaagaccccatttatcagtaggtgacttctcaccccacttctctgccaggcctatagacacacttgagtttataactctggtctgaaaggtcgggagcagggagtttattctttctttgcatgagctgagaaacaaatattcccaaacccttttcccctaggagatttttttcattttgccaatactttatgaaaaatattgcttgcttttagttttaattcatttccttctttcttggccatccctgtcaatatatagaacaactactcagaaaactgttagtttccaggaatccagttattaaagtcagcctttgtgtcttgtctgtaaaccctttccgtacccagtcccatctccctctgacatctcaaagctcacagttagatcctctgccacatgggagtgtcatgacacagtacaagttgtactgtgtccctagctttatctagcacactcagaagacaagggaactcgagcctggctttctccataggtgtgactatctgggctctacactggtggatgtatttgactgtcctctgtaaacaagcttttttagttattttgaagtttctcattgtcttcattttgaaagttgatttaggagcttttagtaaagttgtgtggaagtgaagtcctatactattatttctttttttcctacccctttaaagaagagatgaaataaggaaaggatttcaaacaattactgtctggatttttctttttcagatgcaaaagaaattgttttaaaagcccagatcttagctggaggaagaggaaaaggtgtcttcaatagcggtttgaaaggaggtgttcatttaacaaaagagtaagtctgaatggtttagggcccatcctgatcctgactgaaagggttcttgagggtctagggctggggccagtgtgtggtaccgagaggaaagggaagctctggcaggtggcctttcccccagagcctcctctcattagagggttttataccccgcactgaggaagattacacttcccctctcccagacaatctgtgatacatcctaagagtgggaaataacactgcttgcaactgtaataccatttccatcatctcatttccatgaaaaatattatgtggttcctgtgaccagtggcgtctttgtggcgcctggtctgatagtttatgcttgcctgtatctgaacatctttccagcatcttgcagcctttcctttctccccatcacagtcttttcattgattgtggtccctgttttccctctcattgtttactgtttcccagatcatccattatcagtttctatataagtctcttatgcatccagtattgtttctttatatattagtttggtgagggaaggggtgtgaagcagagttcagcattccttcattcattcactcattccttcatttgtatttggctttcagtgacatgcaggctgtaaatggaaagatatgcattccctgggtaatggggggatgtaggctagaggtggactctggacagtgtggatctgaggaggtggggtggtaatcctgcacagtagggatgtgaggaggtggggtgataatcctgcacagtagggatgtgaggaggtggggtggtgcagtagtacctgggcagtgtggtgtgaagagttaggatggtnnnnnnnnnnnnnnnnnnnntgaaccctgctgtatcatgatttgcaatttgccctaattgttttttgttatcccctcttttttatccctcctagccctaaagtagtgggagagttggctcaacagatgattggttataatctagcaacgaaacaaactccaaaagaaggtgtgaaagttaacaaggtaatgtggctattcttagtcatttcgaatgcacttaaaacaaaagaacagaggctagactctactttgaccgattctcatgaaacactgttctttgacaacatactggttttgtttagggagtgctgtgtcttggaagaaagacctgaaggactgtgtacattggccgttcaccaaaacccagtgaggtgaatgaccagagcagcagttttccattcaaagcacagatgcagtctgcttggagctgacagggcttggcagggcagccttgcactctctaagcctcttgctttcccatgtagcctcatcctcagtcctttctagtagaagtgccttttgtagtggtttgtcttaaaactacctcatgctctacttttaagccactcacggctatatgtgtattattagtgaagactgcttgtagtaagcatgtatgccatgtgtacccatgtgcatgcatccatatggcacctagacatacatatgaagaggaggtaatggcctgcctctggtgtgcagagaaaaatggcctgcctctgctgtgcaattgtgaatgcaggatccaaatccaggccctgcctttccctcctgcctgttttcagccttttgttcctgtcttcatgtgtgaatcagccgaagctgtctgttgtgtataccacagtgcaaggtgatgaccatgcagagactcatgtacacaagtgtaagacctgtgtagcagactgtgaactcgtgagcagagccctttgagtgccacatggcaaccctgaagacagtatggctggaaaggggcagcctaactgggccccattttttggccctgctctgttgccatagcatcagagacttgcagcctctatcttgtgctctgctagggggttattcagtggtacagtctacttttagttttcttagaactttagaaagttgttgacataaccttagaaagcgtgtccttcgtaagtcatggtagacttaatcctagccaaactagggcacagaaaaacagaagataccctgaggaggagactcttctgtcctttgtgcctcccaggctattgagaaagggcaccctaggaacttgaaatctcctcaggaatgtcatgctgggaaaagggaaaggccacagcttgctgctgggctggggaggagctggtctgccaggaaggtccacacagttctgagaacccgctagagcacgctgcagaagtgccttgatgtcatagctactcacacctcttgctctaaactcatgtcagaacccaaaagatggccttgtgctgtcactggatctccatgttcctcttcccagtgtgacacattgaatggaacatcttctgcttctcactgttgtttgtttaactggcctgttgagtctccgtgctgagcctagcttgttaggaccaccagtgccctggatcatcataacatggctctagtaacagtaggacattgggatactgctaggtattagtgtcatctactgaaacgccaagccatctcagatgctaaggagtacacccaaaagctgagtgttggtcggtctggcgcatgcaggctctgtcagactcagggttgattggttcctgttcagaccggaactctacttttacttcctttacatctgatgatgagcagtcacgtgcataacttactcagaatttgtccatagatagcataattagcactgtgtttgtagagaattgctattttattggacacatgtaactgtagattagaatttgtgaaacttttaaaaagcatataaaagtgtctactcaaagcagattcacagtacatagtaataaaattctacagaaaagtggcttgtagctcagtccctgactcgccggagataagcatgttcttgagaatcgaggcatcaccagaaaaaaataaaaaacagagtcatttatttttaagtctatttttactgtaattcaagaacaagtaacaattccaatagaataagagtcagaatgaaagaattaggcactcccagcttggaaggagctgccgtgctctttgtcctcttctgacgcccaggctgtgtcccatctctgtgacagcgctcatgtgtccaggctgtgtcccgtctctgtgacagcgctcatgtgttagtgctgctgttctgcttcctctcttgggattgggtttttgagataagctttcttgtagcccaggctagctgcaaatttgctgtgcagcaagagatggcctgtacttgtgattctcctccagagcaggctgagcaatggactgcagagttacacctttccccaagtcacagcacctggtgatgtgtccttatcattgtcttcatcgttgtcgtcatcctcctcctcatcctcctctccttcctcctcctcctcttcttttttgctagaaggataacttgtagtcactgagagtaattagtatttaaccagcacatttatcatatacatttgttttaagtgtttcatagacagtgtgacagtgaagattcagaatatcctgactttaggaaaggctggaggcttcatacctgactgttcctttcattttctttttctttttggctgtcctgggactcactctgtagaccaggctggctttgaacgcagaaatccgcctgcctctgcgtcccaagagctgggattaaaggtgtgcaccactagtgcctgacatgttcctttcattttcaagacaggcatctggagaatccattgatggccccagatatagtgacagcagggccctgctttcccctttccaggatatgtagtactcactgcattgtctcccttgagctgggttgagttcagggattaaagtcatcagacagtgtccttcgggcttttcgctagagccaggatacagaatatattgtgtgtagtcttcctgcgtttgagaacctgcatagattgatattgacactgagatgctcccaggccccacatgtggtgctgagttccctgatatcaacaacggtgtttcttgcagattctcttcgtccttttgcttttgtgtttagtgatgtttcagcttttcctggcccatgcctcaggttgttagtagcgtgctaagtaggagtgttataatttaaataaattaatatatacctaaatgctttggtaatagaaaatgttgaatgctgtgactaccacaacctgggtgtgctcaccatctagagaagagaaagtctaagtaaagtctctctcagattttatctttggtgaggagagggtcagatttccattgtgtttctgtatagttggaaggccaagggagctctgagttcccctttaaaaaggcacaaaccccactcctacggtctttaccatactgatgttttcctctcaaggacctgcctttaaatagcatctcagtggaaatgagggtacagcacatgaatgttgagggacataaacctttctagaaatgttgtagaaattaaattatacactgtaacctttgagaatcggcttttttccagtgatttatggagattgtatcctttcattgttatataatactctgtaatatgcatgttccttaactcatcatatattaatatctccattgttttaagctgccctttacacatcaaagcattctatacatttatgaacagattttggtgtagatagttctttatttgggggataaattttgagttatgtgtagttgtatgatcagctgattttgttttattttgttttagaaactgtcaaatatttggcagtgccagctgtgatgtgcagtgactggggctctccacattctagccaacatttggtagtcattgcttaaaatttttagccagttttgtaaatatgcagtgctatttctctctaatttaaaatttcacagcccttgaagctacagatccagacttcatttgctcatttgtcatttgtaggctgtccctgaaggctgcgcttgctgtcattacattaagagggaccgggggtcacagctgcacactcctcagcagggaccatgcttttccgtgaaaggctgaagggctcagcttcgaactgttgcatgtgtgctgtgtcagcaggttctgttgctgtgatttgcatcatcatcttagtggaggagagcttcatggggaataaaaatatttagttttgatgaagctcaaaatatctctgctcttttgtggactgggctcttggtacattctaagaacaaggttttctattaagattgtagtggtttttctttttcttctgtgtgtgttggtttccagtaacttttgattaaggtggcagccttaggccctggtttgtgtttttccctgtggatgttcacttgtgtgtttacccctttaaagagctgtggttttcctttgttgtattgcttttgtgccattgtcagaagttagctggctgtattcatggagtcccctgctactgccacttaattgctgtagcatccggtacgttttacactgtggacactgcttttctcatttcattcctttttttctcagtgtgctgtatcctgttcttgtaccttatcagatgcttcttaaaataatattgccttagttgatagaaaaacatctcttgctgaactttcaatagaaattgtgttaaactgctatattagtttggggaaagtcagtgtttgctatgttagacctcagtgtccagtaagaaagtggacactgttcttagctctgccttgatttctgctctcacagttacatactactcagaatatagggtggagatatttatatatttttagatttccacctaatgttttctcccttttttcagtagcagttattacagggattggagttttattttcccatattcatttaattttacatgtacaacaagtttgttgttgacggtattacttcctgctgatgcttggtagatgtctgcagagaaccctgtggtccagagactccctctcccgtgcttgtcggcattcctgggttactggttcctgcagttactggttcctgcagcatccagcctgatttacacggtggagctcagcatggtgtgcttcccttagtctcagcttcccaacactgctttctccttttaagttttcccattcttcctgttttctgttgacttaaagttttatttgaatgtagtggaggagtaagcaaaaagtgtcaattccatattctcaagagctaggctacaggcttatagaaattttcaaattcttaagcgtattagaggtgctatttaatgtatacatatgtacacacatatagacatatatcaggcatttttgtctgactctgtgccattgcgttacatgttgctcaggagaggagtgggtgtgaggcagcactccgcagagatccacaagcactgtcatcactaccagctactgctctgtaggcaatagaaaattggatggtttcatagaatcttaactctctgccgttaggtcatgagtagtttgcacattgctattcaacttagacttaaaatttgaataacaggatatgagggagggaggagaaacttaagatattttgaatacacaagcagctcaaatgtgctctacacaaagttaactgaacttttcattcttgtgatcacaggtgatggttgctgaagccctggatatttctagagaaacatacttggccattctaatggaccggtcccataatggccctgtgatagtgggcagtcctcaggggggcgttgatattgaggaagtggcagcttccagtccagaactcatctttaaggtatgtttgattagctggccatgtaactgatttttttaaaaaaattttttattacgtattttcctcaattacatttccaatgctatcccaaaaagtcccccacaccctccccccctactcccctacccatccattcctattttttggccctgacgttctagtgtagtgactgctcaacatttgttgtggagtctgaggcagggagcactggacctattgcggagctgtgaggtgaagatgttgaatctcgtcaggcagaattgaagtgtctagtattctttcccttctcttctcttctcttctcttctcttctcttctcttctcttctcttctcttctcttctcttctcttctctttcctactttttctttctgcatcatttttttctatctagtctgacctaagaattagccaacagggtagactcctgtcttaaacagtggttatggtctagacactttgtcttgtgggcctgggtgtgggttagtctgtgtattagttagcttgctgtgaccaactcctgtcaaagtaacttaaggaatagtttattgtggcccatagtttgagggtacagtccatcatggcaggaaaggcagggcagcaggagccggaggcagccggtcacatcgtgttgggaagcagagggagatggctgctggtgctgccgcactttctcctttttgaccagactgagatgatgatgcctcccactctgagggtgagactttgctctccagttttcttagtgcagtcacttcctcacagacataccagagacttttgcgacccaggccccatcaagtcgatactaaacttcacagactgtccagagaagaacaggcattcagacgttcgtattttgatctgttgtttctgtccttgaaagcttcagactaagatcagtttcagagagatgagtagtcagattcaagtagggagtaagtctgtcacaagcctttagcctcagtttaaaaaataacatacgactaccttggtttttatcctgtagcatcataaggattaagtggattgataggaaaagaaatgatcagttaacattctcatctatagcagaaaaaaacccatttggaatagtaaacccagtttttaatcttggttcttaatgcccaatttctttagagttttctacaggaaacattatttcctttagaaagtgttttgtttcccgttaagtaggggaagaatcctattttctgaatctggttttcaatagactgtactaacacttcaatgattgttctaaaaatagtcccatcagaattacatagattaactgctttggaagtttaattgaagctttatacacaggcttactcataatgtctagccatttccaaaattaactttatctcaaacagtctcatttgctatcataattcatgaactaatacacatgaatagcattcattgttttttgacagaagatcactttgtagagtgaaagtattattaataattttcaaatgaataaagtgttcaagtcttaagataatatttaacctgtgtgtgacaactccaaacttaacagcagtattaggcaccaaagcctttttttggatgccttccaaaagatgtcacaaaaattaactgactaaatattcatcaatgccatctgtgtagtaattaaaagtgaaaactggcattagatcgtcttgtcagcatgccaccttgaagaattatatagtttttggaagagctgtttcatgatggcctgctaattaaaacgtgccccataggcagccgcagtagcctcgcttggagtcggtggaagggtgccacactttaattacttacttgccagaaagtactttaaatcttcgctttcaggtttaaatcttcttgctggacttctgaattttgttcatttcatatattttcactaggagcagattgacatctttgaagggataaaggatagccaggcccagcgcatggcagaaaatctgggcttccttgggtctctgaaaaaccaggtacaaaacctttgggagacagcatgtttgccttgtttcaggaaatattgcagggacttgtttaattgctgctgatgtttgtgactgacacaagatggttgtgtctgaaactttcgataaattctttatgatcaagaaactattttctcctgttgcaagaggtgatgtatgtatatgtatctgatcgaaatggtttgtgtgtgtgtgtgtgtgtgtgtgtgtgtgtaaatgtctgtgtatatggtgtaaatgtgtgtgtgtatgcagatatattatagagatgtgtatcagtatgagaaagagttgtatacatatatatgtatatgtgtatatattatatatatatatatgatagcgtgtgcttatagttttatgatgtgtgtatgattacatgcatacaatgtgtgtgcatgcatacatatttatgtgagaagtatctatgcatacatatatatgagggaatttatatgtttgtgtgctgcaggtttataatgcatatgtatatatgtatatgtatgtgtgtgtgtatttgtgattgtgtatgtatgtgaaaatatgatacaagtgtgccctgtaaatcgatgatatgtatatgatcagatatacatgtatataatagaggtctgtatgtttgctgcatgtagttcatgaactccatgctgtttggtgatatttgttactgtggttttgagacagggtctcatgtatctcaggctggttttaaacttctgacctcttggtgctgcctcctaggccttgggattacaggcatgcacctggcaccttggagaggtgatcctggggatctaactcggggctccgagcgtgctaggcaagtactctgctcactaagctgctgccccagccctctctctgactgatgggcttttaatgtttccttacagtactgctggtgctgcttggcacatgcacactcattaccttaagaatttacttccagcatctgtataatggagagagtgactactaactgagaggtgtattgtagggtttgagttgagtgctgtatagagcagttattcacagtgctgcaagacccccgacttactcctaagccccacaagcaagcaagattatcactgtatttattaacagtgcaccttacttaaccagttgctattcttttgcagccaatgggcatttgaaatgttattgatggcatgaaggcaaggttgttcactcagaacaaccaaaaatatattaatttaatagtcatatctttttggtttgaggatggaacagtggtactccgagctttggtggggcagaatttgtcatgaatatccagggtctgcctttgttccaatccatgacaggtgacaatgtgtggaaacaggcgagcttcttcccacagctaagtcagaagaatttcctgccccttcctgccctctccctcctccttaactacaagaggcttctttagtatatgtgtattcattggcatgggcctgcccaatgggtaaataataagttgctccacagtgcccagggaggattgtcttcaggaccccgtaagatacagcaatctaattcatcctcaagtcccttctagagaatggcttagtatttgcttagaacctacatacttctctcccaggtgttttataatttgggaataatgacaagaaaataagatctaggtggttggacagttgcaatagtcatttagaatattttccttagtattctatttgtttgtatatgtgccacggtgagcatgatcagaggacaacttgctggagtcatttctctttccaccatgtggaaagaaaggccatgtgggtctagggattgaactaaagtcatcaggtccaacagtaaggatctttgccgctgtgtcatctcaccagccttacaatatttcccttctgtggttaggttaacgcttgggcatgagacctgcagatagaaatggcacttccctgagcttagttgaacattcttgttccaatgcaacagtgatttttgcatcatctccagaattgtcactggtaatgtgggcaagtaaaggaagggtgcagtggggcgaaacattagatgtgttcaggggaagaaaaggcaccgctcatttgaaaatcaaattaaagactgttgaaaagtaaaggactcaaggtagtagaagacatcaggacctcctggactatgtcctaggaagagacaactaagtgtcccctctgagaccggaagactgctacgaaggcagtttgttcaaaggaaggtgctagatgagtcttgggctctgtgctgtagtgattagtttcatgttattagactgagggctgttaacaatatataaaacattttaaaagatgtatttaaagactgcttatatagagaaattggtccctgaagccatttggtcccatgtttcattccaagtttattcaatcacctgtgcacatcctctgtatccgcacatgtgtgttctgtcgtggactggactcagtcggtccctcaacccatggggaaccagggccccagtatgcaggtgggcaagaagtcagtgtaaagtgacagacactgacacagagagagtgctgtatctgaatgtaatttctcaaagcaaacatcagacttacagtatagaagagaacaaaaagttaggtgacatatcagccaaggtacattgaagttatttgacataaaacagaaatgcatacataaagactgacaggaaccaggcagtgtttacaactgagataagatcagtcctatctaaagtcagatattgacagaagccaggtaaaagggctaatatgcctaggtgcaattctggtgtattgtataacccagcaccagggggtttccactcttgctaaccttttcatgaataatacaatactttagttcctccttaaaccataaccctccttctttctactactatgtaatgtaggctgccattcatgtttgtaatgagaattctaagtttactattttgaactagccctgagatttctagctcctatccagtaaaatactgcaagagagcatgcaagaccttccacactattacagggacaaatctggttatggggcaccagagactctccaggagacaagtttccatgaaactttttgtctcaggactgcggccaagcttttgggcttgccatgcagactccactggagtgggtgtgtcatgtttctcccatttgtcgatagtcatccttgttagaaccctaatccccattacatcgtaccttgcttactcctctgttggcacagctcacagtaatagcatacagataacatatacaggtaacatacatttggcatgagcaagactaagtaaatcacatatgtaggctgtctacattgaatgcttctaggaattaacagtagctgtcataatgtggcagcagaaaaaaacccagagtgggcaaatctgttgacccatggttggaaagcttagcttctgaacacagtataaagctctacagatgataataagaatattaaatatatcctaaaatacccttgctacctccatatgtgagagaaaattaagggttatttgtaattcttaaatgacataattatacttcgccagtttctgaatgtgatatgtcgtagtcagtaaggagcctgggttaccaggatatttttatgtttttaagttatcaaggaaagaaaagaaagaataaaacctttgagacagggtcatagctgtcactgggggccgacatctttgtgggtttgactctttatttgcccattgagcaggcactgattgtatgttacttccttttcttggctgtttccaaagtaccaaaagatagccattgttctcttgggatttgtggactcgtggccatcattcccaggnnnnnnnnnnnnnnnnnnnncaatttaggtcactgatcctatcatgaagagatgatcctagaaactgaaggagcacttggacatctggcaatggctgccttggtaaaatctgtattctctgaattttaccacagttttttgaaatggttgtatttgatcttacttatgaaccaaagttatttccattacttactttgttcttattgataaattactcattaaataatttattaacttcaatatagaagtaactggcacagggtgtgggtaagtagggcctttccacatgcctgcacacagctgtactgccgtacatggagtcacatgtatatgttcccagatccctgagaggctgagtcatgaacccctgagattatggatacaaggccaagcccagcaacataacagggtccaacctcagaaacaaagatccaacctcaaagatactgctgcatgctgcacagcttagtcctaggcactcagacacacatgtgggacaacagggttgggtgagctgtgctccctcagactcacatcaagaaggcccaaagcctagcatcaccccagaaatgcagggagttgactgtatggcccagggaggaggagttagcttgcctctgaatgggagaatgctgtaggagagcagtctgtggctgtaaacatccccgaggaagctggaatggtgggggaagtgtgcagctatactctggcagcatagctcatggaccaaagataggctgtgccatttcacatgagaatgaggctctgtggtccttgacgtggctttgcccatgcacttgtggtttcgtctggtcctcagatatcagaatttgtgggtgactggctttgtaatttaatatagtttagttggcttttaaaagtatcaacactgaaagcaagaaacaataaagtaaactagaaatattgctagagatcttttaaagtacttccaaaatgattctgaccttttgaaagtctgcaaacccagaagccatgcgacatgagtggtgtgattgtccttagatttccctgcagcaggaggaacacaaacatggttgaaagatgaatgtatttgcagtttttatggaataaagagcaaattttattcacataaaaagacttactttaaattaatgattaaaaaaacctatatctcaacagaaacgtttacaaaattcacagaaaagaaaatacaactgtgtcttaggagctagaatgatgcttaaactcattcattgtatgggatttttgttaaaactacaaatacccgctgtccctcacagtgcccggcatgatgcagatggtggatgggtgtgagtggagtcttcctgcactggcttctggtcattcagggtagcttctcttctttaaatagactcgttcatatttaaaatgctttcagggctgaggggagagcatgaggtactatggccaatcctaagaagccatgctgaggaaagcaccctggccttgtttcctacgctgtgatcccagtgccatggaggtggagacacgtgcatgtgtacatcttgctcactgctcagccaagatatgcaagctccaggccagtgagagaacctgtctcaagaaccccccaaatgggcatttcagaggaacgatatcccaggcttctacagattatttatatatatatcatcctagtcatgtacaaacacatgcacatacagccacactcatgcaaatagtatgcacataaccatatatacatacaacaaataataagtaaaatgtttacatccattctgcactgctatggggtttaccccataaatgcttagtcacatgtattacatatctacagagacaagaaagatgacattttaagtaaatgaagctattagaaacaatccatatggtcattatttaggtgataaatataatgaatgatagtatagcatgcaataaaatatgatctcacaattaaagcagtggcctatttctcctgcccgtgaaggtttctattaataaggatagaggcttttgttgttctgtgaagatgggaagtgtgcatcttagtgtgtacataagaatgtgtctcaggcaaatccaaagtcatcagcatctgtgtcagaggacctggaagctgtgactgggaaatagaatcttgagcaaccctgacaaatggggagccttatagcgtttatatgtgctacctagccataaaatatttcagagtaaaaagaatttgtcttgttctagtataatagcaaatgatggcagtcctactgcccagggtgggtgaggcagaaaggtcacaagcttgaggccaatcaaggctgcataacaacttgagggttagtctggaaacttcctggaacctgacctcaagatgcacatacatacatacatacatacatacatacatacatacatacatacattcatacatatgccttacactttggatgcatttctttatttttgtacataagatttcaactaggatttaataaagtctacacatagacctgaactagttaagattcaaatagtatgagagctttaaagttgaagtgctttagtcaaacctgggctggctttcattattgacccagcctgaactcgtatttagggatttcattcgtaggtgttataaggacaaggagagttaagactgaaggagcagagaggtctcagcttctcccttcctttgccccatttcctcatctcctcaacccctcaaccaggcagagcttcaagccggctggctcagcaactctgaaactaatcctataggagtgaaatgctgttatgccagaaaggggcggggtcacactggctctgatggcacatactgcagggctggcatggtgggcgtcggtggcaacagggaagtaaaagaaggccaagaatgagttccacccttcatgcaactgtagttgctcacacttgtcagggtggactctcctggagagttgatgaggagcagcctgccctgggagaagcagtgattgtgtgttggctgagaaggcagcctgggtaatgttaggagacttgcatataaaagctctctgtggtctttgcctccaggactcactttgtgcagtggaggctgcatggttctgaggctgctctgttgtttgagaccttcatctttctgtctcttggtttccatcagacactcaggaatttctgtgcagattatagtcctggattgatgaatataataaccattttattcctgcataataaggaaaaccttgtcattataaaccctcaaaagcctgtttacctttttacttaaatgaagcctgtttgtattagtgattgtagcttatactgcagtctaacatgactaatagggacatgataattcacaaaaggattaatagcacttttaggctgcacagaaaatattttgttttcttgataatggtctctcttagtgtctggaggaaagttgagcagtctgttctaatgaatagcagtggaaattaaaataattatgttttacaatttttccctttagaaaacctaactgaaaataaagacataatttgctatttttaagatttcgttaatgaagcaaaataaactttgttgtattgcttgggtgtaattccatctcacttgatcatgcaggctgcagatcagattacaaagctgtaccatctcttcctgaagattgatgccactcaggtggaagtgaaccccttcggtgaaactccagaaggacaaggtaacagacagcagaagaaagaattgcaaatggacttttataattattcatagaaactgtaaagtaacttgcaaaataatctccaaaagctgcaccagctttgagttcatttctttaagtaatttaacttctgatcatttcacgcgctcccatgatggtattcaacatttgggtgtgctatactcaaatgccacgcctcccaaggagctacttcctgcttggcttcagctgccatgagtccgtgcatcagacaacagagccctcatttttcagcagtcactgctgatagaaggatttgagtgtgggtgggtatcactgtccttgggcttatagctgcacctcctttttctaaacttggtgatcttgaatttgcaaactgtgcacagttttacctcctgtcctgaacaggacgtctaccatcttgacgaagccactatcatcactctgtagttaacacacttgccttgttcgctttaggcaaaggagttgtttgaaggatgctttctcttgtagcaatattgtaccactgttgtatgcctcagcaaatgtcaccactgcaggatttcttgaatatgaatgaagatgtagacatagcaaaagcttggaacgtcttagagtagtcctgaggagtgggatggcagatagaatcattcaagccagaatgtaagtgccaagacttggactctttccatgtattgtgaccgccggctttgccattgagtaggaagaaggagctgaacagatgtgtacagagagcactgtcaagaccaggcatttttccttagtagaggctttgtaggcaaagtcagaaaacccaaaagactatctttggaactcagagacacctcaggacaaattcaaattctgcatctgtcatattcggactacacatctatacacattcctgcttaggcttcagattaaaaacaacaaaaacttttattagtattaataaaattgctaaaaatgatacccatattacagattgatgtattgagtcatacatccagagtgagatataaagtggagccttcccctatattcatgaaaggacattgctcttcttaactagtacaagagtttgccacgaaaaccagtgtccagctaatggcaagctctaaggaagttgctaaaatacagtattgcatggataaccaccaaattgtatctggactgagttttatatgcaaattgtgtttatttaaactttattttttaagattgatatgcctatgtgcctcagtgaatatataggccctgaggaggccaaaagtgctcgtccgttggttcctctagaactgagttacaggcatttgtgagcaacctcatatgggtattggaaaccatacttgggtcctctgtaagggcaacaattgttcttaacaactgggccttctctctagtttttaattagtttttaattgctatgattataaaaacattaaacttgtatatagtgaggaggcagacaagttgtgcctgtttttgaacttctatgccaggctctatgctagactttcacaagtagccctgcaaaagtaagagtcattattcccgtcattaagatcaggcatttaacctgactctcatggaaagctagatctgcaggatagaatggaaacccttgcctctctgctcagtgtgcaaggttgccctgccatgctgggctaagtagagcctgttttttctggttgttgttttaaaccagtagtttgcccttgttagcgtgacctagaagtggtctcaggttttgagagcacgagtcacattcacactgccttctcaagtactgcaggctgctactcaatgcatgatggttacttatctgaatttgctgtaaaggctctttaatatactgaggcaagcatggttgtgatgctcactgttcccagcggcaggagagtcatgtctttcagagcatcatggaccataatgcaagactatggctgaaaaaaagcaggaggttggcaggatagacccgtctgggaagtactttctttgcaggcaggaagagaggtttgttcatagaactcacactaaagacaaagcatccacgaggctcagtgggctacttgatgagttccagggtagtcagagactccggctccaaacatacgtggatgacacttaaggaatgaagcctgaggttatctctgacctctcggtgcatatgtgatcatgtgcatgcaggtgaacacacttacaagaccgggagaaaagacagcttcctctgaagtgggagacattttgctgtaggattattttattcacactgtagggacagggattatacaagggactcttcttggaaggtgttcacaaattttacaaaggctaaagtttgctttttaattaataagaacatgaaactttttaaaaaatacctttaaggaatcatcacaaaacacatcttgtatgtatggttcactaaagcagaagtcttacatagtatttttaagaccaaaattatctttagctattaatttgttcattgtaccgtaaaagtttggctattgagttataatcacaataaatgagagtgttggtttataactctaatgagcagtagacaaattaaacccaattaggaaatggtgattaatgatcagttgtgaaagttggctcttcatcactgccgtgtcctgcaaagcaggcctctatttaggagctataaatgcagtcatttagatctctgcaatgttgataatatttataatctctctgcttaaatcttttccatttaggtgactaacaaaacatttcacatgaaaacgttgatataattattgtcttgtaatttggaggcttaaacgctccaaaaattaaggatcacataaacgttttgacttaaaagctagccactgtgccatccatctctctgtgcgagacttagctccctgtctcattgcttatccgggaacatttttttttttaatttgctttattgtttatctacctttacagcatcctgttgatggcagtggccatcattaatatcaaagctgctgagtcgccagtgggaaagatgtggaagagtttcagcctaagaacattccttccaatgtggttaacagtctttattgagagggcaatttgacactgagttttattgtggtttaaggactcttttgaggattataatggttgctagtgacctatgaaagcctattaaccttgccttagcttttgtttaccagtggttaattctcttacacacttaacaggagttcaaggtgcagattgccccgtggtgtgtaaagaatgaggcttctctcttactgtctgtggagcccaaatctactccctgagccagctgacggaaggaaacagccctgctttctctggattgttctcacttgcccaggctctgtgctggcagcagagatggtacccagtgttgactgtactggtctagcagccatagacaacacttcatctggttctcattagccttggtttgtcacgaatccagcccaggccagtggttggtctgtgctcacatggtttaagagaaaggtcatttcctagtgaaaactagagcattaaagtgaagcatctctccaggaacgaatcagtctctgttgaaacaaaagtagatagttgcttcagtaagtaaagagaaagttaagtactttcttccccgattcatttgaactaacatcgattcagtaaatctgtaggcaagagaacatacacacacacacacacacacacacacacacagagacaaatagatacagatatagatatttatgtagctgaccgactatccacttattcatttattaaatctttttaatattgcagtattcaaaattttatttttccggcccacccagggattctgcaacaccttttattccttcttccctctccatttgtgatcacacgtgttacttttggtgtctttgaacaaagggtgaggtccttcccccaggagacatttgtcagaagtgttgcttttgccctctgcatggtgactgtagggaggactgccagctgccctacagtatgtagagtggtctccctcatgtgccagagaggcaaattcccactacaatttagctccaagcctacgtgcttccattcattgaactacacagtgagagctacttaaagcagtaaggctgggtgagccatagttaactgacataccaaattcctctctttcttccttaagattcccctaaataaccccctgttgctgcctgctcacagtgcccctgctgtgctgcggctgctgcctgccctctgtttcttcattatattcaaggctctgtttccatgatcacttttggtttttttacttcccctagcccatctcgcctcctatctagtttttcttcataggatctggcgaaaagttctaaacagtatacaactcttagaacatcaatattgaatggaaagcgggactccttttaaagcatcagcattttaaagccagcttggcaaggcgcatttgaatagcacattatggttacttatcacaaatcaaacacagcacattgcttcaagacagattattttccaaactaattatgacagtcgtacttcctgctgtttttctgttcctttatgtcttccatctgaagtgcatttttttcttttgtttaactcagctgcacgctcttgtgtgggagctctagggtcagaggcctcttgctgccagttctggtctccatcaaggcagctgaattagcagcttgcagcatctcacacactaaacaaaacaacacaaacagcctatgaatataagtaccttagctttctttgatatttgttcagaagtaaaattcatttgtataatctttcaaccatgtaacaatatgtttttgatggtggaaattgttttataaatattaataggcatgctttttctcctactttatacacagattggtgtttgttcaagatgaattttctgtagaattgaagtttcagttatgtgacactgaaattcttaatgtctcagctaagtgccattacctcagaaaacagattcccccccccgcgcccccccatagttgtgcgttgttgaattaagtgagaaagctagggtttgagcagatggggcaagttaattttcttgccctgatgttgacatagccatgcgcccacctgtggcccagcagctctgcatgtacaagcaggagtcatgcatgagtccatcagtgtgcgttgtttagtttgttctcattttcagtcttcctgatagcaggacatacttaagccaagggtgttcttgactaggtaagaatattatagctgtgggtgactaccaatctgttaaagcaagatagataagatagagttgtgtccaagtagggattgctacaaagtgtcagtcaacatatgggtggttgtaggctttgtggtctatactgcagttaccacctttgctattttcctgtgaagaagtccggacacatgtaaatgtgcacacacatgtacatagaaaaacaggtggtgagcttgagtgacataatttgacacctctgatgcagatggccatgtgaaactttttgtgtctttagccactgtggccatatgcaaatgtatggtacaatttgactattatcaaaagtctcacatcctttaactaaaacatttctgccctgacagttactctgttaaaagtgctagtcattaaaattcttgcttttgagaaagttcttaatgtatttaaacgatagctaatcaagtacctcagggagcctggacacagttaaatctccaatagacattcatttatatctcctttaaatagaagtttagggatattttgggaatgagacagactatagtaatttctagagatgaaaagcaggttctgtaaactgagctataatgatgggaaactacacatgcagaaagtaccatgttggtaatcatgctcccctgggaggctggctgccacacatagcttctccttcctccaacaccacacagtaccagcaactctgatcttgtttatagacaagggctctgagcttaagagaactgtgtggccagggctagctgcttagactacagcactatagctgtgtccttgaagtatgtgtagcaggcttctctcctaccagaccacttctgtgaccgtttctctgatggcagctaggtatcctactcttcagttctgttctgacactggatgcctataatgagagtcagagtcacatagtcagggtcctgtctcataagactgatgccctccattgatgccagtgacaacagtattggggaccacggttcacctgagtgttctcacgacctgctcttcagttgtggctcattgcattcagggaaacacttactacccgttgacagaagcaaaggacattttaaattatttccagggaagtccgagggctgtagagctctgtattaagaacagagctaaaatgccaagtattaaaaagaaagatccacccagtaggcccattgcttagaacgttacaagtgttttatgatctctgtgccaagaattggagttgaaaactgctgtctttatcacttgaaccccaccctacctcaccactcatttttttaactgcaaagccattttaaaggctctggctctggggacttttgggacatgggacatagctggctggaataattcactagaagtggacttttgaaggttttatctataccaggttcctgcctctttttttctgctccccgcctactttggtatgaacagccgtaaccacaccgttccactgccacagctgggctggttaacggcaccttgcccctaggatggacggaaatctccagcaaagcacatccttccttcctcaagttattgccatcagatacgttgtcctagtcatatagcaataactgaacagagcaaagtatatgagagagggggtagattagagggaaggatgggggagggagagagaaacggagggagggagagagattgagagacagggacctaaactctcatgttgtacatgcttagaccacactggatttaacttgaaatcttcctcactcagcctcctgagtatggaattcacagcatataccatcaggcccagcttggctctgactacttaaatatccatacctaacttcatagttgtgcaggaattttagtttcccaaagctcttggatctacacacattgatctgttcttaccacacaggtaacaagttactgtagcacaaagggacattctaggtgctcacacagaccttgtgttcaagccctggactgcctgtctggttctcaggcgctcaccaaccagaagctcctgtctgcactttgcatgtgcagcatgacgcagagagaatctttggaaagtttgctctgcaggcctttggtggggactgcctgctgaactttgcatacatctccattaattatcctttcgctggagctgcttgcaactgtattctttataataaggggcaaagtttagcttggaactattttgatttactggtttattgatcttgaccaagaattcttttatttgcaagtcttcacttagaaagtcaatttggtagcctttgcccattcattttgaaggtgtcacttacaagtaatcttgccagtgagtaatggaggagctaaaattactaataaattaattagaatgtatttataaacccagtggaaagccaagaatgaagttgcttttctattgatcattatactggtcattaactgctgagaaagtgcctttgcagggagcaaagaacacaggccaattcctttggtaattgcaggattccttcattacaacctcaccattgtagaaatataattactcattcactctctgtgttcatagtgtgggcagtggttgggcagtttgtggcaagactagggacttaagcagatatcagcttccatgtaagattttctcttgtcagtcaggattcatttatggaatttttggcctgtttatttttcttccaagacatcttaaatgttaatatatacccgttctgtcagaactgctccaagatcttgagtcatgtgcaagagaacctggaagaaatcttcctggtacctgtcaatgccgggtgccataaagcaccagtgttttcttttctttgtaagcagtagaattatctggctatgtctgttgtttttctgtgaggtactgggaaaggaaggctcccatttcagatgtgaagtacttctcagcaaagctggcacaacatctgtaaatgttgaccaaagacatctgcttgttcatatctcgggttcaattagagaatgttaagatggcacggtggcacagtcaacaagtttgtgctgcaaggaaaataataaacatgttggagtccagataccacagatgttgtcctctttcccaaagccatcccctaagtgtcctctttgcatccttataatcaaagaagcgtggtagtccaaccctgccttagagcgagctttgctgtgtgcagagctgtttgggtacaacatgagatctgcttctagcagaggatgtataacgggggaccagtgatgtctggcgtttgagcactggcagacctgagaagtcataaccagagacatctacctgggttaagttagtctgtagactagggtgggaattgcattccctgttcttctcaagtgaggaagccaaggcccaccatgaatagagatagtcttaccaaggctacagtgttagtgatatatactagaaatggttcgaagagctcaattgtgttttctccccaaaaattaaggcagaaaagaaagaaaaactctgagactcagatgtgtaaatcttattcctgcaattgtcatttcaaaatgtatgtgtatggtaaaacattcagtgcaccttaaatatattcaattttaattgatcctgagaggcatcagaattaaggagcaatttataaattgtgtattctggcacagcattcactgtcattaagtttagaagttttagagttgtaagagggtattgataaaattcacattttgtcatggaatgtcgggacagaggagaaaaagagaactggcattattcccttgtttcttcctgcataaacgggaaaggcagtgctcacctgttcaatccaactgtacataggtaatgcagttccagctgtgactccagggcaattgtgccaactgagcctgttgtggatgccggtgacctttgttgtcaactgagcagagactgacaaatgtgaattactgtccctcattgctgtaatggaagtcccctcagaccaggaccttgtcctgtttgtctctgtagagtaagagttcacaggtcaagaaagcatcagtgtgctggagtgtgagagaatgagagttcccgccttccttactcctgtacctgctggcctgagtaagtcagtgtattgactccaaagagactcaggtatggcctccttttctctttgtttagttgtctgttttgatgccaagataaactttgatgacaatgctgagttccgacaaaaggacatatttgctatggacgacaaatccgagaatgagcccattgaaaatgaagctgccagatacgatctcaagtatataggactggacgggaacattgcctgcttcggtaagtgctggccctgaggctggagttgtatacgatttatgaaatgctatttactaagagctgttacaacaggtgttttcttatagcatcaagtagaaaacagtttcaaagtccattttgattgacagtcactgatttaaagcagtttttcaactctggcactgctgcacttttgaattggatgatcttttattcttagagaaccgtccaggatattaggttcagtcgtattcctctcctccagaaatagctgataattgtggaaatgaaacaatacaaggaaagtgcccagaagtttccaggtgtcaggtgtacaaatgcactccagataagaactgctgagaggctggagagacggctgagagttgagtgcctactgtgcacatgtgaagatctgagtttgagtctatggcacccacataaaaactgggcatgatggcatatgttgatagccacagtagagtgagagtgggaagtagctggattgaggggccttgctgcctaccagtttagacaatcggtgatctctaggcttattagtgagagatctatcttaaatataaagtggagaatcagtagagaaacacacccaacaccaacctctggcctccacacacatgtgcatgcgtgtatacacacatatgcatgtatgtatacacacatgcatgtgtacatacacacatatgcccatgtaaatatattatgtattaagaaccattgatttaaagcatctcaacttttttttttttagtaaaagtaacaactttccctatgccttcagcatccatctactaggaacggttgataaactatactctgagacaaaagtacattttcagagtgtattagttccctttctgtggctgtcacaaaacattctaaccaaaagaaatttaggggaagaaagttagcttacaggccatggtccattaccacacttgcaagctcaattgctagtttattcttatacagcccaggacctcctgcccagggaatggtctcacccacagtggaccctcctctatcagtcatcagtcaagccagtcagatctggatagtcccacagcttagactcccttcccaggtgattgactgtaggctgtgttaagttgacaattaatgctaactagggcacagaggagggagcacaggatataaattctaatcaattcactaacatttcagattgaatggtaaccagttgccaaaatactttcattatgccagtttattaatcaaacaatgggctccatcacagttctctaatttagtgaaaatggcttctgcagctgagataagatgtgtctgtagaggcaatacaatttcagttattgtccatggcttctagtgtttgtgatttgtatgcttccggcttaattgcacatgactgtgtttctgctagaaacaattcattgcactagaaactgaggtcttcatcttaatggaattaaaataaaaaagatttgttgctcattaaaacaacagcatcattatattaagaagtgaagagtcttcaacagtttgctgttcagtacaatggaaaatggcatcctattacaattgatacctaaagtgcctgctttatatgggagcgctatctgcatagcatagctcacttacaccctcttggctgctgtaggtaaatgtgctcataacatgtgtaggcatgggaagggggcaattcagggtgtgtttagaacaaattaaatacagatttttcttggatgaatgtttctcacaaactctgattaagaacactgcacactacttggagatcttttattacaaatacccttgttatgatgggcaagacttactttatttgctgaggtgcctggggacacattaacccaccccaggatacaggtccccactccctctttttagtatccccacattaattaaggcagtcccagttaccaggtctgtctgggggaatcccagggtactttaccctgagtggtttgctgagtttctatgccttctccctcatcacctgaggaaggtaattctataattaagcataagaagcaaaagaagtgcagttggtcaataaccattagctctaaaagacaggaatgcccttgtaaattgctacggtagttcctaagaaaggctcctaactcgtacttttgttctaggttgaatattgggttagtaaataagatcttgtcttaagttttgtgattactttttaaaattgtttttagatatgtgtgtatatatatgtggcaagtggtgaggagggtgttagatctcttggggtgagcctaggctggggggtaagaactgaattcaggacttgtggaggagcgggacacgctctaaccactgacccatctctccagccccttggtattgctttttgagacagaattgcactgtgcccacattgtcctggtacttcctatgtagttcagagtggcttgacctcaggcttaccttctttagctttctgcgtgatagggctctgggatgttagtgtaagcagtgtgcttcttacactaccttacaggggaaggagcatcaaggctggtttgggccctgttgtttctctttagagctgctgtcgatgagctcatcgacataatgcatgcctgcctaaggtgaggaaagaacagacctgtcagacgttggtttagtcccgaaggttgcacattcagagagcatctccacagggacaagctaagtattgcttttggttcacataatttgaatggctagccactcctcacagccataattgttctgcccatcctcctacctgcagccttttcagaactcacagccaaattggttcctctccttaacctttttgagttattgatgaatcctcctcatttctctgtttgtttgtttgtttgtttgttttgggatacacttatcccaaattttaaccataaattagtttatgagttgaatcccaattcagggtacagattggcctagaaatgatagtgttcttgtttggccctcagtgttcccaccccatttccatgctgtttgtttaatgtttccatgtcacggaccatttgcatttcacagtgaatggtgctgggctggccatggctacctgcgacatcatcttcctgaacggagggaagccagcgaacttcttggaccttggaggtggtgtaaaggaagcccaagtctatgaagcattcaaactgctcacgtctgaccccaaggtgaggtttctttggttgggagagggcacagtattcagtcgcctgcttccagatgatacaagagtgaaaaagcaacctatgctttacagcctcgggtataaattctgctatctatttattgctctacaggatactttgacttttgtttggttaaaggcttattagcaacttcagggtgtcatttcagaaactgtgcccacagtcttgggaggggaagagaacacaaagacagtgtcgagtaacgctgtgctgtcgactgccgtgtatgtgggtgattgacaccaagcctcagtcctgtgtttacatgacttagagactcagcctcacattcctcttgtaaggatcctgaagatattaccagagtattagaaatgtatataattatagaatcacaggtcacagtgtataatatatggaagaaataatagcctgactgtttatgtaggtgctttaatctgcagccttaattatgacagttggggacatacagattaagtagtaaattactaaacgtagttttctaaattctgttatttatataaatcttttctttttaacagagtagcagagtgggatatagtatcactgtggccagctagggtactgcaggtgtctaatgagttcttggctggtcccttgctttcctgtaattgtcctttcttggtcatcagggataatagacctaaactcaactcttatatacaatgtctctattttttaaaagtttgtacttttcatagttctcatttaattctcataagtagccttggggctaactgtatgctatattcatttgtattaaacttcattcaagagttgttatccgaatatcgttagagcacttaatagattttgttggttactaaattatttggaaacataagaattctaggccagcacaaatgaaaacaagccagagttctccctcaccccccaactaggacttgcactacagctggcttcctgcgggtccttctcaggaagaattgtactggcagttgcctgtttgcattcacacacatatggttccatatattcaatatgcttgtcggtctttcttgtgcgtttacaattgctaaggatgatctaccttacaatttgctaactcttttctttcaattcacagaacgatgttaacatgtcattacttacttctctccagttctccagtgttgtccaggaagagcaaagccagtcagtgtagtgtaaggcactcatccatcaaagggatttgggggaagatctgttccacagccggtgttgtttagggtgttgttgtttagggtgttgttgtttagggtgttgtttaggtttgttgctcaccgtggctctcccatccttttgctggaacattgccttcttcatgcttccttctaagagcagagtcattttcctcctagagatccccacatgaaggggcactctgaggtgccacaagcatgtgcctgtctctctgacccaggaggtagcagaggacattggtcagaatcaagctctgtttgttaacactgtgagattacttgccttagagatggacagccactgaggggtcaggctaccaagacaagcagcatggctggtctttgaaacatctcagtagctattcttgaattttaactttataaaactaaagggtgtaaggaattttacaaaatgacatgcagagccatttttattgtttttgtttaaatagtctcttaaaaaatttgactttaccttatggaatattttcaagtacttggagtgtttcaactcttttgagcttggctgtcatcctgggatggataaagggatgtggaagttattttcctcatactatatcaggaaaatgaatgcatagctcatctcccagaacattttccaaaccttgaaatttctaagctggttaaaaatcatggaaattaatttgtgtttttaatccttgttcggttcttgcaagtcagagaacagtagaggggggaaaaaaagacagtacaaaacacaaccaaaaagggacagatgagttgacttgattttgcaaagaaacagcttgtagttctggcagtaattatttctgatagagccctgtccacctgcctcgaaagagcgcttccaagaactcacagttaattatttcaaagtattgtcttgttagataataagaattaattcactgaaactcagaattacgagtggcttgttagtgttaaaccaaatccagacttaacatctctgtgtttgtcgtaacacaatataactttattggtatagtaataaacatagtgtcatttaagaaaaatgcgacaaattctgtttctatccacagtgtgagccacacctctgaattgtacatttctttttctcgcctaggatacctgaatgcttgatttcatgttttaatacaaacatctgtacaagaaatttacatatttgtttatagcacatagcactgaactccttgaattgtctaaaccaagagtcctcagttattcagctgatttcacatgaagtctatcattcagtgtcttgttcttgtattttccatcagggcccaactggagagcagggtgatggggtttgcctgccgctgggggtgtaggcctcctctgatcttcatctccatttgcagaactttgaactggattcttaaacacagaagtagatatgacagaaagcagagttttgttgtaatctgttaaaaatttggacacatttcaaagaaaagtcttatatagaatgttgtctttgtttttgtttttggtttatgctttggcttgtatttctaattctcagtttagaattccatatatagcatctggcctgtgtgaagtatcttgcgtaaatgaataaagcaaaggccagttggcacacttccatcagtaacccctcttctggcatgtgttaactgagtctgttggcctctggggaccttcttgtgagaaacaagaataggtaggtagcctttaggctgttacagagaaagtagacttctgatcacattaagatgtcacataagttggaaatgcataattactagaagagttaagggttttgcagtatttcctatcattctcccttttctaccaagagaagttgccgaatacaacaacgatcaaataatggccgcagtgatgtcaagactggctggctcttccaaataacagttaatagtctcacggtggcagggcatctaaaagtgtcactcttatcatggaggttttattctagcatgtaaagaattagaggaatcactaaatgtgagaagcagccttaggaacttgattcagaaaaacaaggtgaactgccttccacagagattgggttttcccagttgctgtggatagaagctatactttggtgagctgagccccatggatgcaggaagctgaggtgcagccccttcctcactgtgccaacacttctcctcaccgctgccaagggagtgggaattagaaaagatcatcttgctgtgaagaaagcagcatgtctgtacagtccttcctacaaatgtcctggctcattggtgcgctgaggtgtcatgccttggttttcctgaggaaatgtaattcctggggacccattgtctcaatagtctgatatctgaagggaggggtgcagatttccctctcaaatttcttcattcctgtcaggatagttacactcaagggcctcattatagatcagggatcgtcctccaagccacagaatgtaaagagacaagaagccactccaagctgtcagcacacgtgactgatggactgtataggtaggtgtgtcgagtcggctgtgggcactgagtgtgaagccagagtgattggaatcctgacctctgaagctgccaccttctggacaggaaagttactgagcaaacaaatatctaatgggaaacaaataccaaaaaacaggccaagcagttatgtgtggcaatgacatcagggcctgctatctccatcttctgcagaaagccctttctgctagtttgtcctggtaggattggagtctggggtttatagtcttcagcaaggatgctaccagtgagtctttccaacatgtctttccactaggagctatccttccctcttttctagttcttcactgtctttcccagtgtcctgggcagcagggcctactggattgcagtgagttacattagaagtaaggcagggttggggaggggagagaggtggggagtagttgacactgcagttctcactctaatttgggtggccccgtcttgcaattaaagaactttttagtatgcctggctattttatctgcatttctgggaccctctccagaggatactttgaccacctttgaggtcttacgaactggagcatatcgaacgcacatagcagcatccccaaggaccagttggcataaatcctggttaattattttcctccctgcttatctatggctcctttcattaatcgttatatgtaagcattcttaaaacatccttttttttttttttttttttttgcaattagaacttagtagagtcttcttgagcaaacactgaggtaacttgtagtaccaggaggcttttaggctcagatatagtaaacagaaatcttagagttttaacccttgcccttctggatttgacttacttgagatcaaaacaaaagtgacttcggtatttcagtgtgtccttgtgacccagggctgttagaatttggatagcaggtaagagaaagtctatcttgtatttagggcactgttagaagtttctctgcatgttgtaacctgtgttcactggttgtcttttagaaatggagctaattctctattaaaaaccaaactaagcaattaaccccagtgctgataatgctaatcagattatttgatattcaccaaaggagggaacaaaagaaatattttatattctcctaaggaagacgaaggaggaaatgaaaaaattcaagtaaagaaaatgtgcaaagaacttagcccttatggtcagaatctgtggttctgattttctgttcagatacaaccttaaaagcactatgtagaaggagttgcagggtttgagaagatggcatagtcagtagagccctggccaagcaagcaagaggacctgcattcaagcacctagtccccccataaaaaaagaaaacaaaacagccagccagatgcagcaacatataacggcccttccagctctggggaggacagaggctccacctgcatatatatctgtatacccacatacatatgcacttaacatatgggcatgtatacacacagagttgtgacaattagccaaacattgtccaatgccctagctgtataaggtttcaggaaagaaagtaatggccgccaccatcctagatgtatgttttcatgttcactttccaacgcaggagcccctgagtccgtccaactgacaaccaaaaaatacttatgagtcacctgtgatttgccaggcataggccaactaagaactgcatggctgcctataatcttatgcttgcgttcccacagagccttacttactggtttttccttttacatcatccctttaaaacagtggaaggaggcccacaaaagacccagcacagtgtccgtctctcttaaggtcatgtctcattgtccaggttcaggagtagcatggaatcatctgtggagccttaagagtcagcgtgtgggctaggtactaccaaagtggacccctcacttgaaggctgttgaaatgtagactcttgttttctcagggtccagaccacgcccggatagtacaactccctgatttttttgttgcaaagtattttattcatcatttccttagggtattgactgatgtcagtgacctcccagcctattcagtgtaagacaaacactcaaagtgtgatggggcctgtcatcaacttgtaaaccagttctatgaattgttttagtgtaccataagcacagatgctgagcacaagcagttaagacacttttactggaaagcaccattgttgtgacatgcaaatggaaggtgaatttccttgtaatttatatgttgcctcttataagaatattagcctgtcactgttagtgaatttgttcaagattgatccttcaccacagattatctgagcaacattgcaccgtgactttacatgagtgatggccgtctgagaggcagcatggtaagccggtttgttggacgatctgatactacagtcatttgattagaggctgtggtaatcccgttttccacttgctcttgcctcttgctctttctcctgattgtttcttttgtttccttggggctacttttctcattccctgtcattttggtggcatattctccccattgggacattccccaatttcgcatgtaagcgcagagcccacagagtatgctcaagcctgagagatttatgtactatctccctggcatagtaggttgtttttaaagtgttaggcacaggctcttcagactgggcaccgaagtccctttatgactttcccccagcggcttagggatagggctgcctgccttaggatcgtgagcttgtataatgggccaggaggctgcacttctggacacctccaaagctgtgcaagattcagcactcaagttttctcacggggcctcctgtgcactcatcatgtgtgcatcagctgggatctcctttacatgcatatcccatgcatgacctaatctagactcaactgtctccctgatccagaagcagagctagcatttattctaacaaacttcagaggacgctcatgttggcttaagcttgagttgcagcctcagctctgttttgtccccttacattagagtctactttccatcattgatgtcacagcccgtcctccctgaggtaggtttctctgagtaccagctgaccaagccacattcacctcagcatcctctcccacagagctccaggctcaactctgttaacactcatttgtccccctcccagtgtgctgtgacacccccttctgttttatttttttctattcctgtgtcatatctgtctttgaaattcagaggaaattaccattcgaaggtgccttttctatccaaggagactggaggggatcttacacttaatgaaggttcatcagtgagttcagagactccttccctctgatcagttcccgaatggagaactcgtgttttccttgtctgtgcaggtagaccataataacaggctgtgtcagtctcaagtgactttctataaactttatgaaattacctcgtctcaagtgtagtcactgaagtggatcttattcacttttgtctctgttaagttaccgtcggctgctgctttccacccgagacttctttgctattatgtgctctgtgcatttactctctaagcacttttcttcttccctcttgatttgtaagtgtttggctgtgattctgtctctcgtcttttcttgttacagagtacaaccttcatttgttacccggtcccttttgctatttggggaaagggaagtggtcagatgtttctgtgtttgaaaaatgtcatgataatcggcagttttaagatgagatagtgaatcctcttttatgtttggtcaaggaaattgatttctaatactgtgtggcagaggtctttgctgagttttatcttaagatatgtgaataataaaaaaaaaatcaccatttaaaaaaaatccaatgtaatgtttctttaccctaatggacatgcttcttttacaaattataattagcgcgtcagcacaggactctctgtagcttcttgacccatgtctgtcaaccattatatagaatttggaattgaattcttttctgtcctgtcttcagtgtgcaaatgagccctcggtgctgttgcctccatttctatacttgtgatatcagatgttcatgcatctgtcacagggtgaaggagagaagagaggggatatggccttgttttcattctacagatctctaactcatgatagccacacgcagtggcgacccatgagaggagcagactccaaacataccctcacaaaggaaaaacgtagcccagattggtctcaagctctctgtgtggctgaggagggccttgaatttctgaatcttctgcctctacctcccatttgctgagattataagtgtgcaccaccctaccaatgcatgtagtgtaaggggcttgatctcagggccttgtacatgctagggaagccctctaccagctgagtacatccccagacttgcagagcatactgataactatctttagcattgaaaatcccttaaggtacccggtcctgaccctccatgagggatgtgcccccaagcctccctctggaattcttgtccgtacagtgatggtcatagggtcccttctcagttttactcaatgaagtgggcttttgctttcacacttgttctctttctatgtacatgtagtaggatacatataacatgtgtctgacccaagcatacaacatatattctatgtccttagacctgcctggtgccacctcagctcaccaggcgtgctgagtacgctggttggagtgctgtactgagtcaggaatgctgagtcagacatggtccctctttagccttactcaggcttcatggatcaatgtatagactcattaaaattggagacctgtgaattagagtgaacattggtgacattttattaattagacacagatttttaggagagacagaggtggaattattgaaatgcatgtcgttatccttcctccgtgtgttttggttttatgacatggtggattttaaagtgaaaaccaatcatcactgtagactgtgagaggagacaaattcatgtcacaagtcagtacatgtggtgggctgtgcactgaattgtctccggcttagcagatcgtgtgatttaaaggctctgaactgaagtctctcttttcattgtacacatataatagggtggcttcaggctggcaagttacgggaccttgggagatccccagctaacatctgtgcctgaagtccacccccacccccatccctcaagactgctttaagagtatgttcttttggttttggttgattcctctttaatctgacgcacaggcttttgttcctggaagacaaatgcagaggatatttttctacaattattattaacaacaaggaaatataattccattttcttacaaattttaaaaatgaaatttttgttggtaagcctttgataccttatttctgttagctagatttagtataatttttgtttctctgttttgctaaaacataccagaattatttctactcctttaacacatcagagtagtaggtgccttggatcctaggtgatgttttgtgacagttgttggtcatttctgccattagcttataaggcactgatagaaagctgaggtgctgatttgaactcactgctgggtagtgtgacatctgttggtacttgtcatcttttctgaccagcacaggacatgaggcttagattccagagatggcagaggtggaggctgggtctgtctgcactagtaggtccatagccagaagggacagagacactcgaagggatggtgttccccccacccccttttattccctgagaggaggttttgctgagcaaagaagccaggggctcaaaagacctgcatcataagtggccctgacatatgcatggacattgcaaaccaagcagagttcagatatcacagacttcagtgaaacactgagggagggctacattcaaccatcgagtgtgtgtttgaatctaattttaagtgaagcttcttttaaaactgttttaaattttcttgtgctatagaattttggaattgaatgagaccttcaaaatcagaaagaaagcagcatcataaggcaagttaaacttgagcaaatacaggaagacttggcatgttcttctgaaatggagccaagttcattatagcatcagttaagccaagacccagctcctcaaatgggagcagcatggagctagcacgccagcatcgttggggattgtagcagcacggtgtactctccagcatgtagatgtatatggtctggagggttttactctgttagaatgtacccattccatctcgaaggactctgaccgctggggaaaagcactcagttgcagaggtcactggttctgttgccttacatggagagccagtcttcatttggcttttggcaagtcttaaggacttcatgactgaggctgcagatactcagaaactgtatgcagagaacagcctctttctttcccacacgcatctcgatgttacaaggaagctggggtggcactgaccttagctcacactgcaataatgatgcagtgtctatctagtcctaaaggctttacactcatggtcagaagctcctgcgtggctctgggaagcctgtttagaaccacagagcttgcgtgatcgatttggtttttgtttttatcattctctaaaaaaaatttatttctcatatatattcttcactagttaagaaataacactgtttgaatttatttacttagttttttggtgggtgtggggtgaggaagagtagggtacacaggtgctgcaagtgtacgtgtagaagccagagggcagtgtgtgcaagttaggtcttccttccactgtgtggtcccagagatcaaactcaggtcattaggtttgacagcgagcacctttgcctgttcagccatatctcctggctgtctctagcttttttgaaagctaataaatttcagaattccttatccacagcatttgtgttgtctcctaaataatgcagatctgttatttgatgcactgtcatgacagaggttgggacatacagaaggacacagaagacaatggatcactcattggtcctcagtccttctgtaacagttaataagatgggcactctctctgcctccactgtttccttctgttgctgtgcacaggggtttctaagagaactttgattcattttatgttttcccactgaacaacaaactgatttttttaattacatcattggatttttttatatatcaagattcttattacctgtttcagattccattgtgctttcttgtattttactcatttctccatgcttaaaatatttaaatggttttctgtcaccatcatatgatctcctctgagtcttttcatggtgtatgtttctaagtaagcttgggagtacacacttacagtcatccttttacagatagctctattgcagtttcccctttttaacctagcacctacgtgtaggggaattttatttctctccctaaatgtctctggtgaccacatatctaactgaggttggttgtcttgttacttttgttgatgtgacaaagcaccaggcaaaccatttaagaaacaaaggacatcccttgcaggatgggggtacagccatcatgttaggagtcacaaggcagctggccatgccgttttacagttagtaagccaagaaagatgctggtgcacttattcaggaaggctgagaccccgaccctaatagacttgtgccagtcacagtagtgtgcatgcatcttcccactggagttcatctacgtaatccctcctgtacacacccagggcccagatgtgcccataaaggggtctaactgttacaggtgactcctgccattccctgaagagtttagaagtgatccagaaagttaaataggaacccactaagatgttactatttggattttaatagatgtcttcagagggtctatgcacagctaaatctgtgtaccaccctgacagttgggtaaaaacaaattatggtcaccaaggatatttcattataagctaacctaataagtataatgctaatgggatatgaaaatgacacaattataattctatatcttattataaatctctgactaccagatgtggagattggggctaaaacgtgacacttcagtgcttgacccttttcagaagccccttttttctttctttttctttgtttttgttttcctgagacagggtttctctgtgtagccctgcctgtcctggaactcactctgtagaccaggctggcatcgaactcagagatccacctgcctcccaagtgctgggattaaaggcgtacgccactactgcccagcagaagtccctttttttatggaaatgaaaacagtaaaatattcataggtattgttgtgcaacattgcttttggtgtgtcaaaaaagaaatgtgatttgacctgtcattctcaggcacatgttacgagcattcagaatgaacaaagtcagtggtagagataaatctgtttataatgtaacatgttcctgttgctctctctgtgtttattaagtgcgggctgtccaacagtgtgaacatacacatgaaaagtttgtgagagttttgtttgtttgtttgtttgtttgtttgttttgaagtgttattttgggcttgggagatggctcagcacttaaaatgcttgctatacaagcaagacgacccacgcttgtatgcccaaaacccacataaacacgaggcaggtaaggttcctttagttctagcctcagaatgcagagcctgggctaggggatgctctagaacaaactgactgcccaggctagccctattnnnnnnnnnnnnnnnnnnnnactgcccaggctagccctattggcaccctttcgttttgattgagggaccctgtctcagagaataggaggattctgcaggaagattcctgacatcttgacttctgcttcccacctctgggagcacatgtgaacatgcacacatgcacaggctcaccccctgcttgtgaaaagaagaaaaagatggtttcattcatttgtatgtatatgtgtgtgcgtctctttcttcacatgtgacctctgcagaaagaagttctttgtatgtcttctttttttttttttttcatgatcttgagtgaatacagggtagatatgcatcatggatgtgtttggttcaagaaaacatttagttggcattgataactgggctcctccgaaactgtagcatttctccctggagccagagtgtgtcttttaaaaggaaaagaagagctgaacagggtctaagtttttccacatggaaatcgatagcggcaagggcagacccactccatcctgtcagatgccatcttgataagcgtggctgctttccgagttagtaatggcagaacatcagattttgcttccctcacaagacagagctataaattgagaagtttattttttccttccttaaaagctgcaaaaaagccctttagatacatggaggccgtcagtgcaaccaagccgactctccagcaagccctttcagttacctggtatatgaacacccatttcatacaatctggttgtttggttttgattttttatttaaagtacctataaaaagctaaccagcataagtttggttttttagggtagagtgttttgacagagatgcaacataaaggctgggcaggagatgcaatatacagaagcctcagcctttggtctttctctcaccacaattagcaacacaaccttagagcctacttgtcaaagtctatcatgctggagaaccacccagagagctgggtacagcacatactgccaggtgccactctggataattttcttcaggtcaagaagccaaaaattgggcaggaatgagtgtatttgtcacagtctcaagacctgacccagacaggatcttgtgaacaaatattagggggagtggcaagggactaggagaggctggctctgacccggcagacaggaaggtgtgggaagatggtctgtcagtctgtgagccagacacaaccagaagaggccccaagtttcctaggactgcatctcaccgggttccattaagttggaaattacagtctgagcccagctaccgctggcaagcaatctactatttggtggagtctcaacagtaagtcttgagttactgcaagtggggtgagcagagagggggtctgtaaagtagtgacacatgagtgaacaaagggaccgagcaagcagagcagagaaaaagggaagtgcagcagctgaaggccaagagaagaacgctgaggaggctaagcttaggctgggctcccctcagggtgggtgaacgaccaaattaggagtttgggattttattcttagagagaggagtggggagaaagagaaatctcacaaagacttgccacaccaccagaatgaccaaatcttaggagagggtggggtctgcattgtgggaagggaacagaggaaatagcttactgacgtgatcagttcttcctagtctggacatccctggccacaggctttcgaggccttgggttttctacaaatccctgggcttttgagagccctccgatcttcaaaacatcacactgtggatgtagccacatagattcagatagcttcacagagctataccactacagccaaaccagctgaaagcctggcctatcagtctcgtttcttttcctatatattattacagaaactgtatgcacactgacacctgagggagaactcaagcagagtatctcttaacattcagaggtaacaaaggtaaatacatgagtagaatgttcataaatatagttaccagtaaattcttccctaccgatccctgtctccccatagctcttgctggggagatggctcagttggtaaagtgctggccatgtatgcctgtggacctgagttcccatcccctgcatccatgtaaaggccagttatgaaagctttaactgcatctctgaggggctcttgggggctggagttagaaagatcataggggtcactagccagccaccctcgcagttggtgagctctaggttcattgagggtcattgtcacaaaaacaatgtatggtataactaagaaagagaccgagtgttaacccttggcacctcagtgtgcacacaagtgcacatgtgccagcgcacgcatgcacatggacacacgggaatgtgcaacccagcatgttaagaaagtgggaacacaagtttgcacttagattagggcaggttttcagactcctctctcagtccttaccacgcctactttgagcctagaggctctgagacagttctcgtgtctgctgtttggaccaggttttagctgagtgaataaagacccaatggttaaaatttagaagtgtgtcccttggcattgagggtactcccatttcagagatgccagacatagatgtgcttgtttcagaggagagtctgcacatccacttgtgattccctcccccctcccccaaggtcttctgttcctctagccttgcatttcctgtccttgggaactagtaagccctgactgtccaggcggggccatagcatctgctgtaagtagcgaagtgattgcctgtcactcagagcatgcagagaccaggaacttctgcgattgatgcttgacagaataattagaaacgtgtcactttgcagtaaccatttgagcattcctaaaggaataggccagggcaaggtctctgctgtctagtcctgaggttaaatgttcaagaaggcaaaacatagtgtgtcgtgggagaaaattgccttggacatacaggcagagatggccgtcctgctcctaaacaatggccccgcgtagccagggctcctgctatttctctagctcccatgctgtgttaattcctctgcaaggttggtttactctatcacaggggtggcagggtctgcaggtgtgtccttgacctttgtagggtcaacatggcccctggtcctggcatcactgttactgtctcaagtaagatcactgggacccagcttgaccttaataggcaaggggggaggaaagttaacggagagaagactaagttaacttatgcctgcgtctccttattttataggaaaataagttagagaatgggagtgtatctttggaagaaaaatctgtctccaagtctacatcttttattttcactacttccattttttacgtttatgtgtaggggttgggtgtgtagagatcagagaacaacttgtggggagcctgttgtctttccaccatgtaggtgtagggattgaactcaggtcttcaggtttggcagttagcacccttactctctgagctatctcaccttactgattcctttttaaaaggtgagttttagggccagcaagatgactccatcttgtaaaggagtgagtacctgctaccaagactaagttaacttatgcctgcttctccttattttataagaaaataagtcctgaactccattcccagacctctcagagtgtaaggagagagccagctcctaacgttgtcctctggttggcacacatgtgctctgactgtataccaatgaatatatacaaaacaagcaaataatgaaatttttcttttttgatcttgagttttaatattaatactttgacgtcagggtttcttctggtggctctgagaaatgcgacactggttacagcactctttgtaagcttacaggagaatgaggcagagaagaatcagcactgatgggcctgctctgctcttgactaacgtgcagaatagcacctgagtcttaaaattcggtgagtggtgcatgttgagtgcctggcatgctgaaaaactgtgttcagggaagggttaaaacatcttcatcctgtttgtctttaactaaagcaatcagaatgttggccgcccccagctgtggcccacagccttccttccccttaggtttcctctatggatttagtttgttattacttacaagcaagttgatcctccatcttctgctgatttcttttcttatttgtttcttttcttgggttttggtgtaggttgttatgttgcagagaatgcgttcaaagttttcatccccctgcctcggcctcctgactacttagaatttaggtgtgaaccaccatacctggcttcaaatgagtctaaaactcttacatctagagactgagcagcaagtattgtaaagcaagctgtcctacagctcctcactttatcagcgcagacaccactgtctgtctcagaccacacacagccttaatgctcactgcttccctggaagcctcccaggttctgggcacgggagatacctgtcagttctgtgcttctctcaaataggggccttgttggccctcagagaacactgggtgatgcctagaaatctttggggctgtcaagttggggtgagtgagctactgatatctcgggaggcaaggccagggatgcagccgaacatcccacagaacagctcatcatactgaaggttctcagctcagagccgcagagctgcgagggcttgagccctcggctttggtgattgatttctgtccttgctgtgatgcctactgcatggttttcaaaatacacggggacgggtgttcaagcccttcttcctcatgccaagcctttctttgtgctgcttctgtcatagctatatggaacccaattatattttatgttttatacttgccagaactccagagttacttaaatatataatctccacttaagattcaaacagatttataaagttggcagaagaaagtgaaacgagctagcttccatgatcagtcttgagccttgtttggggtgttaagctcatgtaccatgtgggtaatttgctaatggtcatattttggttttagttccttccatctcagtgctagggaaagaaacatacaaagacattctattaaaagccaactaaaacaaaggtgcagttttagtcatagaatgttctgtcctgtatatatttaggatatctttcagcaggaaagaacccagaggacaggatacctggggacttcagtaaagcaagccagaccacaatgtcgagctctggggcatcaggtaaattgctcagaccctgtcttgcttcttgccccttgcaccccttctgtggtgtggtaccttgcatacatgtgcagggcagtgtgcacacacatttaaaggccagaggacaaccttggcttttctctgttaacagggatcctatcatttcctctgccttagtttaccatttcactggcctggaattcgatgacttagctggccagccagctcacccaggtcatctgtctctagcacttggattataataaactcatgcccccttgcccagttttttgaggggttgatgtgtgatagttgtgtttttctttagcagttctggagctctaactcagtccccatgcttgtacagcaagctatctctctccccccaggcccagtgaaaagtccaagaagatgctcgctgctacagtcccagtcagtgagttccctgcagctggggctgcttggcgtgggtctttctttgcttcttcctgtattgtgtgatgtttccttcccaaaagactgtgggttgtttttacaatcaagtcagcatcactaaggttcaaagccagggtgacatgccagctttcctaatatcttctctggacttcttgatctctagttgttaaaataacattttttgcaaacaaacccaactattggttcatagatgtagtcagctgtagttattgtacattaaagcactttcactctttgaacttgagtttttgttttgtttgtttgtttgttggtttgttttctaacattatattgagtttacattattttctgtaaaatgagacttcttttgaactcaatggggtgatgataacgcccagggtggcagggtggacagaattgtagtgagcagccctaacaaagtcctcccacctctatgactagtactgccttcatggcctggacttcaaagctccacaagctgggcgtggtggcacacgcctttaatcccagcactcgggaggcagaggcaggcagatttctgagttcgaggccagcctggtctacaaagtgagtttcaggacagccagggctacacagagaaaccctgtctcaaaagaccccaaaaaaaaaaaaaaaaaaaaaaaaaaaaaaaaaagctctatagattggttatctatccatgatactaaagcacttgccatatagtctgctgctgagtaaacagtggcattgataccagcttctgctgtcacattcattatcaccattgttgtgtggctggctttagccagattggaatttttactctaaactccttcaagattaactttgtcaccacagatgattttgatcggtctaccatcggctacgaatgccctgaatcgggtggtttactatcaaggcattactttgggagtgaaaaaaggggactcttgggatattcagaatcattttttttttcttccttactggctgcccgtcagtggaatgcaagtcctttgatacttcaaacctcccatttagctgggtagccaggatcctgtgacttccttctggcctatgagagataaacaaaagcctcatgtgagacttgtggcaagattatctttaagaagtagaggcacccaaatggagcccttctgattcttctgtgctcttccctgtggcttgggaggcttttgttaagcaagagcttatgcagcctttctggcctagaggtgacattgtaatgatacacttttatgatagaggaggttggcttgggtctttccagcccttggaggtaccgtcagcccaacttacctctatagctaacatcctgatacagtccttgactgccaggcctcaatggccgtgccttctttagcttgtaatggagttcttatagtgtctttatttttccatagtcaaatccttctccattatagcacagataaaggactgaagtttgactcttgagcaactccccaagcagaagctttcctaattaggatggatggatataagctgttgcttgctctatgaggcaggtttagagaaggggcagctggcctttgcagtgggtttcctgcctgcagcagcctatgtgtgcccagtagctccacccacagctggtggtattgtactaccagtacacatgctgtgaagtttactgttaagtgtggtggtttcctgacggtgctaccaatattcccttagagcttttgtcccactttccttcaaacagatggtggtaggttaagtcgagtgggcttttcatatccattcagtagagaaagtccacagagcgtatgtctacatcctagaacaccgaggtgaatgcctgtccttctattcagttgtactttgttcaaacattccatggtcccttaactagcagagaaagaggaaactgtaaagctaggacaactaattcatgttaaaacatgcatactccaaacagccgccctctgaatggttcactggccaccaagacagcgtggaggccgaattaagagcatttgaataattgactttctatgtgaataaattagaatagattagatttgattgaccatataacaatttaaatccctaaaaccaaaaagccgcttttctctttctaggctactttgtaatgttgtgtgtcaaagataattaaccatgtgtttttcttgttggaggagtttcctaaacaaaaatcagctgacttcagagaggatggaaatatttacccatgctatttccttttttaattgaagatctcagaggactgagagacatactgagttgttgggagcccagccagaagaatagcaggctcagagcatcttggtgtgcatcatgtctcctctgacctgtggtgtggtcctggcttgggataatttgagattcccaaagtgctttgttcctttctgatggcagatgtaagcttgtatgcaatacactgtgctgtcctgaagaccatactctagtgctgcagaaacaggaggcacactgttgagtcaggagtcatggtgaggaatcactggttagttagacacaatggtaaggagacactgcagagttagacactatggtgaagagatgcaaagccaggaataggaaatgtcctgccctcatctcagacttgagccgaaatgtgttggctggtgtgcagatttattatttctgtctgttctgctcttgctatccaaggtcacttatgctactgagtatatctctcagctggcatgctggatagaggatgcatgcctccctctccctctgctctccccaaggccctttccatggcctttccaacagagtaagacttctcacgaggcacctaaggctttccagtgatgaaagctgacagccaggctttctagagcattggcatggagcagctgtagcacatcttctagggactaaaacagttagagtagaaagggctgaaggacataatcgaggtgatagggtgttgacatcagcctaacagacgactccacagacatgccaccgtgtctgatgcccactgctggcccagtgaatgtcagcacacttttctgataataggattagattaatactgatcactggttttattgtctttctaatgcaaagaagacatggatggaagaaacttggaaattttaaatgactttattttgctgcatctaactttaagacacactactatccacagtttcatgggacatctgctataaattaaatagcatctctaatttagcaattccccaattccccaatccaagtagatctgagttgggtccagagattttgtttctcaaaaaaagtataaaattgagaatcatgaaatgagaattgttcaagttggaatggattctagtatcttccccacctcaacccgcaactgaataatttgtacatttctaatgcctgtcacttagagcaggctattttgggaagaagaaactttacaaatctcttgccctgcagtcttgagtactgtcctgtactaggagaatttagtgctgttgccgtggagagcaacacttaggagtgggtctaccttgtgtttcagagcccacagtcatgaccattagcatcccaagatggagcccaggaggcagccagcaccactgctgggttagaagaaggcagtagggaaagcggtgggtcctgagctttccatgtctgcttattatcagggaatcttatctggcttacttgtacattttttcatcttgtaaaaactcttttccttatttgtgatgttaaccttgcatttacacttttctgctgtctactacatgaaagcataaagaaatgggaattagactcgatcattcttgtccatgttaatatcatggtgggtatcagccaagatggttcatttgaattgtttttccccaggaatttttttttccttcctggcaactatgtgcgtttgcttttgaatattcagaactggctgtcttcacgaatctttcaagtttagctgttttgcttgagagagacaccatggtgtattcttgctaatgttttaaacttagtattatttatagtttccccctgagaagtctgaaatttaaaatttctctcctccctgactctgatgctttatcatctagcttgcaattgattcaccactttgtgcttctaatggagcctggaatcgacatgcccacatgtgaggtcagctaatgtctgtgcccctgcagaccaggaacagcacagtagctacattcccatcatcagctccatcttcagcactagatccagctcagtgttccagtgagtatctgcatgaggcttagtgctggactcgataggcaaacatcttgttctgtcacctttaaggaacactaatttcctttgtggaggaagctgtttcccctctgtagtgttacagctcttggatgttgttgtgcccaccttggccggcaaggaagacacaacacggtcggattcttctcaacagcctttattgcaggaatgcctcgatgctgctacggggaccctgggcacccagggaggtctgcttatatactctccagcacagggaaaggctttgaggccccctgggattggtcagtctgccggcacctaatttgcatgcacctgctcgggaggtgttggcgccagactaggacttacacctgcactgatgttgtttatgacaacagcacacctggcacccagcgccatcttagagttagcgtcctacaggatgtaacaggctatagcatctgtgcactactccgtggctgatttggttaaaggaagagtcctgtgctatccggtttataatattacacttcactagccagactagctagttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctttcccctttcctttcctttcccctttcctttcctttccccttttccctttcctttcccctttcctttcctttcccctttcctttcctttcctttcccctttctttcgtttcctttcccctttcctttcctttcccctttcctttcctttcccctttcctttcctttcccctttcctttcctttcccctttcctttcccctttcctttcccctttcctttcccctttcctttcccctttcctttcccctttcctttcccctttcctttcccctttcctttcccctttcctttcccctttcctttcccctttcctttcccctttcctttcccctttcctttcccctttcctttcctttgcctttcctttcctttcctttcctttcctttcctttcctttcctttcctttcctttccttttcctactccctaatgtatttgcttcatgtgttcctccacccagttcctggagcacagcgcagtatatccctctatcacagctgtcctcacactacactgtgaacctggacctgttccagtgagaaggttgatctccctcattccctcccatcagaagcattctttgctgccaatgtgcatatgaaacacaatgtgtttcaagcaccatattctcaggagcaagaagaaattaaactttgtatccagttttggaagtcagtctcctttctcaggtagaagttttaaactctgttggttagataagcatgaagggtgccttcagtgatttgtgccccagacctaagctttgccaggagtgagtgcctgacctgcatggggaccagatgacctctgctcagagagagggaggtgaggcaagtcaggtctgccttcagagcccagaccccacaaggtaacctgtaaaaataccttccttcctcagtttgcaggtatagtatgaaacacagaaaataagaaaatgtgcagcaaataaatcctaaaatttaacctgatgatagaaaccctacaaaccataggcagctcgtgggctttgagaggggctgatatgtttattggcatgacattcttgaatagtggttaaattgtcatttatagatgacatatttgatagtattagggacatatttttccaggtttctaataacatgagtatgtaagactataaaaacatatgatagtttagaagtgtatgctcaagtacttgggagtaaagtgctatgatataagcactcactttaaggaattcagcaataaaagtgtacatgtgtgtagagagagcgctacatctttggaaaagactaaatagttaaagacacatggagagtatatgaattatctacagagctagttaagcctctctctccctctctctcttttctctgtatatctagtattttctgtagttcaaaatgtgataaatactgctttgcagctactagcttccccacaagtcatcacacagtttctccccttatctcaggctgatgatttattgaaatttcttgagtagctactatgtatgggtttgcaggtactgaggtatataggtgattaagcacttgaggcacacatgacttattatggtttttttgcaatttttataattcatataaaatcctaaaggtaaaaatgtccatcaacctaggcccgggaaggtctaaagcagtatgtgctggtctgaggctgttgtcagtcagcctctgacacctcaccctctttatgggctttgcataagaacgtgtgcgttagaagataacttgtaaggaatttccacaaagaaagtgcctggcgtaatgaccttggactctgttcaggttcatcatgtacctctgggtatatctagaaaggttttcacaaagactgctagagttttgtttgagtgggtattcacaatgtgtgcatggctcggacacacagttctctagaagcagcaacttctctagctgaggcatttcagtgactccttggtggcaaccagtttcccactgcctggaatggctgtgttgaaacattgttttcctgctttctaactcatagccaaataacaagaacaaaaggaagaaagggagggagcaaatgtcgaatgaactattttaagagaatttcctactgttggttaagctaaagattttaagaacacccaaaagtagctttgtgctaagaaaacatgatacatatgtgctaatactgagtctgaagacctgaagaagttcccttttgtggaagatgctcccctgtagattagttaaatctaatagagtttcattttgttatcttctatcataactgtggcaggagaactatttgcatcttagttgtcttaagaggtgcttataacaattaagattttatatttcacttaatttatatattttttaaaagctcagcttgtaagtacagatgcagcttgacgtattggtggggttacaccctaaaaaatcagttgcatatagaaaatactgtaagacagggagtataatcaacatgcctcaccaaccaagcatgcaacttagctacatagcccaccacagagtagcaggtctgttcccagccacagtggaaccggtggaactgtggctcctacctgtaactactatagcaagagatcagattgcatgttgctaacccaggaaaagatcaggatttgtaattgaaagtacatttttctattcactgaaggtagtctgcattattataataccacaaaaacgtaaggtgaataaccctaaggatttattaacttatttatttaactctcacgtatggaaatgtttgagcacatcatcgaagatatgatatttgaggtaaagttaaataagtatagtttggataaaagaaaaattaaaagatgtattcaagcaggcaagataggtttaaatattttaggagaaaaaaatagatgaactaaataaacattcctgaggaaaaaatagatcatgtattgttatgcaggtcaattaaaagctctttcagagatggctagtgaccagtgtagaatcttctctgccttcattattttcatttgtaagttgggaccaataagcccaaccttgtagagctgtgggaagagttattggagatgaccaggcaatgtcctgaacatggagcttcgagtgtgtcttgctctcaaaactaactcagaaggagaaagtgtgcagggttaaagaacagtaaggatgtcagaaaaagtcataaggaatcatagttttagctatttgcctttaaaaaccaccacaacaagaagccctataattatatatatatcttaaattaacttttctcatctgggctgttagtgttccctccaagagtcaaagacaagatcatgggcatgggaagccctcttttgagttgttgattaaggttgtccaagagattttcaaaacacacttatgaactagaactgacctgaatgcctccttccagaggactagcttttatggtaccaaaaggtgtcatgtaacgaaacgttccaaaagaaggaagcaaccatcagtcctatccagctgcacaaaaaggaccagaaggcacagtagcccgaaaggtcaggattggcacacatattgtggcttcaaccaactactctttaattagtctcaagacttgctcaacaaggtggaaaccatgcctggcactgggaactagccagctactcagtgctagtgaaatcggggctcttggagtaaaaactacaaccgctactttactaagccagcttgtccctaatcaatgctccaagtatttgttgttacacctgcagatgagtgtagtcctcatccctcatcaagaaaacttctctttgcaactgatgggagaccactacagaaacccacaaccagtcaaagtgcaagtcccaccaaaaccatgactgcctaaatgggaactgagcaagaacaagatccaaagtagatggcagcaaaacctcccagcctaaccctacacaaaaactacaggcaactaaagaaagctgagtgggggggaaggtctttcccaggcaaggatgtacctcggttatacaactccaagtgatcagtcttgaaaacctacatacaagtaacattatacagactgagcaggttgtatttagggatacacacacacacacacacacacacggcaacaattaatgaaagggggacatacatttgaaagagaacaaggaggttggggggtgtaatctttaaaaagattacagtgagcgagcacagtgagttggggccaggctggagcatgttgtacttgctgtgcagaagacgtgggactgtgagcagtggggtgtgtttgtcaggtttggaagagctgtctacgtgtgtgctaaggactgcttagaatcgtatttcccgagtgctggggtaggcatggtgactggtgagcgctctagctgattaaatgtgatacagctgtgctgctcaggtacagggcacctaacaagccacacaacaagtttacaattctcatgagctggaacctctgccctcgccagctgagggttctctgctcagtgttttcagcttcgctttgtgtttaaaattagtttcagtcaaaaattgaaattttgaaaaatttcattttctcttcaatttttttttacaatttttttaatcccagcactcgggaggcagaggcaggtagatttctgagttcaaggccagcctggtctacagagtgagttccatgacagccagagctacacagagaaaccctgtctcggaaaaaaaaatcttgacaaaattttctgttgcttatggggtttcttcactcattttgtctcactcactatgataaacgctatcaaataagattcactaatacttctgcactttccctagtctactgttatcttcagttaatgggaattaatacttactttttttgttgttttcatggctatactgttcacttttcaaataaagtatttaaagtttaaagtgcagtaaacaataagagatttagtagtgtaaggtgattcagagttgctataggaaaattgaggtaattttggatctaatttctcaccaaaattaaataagtcacgctctgcggaatgaatactgggctgggcctttgggtctctgctggctatagttaagctccccatgtgctaagtggcctctcttgttcagattttcttccaaagcccttgaaagtgaggtccagggcaaagcacacaagttatgctgtgtctgggatcagagtgcgctgcccatccagaccttggcatggaccagattctgatgcgtcacagtactttttctttgtagggtttcgtagaagaacttagggaataccacagtctactatcacttacataaaacacatgtacaacaatacatttctataaaacccagcaaaacacccatggtagaccgcattctctgttgtgtgacgggattgctatatgaacaatggcatttcacatgttctttgtttggggtgtgtttttcttttttaattatttttctccaccactagaatcagtaacaaagatggaataactagagtgtactgaaccacattatctaagaatgctgcaatctcacacatagtgtaaacaacttatcaattggtccccttgttaggattcagtcagcttatggtaaacttgcctctgcactaaccgtgcgcaggttttgttgatgctgctgttctctgaatactgtagagcaagcacctgcatagtgtttgtgagaggaatttagagatgactgggaacttgggaggatgtcctacacttcataccacgggcctgagcctccgtgtatcagtatgctgcggagtctggaactgatgagcctctgatgctgagggatagttggttacggtttcccagactcggttagaattgatactaaacatatatcttacctcatttattttctggcacagtcttgcttgctatgtagatcagagaggctagcgattccgttacggcatccttggtgctgaggtaagagatatgccaccagtccaaaggtggcatcatgccacctttgatgtgttgctgtgtttgttcacttgtatgtgtgtgcatgtatacatacatacatggcgtgtgcctgtgtgtatgcgtgtgtgtgtgtgtgtgtgtgtgtgtgtgttgaagagatggtagaggaaagctcacctctgctcccatgcacttacaaaattgtctttttttatattcattcagccacttgcttttttgtaatcacttgataacatttactcttgttggaattcactttgaagtgaattttgcatttaattgtggtattttatggtacttgcaacattattacatttgggaaatgaggtagaaatcctacaggcaagcaagtaagatgattttttaaaaaaattaactcagttttattgaccctgcattttagcatgcatctgagagtacttcctgttagcatccgcatctgagaatacacattaagtaaaactagccaaccagagaacaatgcatttttgggaactaattgctagtgatgactgtttcttaacccgtttctttctttctttctttttttttttcatatttaacttgctaatagagttttgagggtaaaggccctacttccactcagtcaacactctaggcacagctacccatcccactacaccaattaaggcaagtactggggttggggagatggctcagtggatgagacttgagtttggatccccaactgcataaaaagctgagcttggtgctgatagcctataatccctgtactaggagagagagacaggaggatcccagaggttccttggcaagccagtcttccacaagatgagctccaagttccaggagagactttcaaaaactaatttaggaagtactgaagaaggatacccaaaggcaacctctggcctctacacatgcacactcgggagcatgttcctgcatacacaaatgcttacatatgaatatactgtatacttatgtgcctacatgcacacatcacacacacacacacacacacacacagctcataggcaggcaagtaggagagcaatgtccagcctgccaggctttgctcctcctgaaatcaaggaggctcaagaggactggggaaggccattggcttatttctgtgtctttagctaaagtataagtacagaaatgcagggagaaacagcagctttcttcaaaactcaaataaggagttgatactttttagccaaagcagcttctctaaacctgtgtggagccttgatttttaccagtttaatcaaattatttactgaattattgtataaactattctatcttctttagaaatctatcacaggaagtatgtgatgagtagataatttgggattaataatttatcactgaatatttaaaatgaattttgcttaaaatataatttgcttgactattttgagtgaaatgttgtgataaccagcgtgtttgaagtatgtgacattgtgctgtctgtctgtgagacctgcacatacatgttaccaggttattttttatttatatgagtgacaattacaagagaaggaagtctacaatctgggcttgtgctgatattttgtccggattaggactgagggatgattaattacaaggcattatttcttgtcaagtggtgaataactatgtttagcttgggtatcgctgtttacaaatgggaaaacccacactgcttgccaagcagttgattaaaacaatgcattcaattcatctcatactctctgtaggagagatctgtacatttgtatgggttggcacttagtaattaaacctctttaaacattttaattagacttcaggccacccaaagccctcctctcatctggaaaacacttttagatatcagcaaacacaaaggtgtgggcaagccccagtcatttcccttgagcctgaagtctggagcagtgtgcatatagggttttgttttgttttgtttcctatctgaaaagtctgttagaacacggacttttgagccttactttcaaagaacatttgatctaggagttcatcataaaatgtgcattgctcactagttccaagctgatataggtagatgtttctggtccaggtaacaaactggagaaggacagtactgtgggattcagttgtgggtggagacctgattggtctttatttactattttttgtttgtttgttttgtttatattcagttcatttcctttttgttaagtctagcctgtgatttaagactcttcgtgttaaatattgtgtgatactgttctctcatgagaaaaatgcaaactttgaggggaaacggcacatagaaactagatagtggagctgtgtttgtctggttgcatctctcttcacccatgctaggaagccatttgtaaagttgtttttcttggcgtgtttcatacccaccctgtcttccctagaagtaagcattgtgaagcgattgagctcttgcattctctggcatctagttgtgtcactgcagttaggtaactccaggtcttgggcatctctactttctaacgataccttaaaatttggtaccctcacacactgttgtcatgtatagtttctgtgggtcagaaacgcaggcacagttagctggattcctctggtgaaggtagatcctccttgggtccccacattgggtgccaaaagtatcaatatacaacaaaattctctcctgaatgacagtaagaggtagtttattctcagccaaatatgagtggttatagcccagagtcatgaattcaggacaccctgagagtaattgcccaaacttttatagtcacagactagaaagcgtaactcctgacatttgtcatgagatggacaactcacagcaaagtgacgagatctttgcttcaggtttcagatgttatttgatgacattctcggtttggggaccagtgtcagaagtctgacatgttaacatatcccaactttttcatctgcctcatctttgaaaggaagttagatgcataggtagacaatgaatgccgacagcaacccaagatgattttaggtctagattgaaactctctgtattcaggaagttttaattattattctatcttgcagaatttttttttaaagtgctgcttttttctggaaacctccatttacaaactccagtagttctgtagtgcaggatcagaagtgatcacgcatcaagtctgcatgctctgtttattagaagtgaactaagcccactgtgggagggtcttgttctgatgttgcccaggacagcctcaaacccacctctaggcaaatactgactcttaactcctgatcctcctgcctctgccgcctgagtgctacactttacagatcaatgcagacctccacacttgggccttggcctgctttgtaagatacagaaaagtaagttccatatctggaagacagtatgaaagaatcgatgaacaaaccctcaagcccatcactatattagcatcactttcttctgtgaaattggtattttacagagatttcagaggccttaatagtgggtactcactttggtgactgttgcaatctttcactgtgacagtcccattcttaagatttacacagttgtccaaacttcctgctgcatgagcttgctctccccactgagtttgtattttacacaatgccgtatcacaagaacatctttttatttaagttgtggaaatataacatgatcatgaaaattgattatgtagaagtgaaaatataaatgaatctgataatcctgtgatgttcatcatcagtgttcatcaattgtatcaccaagtacagttcattcaaggatggctattttgtcaggtttcttaaaaattatcattcagcggctacagagatagttcagtagttaaaagtcctgactgctctcgcaagaaccaggtggaattctctagaactcacatggtggctcaatcttaactccagtatcatgccacctcgtgccttcttgtggctcttgcatgtgctaagcacacatgtagtgcagttatatttgcatgcagcaaaacacacatatacaaaataaaacttattttctaagttgtgattcatttagcaagtgagatcttgccatacgaaagcacataatacttagactgggatagtatttacaaccagctgtctctcagatggcccttggtgactgataccatatgctaatgttcacattcttatgaaacccctgccattgcttgtggactgtgtctatgatccacttgtgacatgtggagaggaaatatttcataaagcctggcatttctgtcatgtgggctactgtctgctttcttctaacatggtaagttttttgttgttattattttgtgtgcttatgtgcttggttaaatcctctctctgtcctcaaaaatacactaagaaggattacgcaagatcacatgatggcagccatgcctttgcacattggtattgcagggtgtagtgtgctctagttcagcctgtcccttctcagttaggatagtatcttccctctcagcagagaactgtttaacaggaaacagaacagataatgtatttcaattcacatcacattggaaaacattatttgggaaaaaatattgtacatttataattaaatacaaaagaaatataagattgttattctggatcatataatatttaaaatgtacatcacttaaaattaagaaaattacatatttaatcagaatcagtggttaattttcacgtaccacttacaggtgactaataacctataaatgcacactaatgttagtgaagacaacttaatgaggatccagtaataggcaccagctttcctagccctcactgatgattattttgaaggctgaaggttctagctagtgaagatttttttcactgtgagcttctctactggtgggattttcctgaatggctgcgacttttctgtagtcatcctgctgggctaactttgctgttcagcccattcacatgtgaggtgctctacatgtcctcgtgagtctcccactgagagtctgcgttgggacactgtgacctgggtgttcactaaaacgttggtgagcaggagcatttacattgcttttagctctttgagatcatgtgctttcccctcagcagcaggagtaaggaaagattcccttttgtatgtgtgtgactctgtcattagaggtggtgttgcagttaggaaacagatcagtctttggagccctgtgtttatagaatcacctaaagcgctttgctgagacttcaactcatccatgtctttttgcagtgctcaaaaccatgcctcgttgtttatatctgctcattttagaattgataagatcggatgagttattttcccaagtgacaaatatatgacttcaaaatataaatctttgtgctgtctttttacaatttcaaggagcacatttggtaaaaggcagatgtatacactctgaagagaaaccagagtacaagggagggacctcatttggaaaactggtttcatatgtgtgtgtgtgtgtgtgtgtgtgtgtgtgtgtgtgtgtgtgtgtgtgtgtgtgtgtgtgttacagaagcaatgagagcctggcctgatagcctaaaactcaactggaaatggacactgcactgtattaaatggtattgcaaattccactggactatgtatgtgtctgtccccaaatgaggttattttaagtgaaaaagttgaggttagaaaaaaacctcagtggttaagagcacttactcctcttacagaaaattcggcttccattcccaacactcacaaagctcaccgtccagatccagtggttgactctcctggcctcagcaggcactgcacacatgtgcttgtgcacacccccaggaagaacattcatacaaacacagagctgcaattgggaagagcttccttgtcagtccttattatttcaaaaactactactttcagaatccagtttcccctttttattaaaaaccaagtcacaccataaaagagtgtttactggcttctacatcactgcagccagggccagggatatgaggacgtgaagtggggctaaataacacattcttttatctgtaagagactgcacatacattctccccactgggccctcagagcttctacagtttgagctgtgcaataattttgtattttcactttctctgacttatctgacgtatataaataaaggccacaacttgctttagtaatcaaaaacccattatcgcctgtggcggacatgaccattaccaccattagtaaccgttcatgttactattgcatgtttttctgctccatgccaaagcagcttgggtgtgaagcggaatacctggtttgttaccttttaagtgttttgctgaaaaggaaaatgatttaaagatcctggcatcacttgctccacatctccatgaccattgcaaggtagggctcagcactcgcaagtatatggggtctccttaacatcagggcactggtctggaccctctgtcagctacagctcctccacccagtgctgagaggtgagtgttccactggacaagcaagaggaaaacttgtagtctttcctacaaaagtgagaagtacagataaattatttacagatttttgtttgtgttttgttttgagagagtttcttctgtgtgacctagcctgaccttgaactcacgatcctcttctcttagcctctgtgtattgggaccataggtagtacctggctggtgtatattattgtactcttgttcactgttggtgaaggactcacccaacaactggcaggaagagtgcacaggcacagctgacatggcacataagcttctcctgggtggagaagtgaattctcttcattcatacacacacacacacacacacacacacgcacacacacacatatgtaaaaattaatagacataaaggaaccggtcctgttaagcctttcctttatgtttagttgactactatcccagccattgtaaactgcatcaccctccctctcctatcccagtgctggaagatagttctagctcatttttattgggcccccatacatgtaatgcatatatgacaatctagctgtctaccctcagctagcctcctgtttcaggttcctgagagctaaaggaagatatgcaccttcatacccagaggttattgtagtcttaccctctgttcacttcctttcacagattcctgtgtagatgcttgggcattggcctttcaaagagatttctactaattatttctttgttcgatttgcgtatgcagcaagtgcgtatgcgttcacactggactggcatgggcctgcaggatcagtgctccccagcttttcctttccaaggactttgtcaacattgagtgtgtgttctggcatcttggatttgccctggtgggttatttttaataatgccaaaagatacaaaaagcctttacacttaattaagccagttattaagccaacatgtagacaccagcaaagtgactatattctcacaggaatgaattaactaggtatcactatgcaaaagaaattccctgggattttcttctccaccagtaagtgctagtcttctggctatttgagggtttgcttcattaatgcaagaggcagctctaccccacactcactgtctctgcagaccttcattctcttcagaaagaagtagccttccttccccacacagcagcttttaagtggaggtcactgtaccttcatcgtggcccctcccgctttcttctcctggtccaaagcctccatctcacccactatcattttgatcccttgatctttgttcctcctagctgaattcttaccagaatgtcttcctttcaacctcctattaccactggtggtggaataagaatagaaaccttaacagctaaacatttcctagagccaggtgtgatggcgcacacctttactcaggaggcagaagcaggcggatttctgagttcgagaccagcctggtctacaaagtgggttccaagacagccagggctatacagagaaaccctgtctcgaaaaaccaaaaataaataaataaataaataaataaataaataaataaataaataaataaattcctagttcactgagcaggtttagggaagccatctgaagtggtttctctggaaggtaacttgaggagtttaaatatggtacggagtgatgtttactgcatgatttttatagcagcgcttttttgaacgtccaatagagaaaatggccagaaatatatctggcctcaaagtacagcgatggaaggccagacttggggtggaatctcacctgttaagatgggcctaagataccaggaaccttgggagacttcactcctctctcagtgccattcaagtcagtaaacggttaacagtccctgttcttttaaagaaaatatcttattagaatcttttgcacttgatgcccaactctagcccctaagcaccctgccaccctgagctctaccaaagtctctcccgttccttttaaaactatagttttgatgtcttgcaaaggaccgtccatatcgaaggcttctctgccttactcttgggaagtcaaaagctgagaggttgttgtatactctttatttctgcattcttaccacgtccagtgcagtagcagggatggacctgtctggggtcatgatggcagacagtcaagacatatggactcatggagatgttgggatcaggtagcctgggcttcctggagaagctagagtaccctgaaatctcgagtggttgttctatagagttgaacaggattccatagagctgaacaaggaggtggaattattactatacatggataaacaagaagatggggtttctagtgtatatctaggtcaaggaaatagctttagctaatgtcagtaggggagcagtctctgtggagaggagcagtcttcatgccctaaataccttggggagaaagccacggtggacattttctatacacactatcaaaactagcatttggtcctctgaggacaacttcactatgcccctgagcctgaggctctcaggacttccttgattttaaagcccttctcaagtcatgagtctaagacagtaaacagcctaggtcttgagccggtgacctatttgataacccgcttgtaaagggtctaaccttgaagttatcttaaaatcccatcttacagcaatagattcagcatcacctgagaattggtggacagcttttaaggaaaagttagttttgctaaaatgaaaacctcactaatagcgtagagcatgcatccgtgattgctgtgggtgactggaaccattgctaacaatcaggactgtattaaagaaaacctatcctgtctacctattaatacatacaattctttgttcaattctggataaggccagtgggtggaaagagctgcattcatgaattgtacttaatgtcattttattatttttatgcatttaaagtaaggcgaggacacatggtcaaaatgtcttttgccacctattctaattaacagaaaaggatgtctcatggttaaggaattgggttttcataatagaaatgttttgatgttggagaaaaatgtgtcttaagtgtgttctttacaatcttggtctttttttacttagcaattcctttttcttagatttagcagatacaaatttcagatgagtccttatgcacagtctgaagaaaaggttttgaaatgaggagtgttagttctttgttgagattatattagtattttgagaaataattagagcagtttttcagccagtgtgtccatccttgttaggtatatttgctgtcaaatctgcttcggacatcatgagactgaggattattgaccctggttcataagtagtgagataatgggaactgtaggggtttgttctatttattagctagctttattacctctagagaaaaacgtacatgtgtatgagtatttttgcttgggtgtctatacgggtatatgagtgtgtgtgaacatccaacttccatatcttgtctttaaatccatcattttccacttttcttttaaagagtaaaacagatagacaacacggtaggtgaaaatgttctctgcactggacaatgatctgcattcaaccttaggaacccatgtagagggaggagcagagagacagctgactccacagcgtcctccacccacctctgcttgagcataccccatgacagtaatacctccacattctaaaactgtaaaaagagcaagtcttgagaaaccttttctctttgttcttattaatgtctactgggattgggtttaagagggtactccataaaggttccaggtccttgtatttcagaataaagaattagaaaggtcagtagtggtaggggagaaagagaggtgggggagagggggggagagcaacttactaagaaagactagactcccaaggaaagcacaggccaagtgggataaaggttagaggctccatggtcaggtttggtgtagtcctgcatacagcttcatacactgaagtttccacctaagggtgtatgtttcactatccccatgacctgaagcttcctctccagtgagctggaatccagtgatccaggtacttttcatcagtccagaggaagttatttctagctgagtttttagaacttgttttcttgctgtgcggattgtgttaaggatttaagcaggcaccattctcagccactccccctgctgaaggtgaattcttcctgacatttgtgctatgcttagaaatagaatccttctcagaagttgtgcctgtgtacttcacgaaacacaattggtaaattgttatgttgtatgttgtatcaaggcatgctagaattcctctctgactgcacattaaactcttgagcaggttatggtggttaaaatagttgatctcacttatcaactgatgagatgtagaactgcctgagaaatgactctgggcctgactgtgggaggtgattttagctggattaactgaaggtgttgggctggtcttgcagtatatacaaaagagaaagcgagcatggcacaagcatccatttttctattcttcctgattgtacggcatgtgtccaactcccttatgtttttgatggcatgactcccctgccatgatgaactctaacatatgaaccaaaataaaatcttccttcccttaaattgctttatctttatttttttttctttatggtgtgcatgtgtttaggtgtcaaggtattcaaaagaattaacaaagatggttaatattctgcaggtattatatagaaactgcctcttttatttgagaatgataagggagtattgtgatgcccaataaggatttattgtatttttcatattaattgcggttctctagagaaacagaatccatgggcgtagaaaaagattgtgaataagttattgaggcccttgattatgaaggccacgaagccccactgtctgtaggctggggacttagaaatctggtggtgtggtgtggtgtggtgtggtgtggtgtggtgtggtgtggtgtggtgtggtgtgagggctgagagcagaaccttggcaggacttgcatgacatctgaagtgacaggaatgtaagactgggatcctggacaagcagtcagacagggcagtattcatacctttacctttttgttttcctgtcctcacaggcttgtctgattccccaccctaattggtttgggtggtcagctttacactggctagtgcagatgccactctcctccagaaggaccctcacacacaccctgaaaatgtaccagatatctgagcatccctctgtcagtcaaattaacacataaaattaactctcacacttagcaaaggtcattaattcttgggataattaagaagattgagtgggtccactgatatgaactagatcttgttttatgttcccagaatggtgctaaatacaagatgacagcatcaaatggcaatagtaaactctgtataattagaaagataaaatgaattcacgagctagttagaaagccatgcatcatagtaatcttatatcagggagtttgataccagaggatcctttaatgatttagtgcttctctggctaaagtgagggagagagataactttgggccaagaccttgttttagggtacagtgaatgagcagagacctaaaggcaagagatgtgttgggtggaaggaaggaaggaaggaaggaaggaaggaaggaaggaaggaaggaaggaaggaaggaagcctttcaggctggtgctcctttggaaaagagcactgagaagattgtttaggttggagaaaaaataacatgggaaccaaggtatcccactgagtatgaagtggctaaatcactgaggtcaagaaagctctttcctttctgtatctctcctttcctgggtcctaggatggctcatctggagtcatccgtcctgcagcactagtggtgagggtgttgacagggatcagcagtgattagcactcgctgagcttgggttgtacgccagctcttacacttctgtgggtgagtgcacatcaaggcagtgctagtatttatttcacagccaagaaaagaggggcaaagaaggcacccctaactggcggcccacagccatacagcaagtgcgtaccaccttaaaacctcatcctatatcccaaaatacttgtattagctgagggcactgagtgggaaggacagtaataactgtagccactccccagggcgataatgggaattacatggaatccttgagaccgtgtgaacagaaataaagacatcaagatgatcatcagactagagagaaagatgtgctggggctttatctccactccatccctgctcttcttttcggtgggctagattctcccctcgctagacattgtagagattgaaggattatgttctatgtaaattaaaagactactccaggttggtggtccacttttcctcagcaacaagagttcctgagaggccattcattggttggttggttggttggttggtttataagtgaaacatcatttgctcttattactgagccaattcttaaaggtcaaaaacaaagaaaacaaaccatagaatctgtccatccctgcagtttgaatgtgtagtgtgcttttgaactttttgtgttgatcacataactggctgtaagtttggcatgtccttagttgtcctgtccaaacatagcagcatagtgattggtgcttttagttaaattctattgaatgcttgcttcttagacaacgttaacaaacgtggttatttcctgatgttatggtaggatgctagaaacttagcctctgagagccaggtagggctacagcctctcattcctgttttgcatttacttgctggacttgcagaaacttaattcctaactttgaagtaggcctacctgggtaggatgcagatctttattgtttttttcctaagactatgttatctgactcctcaacataatgcaaaatagtcttttaattagatttttaaaattatagtctatattatgtaaaaaaatgcaatttgattcagagatgtgggaataaggtcaggacaacagaaggctacagctcagagctgagcctgatatacggaagtggtgggtctctaagtgtggtaagagttgttttgtggtggacaggagtttgggctaagggctcccatagtcatagattgtcatttctaattagacattaggcagctgtaggacagaggacaactttctcacctcaaagccctctgacattgacagtgaacttcttgtaaggatagaatcccaatgatgtgctcaacataatacctgacgcagagtgatgcccttagaagttacccaaatcatcactgacacacgtgcctggggtaaggccaagactgctgctgtacagaaggaccaatccttgtagtttccactgcttttagaattgggaatatatgtgcatcagcgtatatgcatgtaaggaatatatatgcttctttcttctttgcttttttaacagtcccataccttagccggattcttgattgatatagaaaaaggaccatagctatatacatctttttccactaatttatttatttcttgagtttacatcccaatcacagccaccacctctcctcatggtgccccacttactcagccccttctcctctgagaaggaggaggcgctcctgggtaacaccccaccctggcacatcaagtcactgcaggactaggcgtattttctcccactgaggccagacaaggtggcccagtttggggaatgggatcccagaggcaggcaacagagtcagggtaagcccccattccagttgttggggacccacatgaaaacttagctgcacctcctactacatgtgtactacatgtgtactacatgtgtggggagggcctgggtccacgtttgctctttggttagtggtttagtttcttggagttcccagggatccaggttaatttactctgtttgtcttcctttgggatccctatccccttggggtccctcaagccctgtgccaactcttctacaagactccctgatctctttcatctaatgtttagctgtgggtttctgcatctgtttccataggctgcagggtggatcctctcagaggacagttatgctagactcctgtccgcaagtgtaacagagtattaataatagtgttagggattgctttttgcccatggatgggtctcaagttgggatcaactatattcatagcagctctagagcatccatcttctaagtggagtagtcagtgtggaatcctttcacccttcagtaggcatttacttagaagggctggcagttttactatgtagtacagaggcctctcactctacacactcactgtactgtgtcagtggtgcttctctcacccccttgacacttgtgccctcatgttccctgaagttggagataagaactataatttgctaatagcaggttaaattggtttttagaaagcattgttctagactttacctcctaacatataatgatcacacaggtattgaactactaaagaaaatctcaaacaacaggtcaatgcattttgctcaaggggcatcaatctatcacctgcctgttcgtgtcccagccttacattggttatgatctcagacttcattcaattgctgtgtccttttctgaattcagagcctcaagtaagtactctgtcattccgacaagttggtttctaggtggctataatagtagttccagctgtctcagggagccttgctctctgcctatagttccctctgtggtggttaatctagatctatttccttttcctgctgtttcccatctactctgaatggcctcagtaaccatctctaagtcatcaccaactagtttgcttgttctgagacttagctgatgctatagactactggcacaaactgggtcaacaaggatttttcttctcattaacatctgtcacaagatgtgaaacttgaagacccactaagatttgatgtaagatgatttgtttcttgtgacctcattagctatgttaaagcatatccaggggcagacgttcacagctggaggagcacagggttattctgtggctcatgatctggccttggcatatcaaaatcaacggcagagtccgatagtcagcgtcacatgcccactgcagaccacgttctctgctcctgcctaatgagcaagcagaagatcctctcaagagggaattctaaatagagagccatgtggtcagaccatgctggcctggacttccaggttgctgtgtggtatggataattcttctggaaattcaagataagagctcttgagatgtcttaatttattcttctaaacaattagtagaacatcggatccttggtatacttgcagaacataaaaactctgtcctcttccttgcatggcattttctgctgtcggcagcttattagttgctgggtatgtacattgcctgacacagagtttgtccttggagctggggtacagttacagctcacacatacttctacagaatagggcagtagccacccaaaggcagccttaagtggcatatggtagtattctctgtctgatgtttgtgtggagggttttctagtctacaacttatttgacactacacagctatgctatcatggatgcatttctcctaacagtcttcccaactagatagattttttttttctcactacctttcataagcacaagttctatggtgattccaggttgtacattgtgggaagccacatgtgccattgcagggtggcgctggctaccgctggccaccacgcatacataggcagtaaagttttttctgccaagatgaggttttgagaattaaccaaaattaaccaatcagatgagagacaagttaaccaatcagatgtaggcatgcaaatgaggtggtaagcataacccatgcacaaccaatccaggtgtgagacacgcctctcctaggtctatataagcagcaccagttctgggcttggggtctcttcacctctgcaatcaagctctcccaataaacgtgcgcagaaggatcctgttgcagtatcattcttgctggcgagtcgggcgtgagcaagagtacattcctgtcctgtaaggatcaatttgtgaatgattataccacctctccagaggcagctctttatcaaattgatgtgagctccagttagcagaggccaccatgccagaaaggatggcttctgggaagcagagataggtttgtaattctggaagtcttcaactcagggacccatgctctcccatggctctagtgtgtgtttgtttgtttgcttgtttgtttgggatagagtctcatgtagactaggctagccacccttgtatccaggggttgccttgaacttctgactctcctgcttctattgtatctgagagctccatcctcagtctctctcccatggctttgaaggaagggctcttgcagttatgtttggcaccaactacattcaaagaaaggcaaagttagggacatatggcagccatcactgtcacgtggactaggaggttacagcagcagttatcaatctagtttgacagcttaacacaacaatgaaagcatttgtaggcagactgttgtgtgcctctttggccattaaatagctgtggaccttgtgacctgttttacctctgtggctcagtcttctgtctgtaaaaagtagtggtcattagagttcatgagagtttggtaaggaacaagtgactcctcgaacaaacactgtgtggcagtgatagctgacagttagcctctgctctgtttcatcatactgaattctggaaccagccctgtagagtgcatgttcttctctccatctaaaagatgcaggaactgagctccaaggaagctaactaatccacacttctagggagtggcacaatcatcactttcatttcaaaggtcaaaatcagcctactgcatgggtgaaatgttacagcccctctgtgtatctctgtatgtgccccgcctcttcttttaaccaagtattcattgtgctttgcagggggtttctgagaatgaaggtaaagggcaactgtctgagtggttagtctgaacagtggaataagccacttgcacagagacaagtttcagactctagcagcccgacctctcatgccctgtcagtgctaagatcccttggttcaccgtctccttggcattcccacactctgtaaagtgcctttctcctcagtggagatgtgaagcctacacagctgtgagttttatgttaaattgctcagcctttgctcttacagaatgaaataacctcagaatcctcccaactattattatctaagccttactcaaacatcagatttcccccaggactgggaaaataaatgaaggggaaattagatttttatctcttctcctatttttagttttgagaaacttgttcagttccttgttcaaaagaattgtgagcatcatgccccaccattattaggaatgtgttttacactgagtgtgctgctgggtaaatttatatgcattattctatgtttgaggcaaacgtttggaacttgttaggaataaattgtttaagggaagaaaatcgcaagtgtaccatttttcctctctcccttgtccttgtttgacaggcagaagtgataactgtcccaaaatgagatcattctggtacttctcagcattgtgcttctcaaattatatctagtgtattgtcaagcaaaacactgtgggaaaggttaacaaatgtgctaagtgtcctgaatattgatgcattattggtagagcatcaaagagttaaggctgtactgttttttaaagacaagaaatttttgctccggatttttatctttcttattctttgaaacttactcttcagagaatcaaaaaagctgtcttcattatttctccccttcctattcacaagggctccatttttaagtagaagaaatgatgttggttctcctaccaggaccaacactgaattacactggcctctagtggatgcctgtcacaattaggttctgtgttgattgcttttcactataacatgcttttaaacttaggggaaatttatctacaatagcataatgataattccagggggaggtcagaattgatgtcaccatgaaagttattaaactttgtatgcgtaactccagacttatcaacacacttaacaagcttagatcatcttctgcagtctttaaaaatggagagctgggagagggctctgtagaataagcagtctcagttctcagcaccagcaaggcaccttacagtgtctgtaactcccactccagggctcagtcagtgtgttcttctcacctacacacacacacacacacacacacacacacacacatatgatgtacatgaatccgtgcaagctaatacacacactcacacacacacacaaaagtaaataagcaaatcttttttaaaaggagtgaaaacaaagagagaattctgcagtatacatgtaaattcatgttgtactggaaaaggcaatcctttcagaagtattccagttactcttctaagagaaagaagacactaataccaaattctcttacactgttcatggttccatttaaacagaaaaacagatgaagtgactaacgtgaagcaaagcagcctcaccatggcattttcccacataaatttaaggcaaccatcctgttgcagaatggtgaatgcccagcaacactagcatgtgcagtttggtgcatatcaacgtaacacagggtctgcttcgactttcaaaggcatccatgagtgacaacactcttctctcccttgaccgtgtgccatacaatcaagtcctatctatattctcttagaagaactacttaactctaacttaaaagactatactctgcccacccaagtcaacagcatagccttgaattacttgttgattctgcttctgggtgtcttaagcagtcatgtaagaaactagccaggttttggctcgtccaaaattttgtctgtctggagctgaagggtctgcttccaagatgactcactcggcagctgatgagaggactcagtcctttgctaagtagaactccgtctagtgcctgcaagacctgaccatggtttccctcagtgtgagtggctttaacttggggactttttccagctttgtgtgaagctgactaggtgccacctccacctagactgtcacaagaagcacatcatatcttgactgtgatcccactagagaagaaaaattaaacaccacacttttaagggaggaccactgagaatctctgggcatatttgaaataccacatttgtctcaagtttaaccattgtatttgaatatatagaaagcactatttaggctatggtaaggatttgagccaagttagactagttgagtaactgaaggtaccatggtgaaagaatgtgggacaaaataacctgatgtcatacctttgcaaccaggcaggggtgtgaccttgaatcatctgatatttctgtatgctctctataaaagttataaagtaattacttttcttatagcattttggtaagatttaagttaatacataaaaacaatacagaaaccacatacaaagtgcctggactctaatgactgagcagcctgggtagaagtcactatcttctagccagctgataagaactgtggcctgcatgtagctcacacagtgtggaagaacacattaccaatcacagtgtgtggcggaaactgagattacaaaaggcatgagctaggcaaaacagtaaggacctggagatgccctcaactgctgtatctgaagtgagaacttagacatgaccttcatggttaccttacaaagataagagaacttcagggcattgtatctctgtcaatccaatatagttctacttctaaagaagtaaaacagccattaaaactacctgttggagacaagagacccttaccgaaaaccacaactggtcaaaattcagagaacagttggctgtggggtgcgcagccacaattgattcatctctaacacagctccttcacctaaggcttgggcaacatcttggaataaaggaactcacacacacacacacacacacacacacacacacccctaactacacaaatacagcctgctcagtctatttagtgttacttttatgtgtatggtttcagagctaatttgtattgcatagccagttaggttcacattcctgggaagggaggactatcttccaccctcagcattccttagttggctgtttttatttatttatttatttatttatttatttatttatttatttatttgtttattcattcattcattcattcagccaggaaatctcctataaggtgtttttagaaataacagagtagctttatgcatgatacctcaataacatggctgcctaaacatgacctgaagaagtataccaccagtagacatgccaacatgaaaagggaaaatctcagaggaccccacccataaatagtgttaacctaactggctctatagttcaaatcgctctgaaatcatatacatgacagtaacactaagtgcactgcgcagcttgtatttgtatagttaaggaatgtgtgtgtatgtgtgtgtgagtgtatatgtgtagcagtgtccttaataggtgctactcagttcttgcaaaaaccacttgaaagctttagaagttagcttctgtttcctcctgcgtgggttgtctgggttctgatgccatcctgtagtatatgttgtcattgatagtaacagctcaatacacagcttgtttaacaaagcagaatactgtagtcattgagataaatgggaggctgtggaagtaagttcctccttcatccgtggtcacagagccatgctctcactcagagagcatctttcaggctgctctccatgttnnnnnnnnnnnnnnnnnnnntctttcaggctgctctccatgttgcccagggtcttcctgcaggcctgctgggaagccacagaggtttgtttttattgtgcccatcattcattatgctgaaaggaggatgtgagccaccttgtgcttggccttccttaggtgtcatttgtagctaagaaaccaagagaagctttttcggtgctgggaagctcgcttcacgaggcagggtatcatctgtcgttcataatggacaaggccaggaataatacatcatttggcttgtttgcctttttctgcctttaacttggttatagatgcagttaatgagcaattgtttcagatccttaactgttagccttctcccaagacctagagaaaacaattgctgatgacagcaatgttttccagtgccgataattttaagactgcttttgcttttttcttcttgtcacaaaactcgtgaccctcatttgttatacagagggtttagctaaacaaaagcattgctgtaagtcttccaattctaaagggtttagccttcacaatacaggaatttttcctaaattcgggggctagtgaagtaacagttcactcagctcagggtgtagaggagagcctatatttagggatgaactgataatgatggtgaggtttggggttcggggctctctctcatcctgaaatctaaaatgaaatgaagagaagtggtaacccgactgggctggtgagggaatgaagaaaggacaagcagacacgagcgcgcacacacacacacacacacacacacacacacacacaacacacaactgggtcaggtgaatggtgtttgctgctggagccacaccttctgcaccacaagcccagcacggttactgtatgctacacggaggggccagagtcagcctgcggggcctctgtagcctagcattcctcctctaaacatccagaggaagctacggttgctcgttcctgttcacactggccaatcatcagcaaatcctaacaagcagggggaaaggctttgctgatttcaaacctgacccatatagggacaggccttggtcctggtcatggctgtgccctccctgtcctcagtgcacattcactcgggaattaaggccacaaaagttgggctattggtggaagaggatgtgaccacttgcctttgaccctgagagggaatgagctgtgtttcgttagtagcagactgtggggaatgctttgccagcgtaatttgctcgtaatttgctccagatacgctgtggtgacatttgctgaacagctgagtaaatagatcaatcaggcttccacacaacaagttacagcaaagttgacagtgatatcagtaatttcagagtagtgtcttcagtagaggatgcttttttatgacaggaacattggatgctaaaagagcagcctggtactgcggtttcccctccttctagtggtgcgtatgagcccgtgcgagtcctgtctgggcatctcaaggtaccctccttccccagactcagatggagtgttggcctccatcagtactgttatttgtttcatattctgttaataaatttaaatttataacccgaaacactgttaatatcagtggcagtttttcagtttaagactctggacttgggcttgctataagagatcattttattttcatgaacaatgaaggaattttaggtattgcataggagactggttgctaataagagatttgttattaaactaaatttcacaaaaaaaatacctgtgagatttactataaatgcaataatatgggctgaagagatggctcagtgagtaaaggtgcttgctgccaagcctaacaacctgaggtcaatccccaggatccatatggtgagagggaagagctcactccctaaagttgtcttatgacatacataagcctgtatgctcagtggaagacttggtgtcaagagaataaggcagaggaccatagagaaagagcccgatgtcctcctctggcctctacctgcctgtgtgctggtgccagtacccaccacacgtgcaaccaggcataccttacataccatacatacacacaataataatcttagcagaaactttagaagaagtaatctgtaagctgttggggttttaagtagacacaattttcactcttccctgccaggtattcatctgcttggtgttttaataggagttcctatcaagacattgtttttccagagatctgactgatcaaactgttttatctgagcagctgtgtgaacagtcacagtcgtcacattccaccttcatcttgcattagacttgttatttacagaaacagtgggttttgctattaactaaatttatcttcatttctctgtgctgtgaaatgtgaatctgtgcaggcctaagttttggctctgtctgcttagctattttttttaattgatgtcagtcatgaataaagaagaagaaattacccatagaagtaattgtttttcttttcttaggaacagttagcctgtggaggccattatgttgtggggatagacagatagactgcctgtttatagattaataaatgggtccttcaccaagtttccagttgtgtgagtgttttctatatcaattccccagctaatggtgatggagtacacatgttcacattcatcaaggtgacataagtctgagatgattggacaatgttgttcacaaagaatgagccaataaatattcttaatctgtaccagtgtagctctcatacaaataaaatatagcgttctagtttcatttctgttgctgtgataaaataccctgacaaaaaggaaggaacttagaggaaagagtttttcagcttacatttctaggttattgcccatcaccatggggaagtcaagccaggaacctcaaacagctagacacctgacatccacagtcaagagtggagagaaaggaatggaaacatactgcttgcttactcatcttcattttccactcataaagttcagcacccactgcctaaggaatggtgctgcccacagtggtctgggtcttctcacaccagttaactaagagggttcatcacagacgtgccattaggtcaacccagtacggacagtccctcattgaagcttttcttcgaaggtgattctaagttgtgtcaaattgacaaattaaaactggccatggattacagctactacttcattaggaatgactgttctccatgaaagggactaccttttacgtttggaagccatttttgttaccagaatatttcttttccttttgacctagtcactttctgaaaagagttaatgggctggaaaaatgattacttgagaatttgcagaagagtccaagccctggggtatttatggtcacatgaccacagtgtagaagtgaaggccagaggacaagttccagaaatcagttttccccttctgccttgctttgaggcaggagctctcttgtttctctcactgtgttgcaatctccaaactagctgacacagaagcttccagctaattctccatgtctacctctatcttgccagaggatggtggcgattgcagatgtactaccacagctaactttgtacatgtgctttggggattaaacccaggttttcaggtttttatggtaagacactaaaagtccattttcttaaaagtctatttcttgtgattgggttttgtcagtttgacagaaactcagacatatctgggaaagtgggaatctaaactgagatgataactccaaaaatgtggcctgtaggcaagtctattgagttaccttcttgattaatgattgatgtagaagcctgcaccaccacactgtatggcaccattcctggacagatggtcctgttgcgtaagggaggtaggctatgcaagagctgaggagcaaaccagtgagcaattgcccttcacatgccctttgcttcagtccctgcctcaagtttctgccctgactttcttcagtgatggactgcaatgtggcctataagctgaaataaaagctttccttcccaagttgtttgtggccattgtgttttatcacagcaagagacagttaactaaaataccatcctaatgttcatttcttaggtgaggcttacatgtctgtccttttttaaaaaagctttttacctattggtaaacgttgttactgtctctttgttcttctttttatgcctagatgactctgtggccaaattatacatgcagttagctcttacagtaaatattacagacacgccaaacagaaacccaggcattcaggttgtccaagtggtttttataattgtggttctaactctgatactagttcaaaagaatataggaagtgactctgtaatggatactaaacacatctgctttattctccaaatctctttctttttaacccaagcccaaccaacatacgtatgcccagaggaatttccttcctccttgaaaatcctttgaatagttgactcagccatggtttctgtgtttgctgacaaatggagaatcagctgtaggccatgcaggtcagggtattcttggttgctgtttctaagtgaaaactttctttagataacataaatttaacacaagtaggaagaaagggcatctctgtagatgaggctgaggtttttgtggcacagaaccacaaatatcccaagtcttggacacttcattagaacactcaagtaagcatttttccaacccattacctcttttcagagagtgattaaattagttagttaggttagaacacagagagtttatggagccgctcagatcaagagcccaagtcatttgaccagaggatgatgctgtttggggaacattacctagtgtgtgagtttagaattttatggtgcagcatttacattgttttctacctgttaagctgctgttcgagttgcaaggttgcctgtacctacatagtgctagaagtccatatgcattttgcttatatgcacctaacataaataagtaatgagattgttggtgcttatgtaacttcagagctgggcaacaactgtataatacagtcattttaactctggtgctcctcagacagtcactgttagcaggttggaggcctccctcacagagctcagatacagcctaatcatcattatcaataccaaacagccaattacaatgcatatgatcaccatgtcttcagtatttgttcagctaccttgttctgaaaatgagtattcattttctctctgaagatagatttttgtcattatagttttcttggtcataattacaaattaaacagtatcaaaggcataaatctcggtcagaagagggtcatcgggctgcacggaaggatctgcacgtcggattctccctctagctcagaccacagtcaggttttgaagaccaagatgtacttttctactgtgaatgctatctttagctctttctaaacagacactgtacttcaagaaactctgggaaattcttttacaaatgaacaaagcattttaggttgtagagagccaagctcatttggtcttccccagagaagagcacaccaactggctgtccagtgccgaatggtcatccctgagcacatacatgcaagtaacattgactacagggctatatttaggaatatacaagtataaacatagatggatgcagcaataattagtgataaaaagaggccatgaatttgaaagagagttgggggtgctgtgaaatccttggaagaagcaaagagaaaggaaaagtgtaattgttatttatgaattttatgctagattttattcccccaatacaccctctgactgttacatatcccatacctactccctaccgccctgtctacacgaggatgtccccaccactcacacccatcccacatgacctctaaacttcctggttcctccagtctcttgagggttaggtacatcatctctgattgaacacaaacctagcagtcctctgctgtatatgtgttgggggccttatatcagctggtgtatgctgcctttttggtggtccagtgtttgctagatcttggggatccagattgattgagacagcaggtcctcttagaggtttgccctcctcagattctttccacctttccctgattcaaccacaagggtcagcagcttctgtccgttggttgggtgcaaatatctggaaatgactctctcagctgctttttgggttatgctaggtccctttttgtgagcgctctatagcaattttatgaggtcccatttatcaattcttgatcttagagcatgagccattggagttctgttcaggaaatttccccctgtgccaatgagttcaaggctctttcccattttctcttctattaaattaagtatatctggttttatggtgaagtccttgatccatgtggacttgagtttgtccaaggtgacaaatatgggtctattttcatttttctacatagaaacagccagttagaccaacactatttattgaagatgttttcttttttccattgtatatttttgactcctttgtcaaagatcaagtgcccataaatgtgtggttttatttctgggtcttcaattctattttactgatcaacatgtctttctttgtaccaatacaatgcagtttttatcactattattctgtagtaaagcttgaggtcagagatggtgattcccccagctcttcttttattgttaagaattgtttttactattctgggttttttgcttttccagatgaatttgagaattgttctttcaatgtctttgaagaattatgttgagattttgatggggattgcattgaatctataaattgcctttggtaggtagaatgccagttttactatgttaattctgccaatccattctctccactttctgagatcttctttgattctttcttcagagacttaaagctattgtcatacaggtttttcacttgtttggttagagttacgccaagatattttatattatttgtggctattgtgaagggagttgtttccctaatttcttactcagcctgtttaccatttgtataaaggaaggctactgatttatttgagttaatcttatatccagccactttgctgaagtagtttatcagctggagaagttctctggtagaatttttggggtcgcctatatatactatctacaaatagtgatacatttacttcttctttgccaatttgtatccccttgatgtctttttgttgtcttattgttctagctagcacttcaagtactgtattgaatagatatggagaaagtgggcatccttgtcttgttctggttttagtgggattgcttcaactatgactccatttacattgatattggctgttggtttgcaataaatttcttttattatatttagagatgggccttgaattcctaaacactccaacaattttaacatgaaggggtattggattttgtcagatgctttttctgcatctatggagatgatcatgtaattttttttctcagagtttgtttatatagtggattatgttaatgtatttccttatattgaaccatccctgcatccctgggatgaagcctacttgatcaggatgaatgatggttttggtgtgttcttggattccgtttgcaagaattttattgagtatttttgcatcaatattcataagtgagattagtctgaagttttcttttttggttgggcccttgtgtggtttaggtatcagaggaattggggcttcatagaacgagttaggttgtgttccttttctttctattttatgggatagtttaagaaatattggtattaggtcttctttgaaggtatggtagaagtctacactaattccttctgaccatgggcatttttgtttgggagtttcttaatgacttccatttccttgtgcaatatggacctgtttagatagtttacctgctcttcttgatttaactttgttatgtggtatctgtctaaaaaacatctatttcatctagattttccagttttgatgagtataggcttttatagtacgatctgatgatattttgaatttcttccatttctgttgttatgtctcccttttcatttctgattttgttaatttggatactgcctctgggctctttaggggtttatctatcttgttgattttctcaaaaaaaaaaaaaaaaaaaaaaaaaacagcttttgttttgttgatcctttgtactgttctctttgtttctatttggttgatttcagccctgagtttgtctactcctcttgggtgaatttgcttctttttgttctagagctctctggtgtgctggtgttagtgtaagatctctctagtttctttaccagggcagttagtgatatgagtttttctcttagcactgctttcatgtgtcccataagtttgggtatgatgtgtcagtattttcattaagttccaaggaagtctttaatttctttcttaatttcttacctgactaatttagagtagagagttgttcagtttccacgtgtatgtgggctttttgtcgtttttgctgttattaatgaccagccttaagccatggtgatctgataggatgcatgggattatttctgtcttcttgtatctgtttagggttgttttgtgaccaattatatggtcagttttggagaaagtaccatgaggtgctaagaagaagctgtattcttttgttttagggtgaaatgttctatagatatctgttaaatccatttggttcataacctctattagtttcactgtgtctctttttattttctgtttcaatgacctgtccattgatgacagtggggtgttgaagtctcccactattattgtgtagggttcaatgtgtgttttgagctttagtaaagtttcttttatgaatgtgggcgctcttgcatttggggcatagatgttcaaaattgagatttttatcttgatggattttccccttgatgaatatggagtgtccttcctcatcacgcttgataacttttggttgaaagtctattttattggatattaggatgatgactccaacttgtttcctgtgaccatttgcttggaagaccttttccatccttttactccgagatagtgtctgtctttgttattgaggtgtgtttcttatatgccaaaatgctgggttttgtttgtgtatccagtctgttagcttatgtctttttataggtgagttgagtctattaatattgaaagatattaaagagaaatgactgttggttcctgatgtttgttcatgtaggtggcttgatgtgcttgtggttctctccttatgactttgttgtgagatgcttaatatcttgtcctttctaggtgcagatatctctcttgtatttgagtttttccttctaggatcctctgaagggctggattggtagatagatactgtttgaatttggttttgtcctggaatattttggtttccccatatgtgttgattgagagttttgctgggtgtagtagcctaggctggcatttgtgttctcttagagtctgtatgacctctggccaggctcttctggctttcatagtctttgttgagaagtctgatgtaattctgataggtctgcctttgtatgttacttggccattttcccttgcagcttttaatattctctctttgttctgtgggtttagtgttttgattattatgtgacaagagcattttcttttctggtcccatttatttggtgttctatatgctttctgtacctttatggccacttctttcttcaggttggggaagttttcttctatgattttgttgaagacatttttaggtcctttgagatgggaaccttcattctcctctattccaattattcttagatttggtcttttgattgtgtcctgaatttcctggatgcttgggttagttttgtacactttgaattttccttgacagttgtgtcagtctcttctactgtatcttctacacctgagattctctcttctatctcttgtattctgttggtgatgcttacatctgtaattcctgacctccttcctaggttttccattttcaggtttgcctccatttgtgttttctttattgtttctacttcctcttttacttggatcgctttattcaattccttcacctgtttacctgtgttttcctgtatttctttcagtgagttattaatatcctcctttaaggactgtggtttctgtttccctgtgtgcagcagaactccagggaggcttttagtctgtcaggtcagttgtcctgcatacctttaagctgtggtgtctactgctctgagtgcagctgatcctcaactgctttgagtacagtagatcctctaggatgggtcaggatgtagtgtcctcacaggagcagaccagctaggagtctgccccagcagaaaggaccaggtgggaggggcgaaagaggagtagtctaattgctttatttttgaaaattataaaagacatcttcattttaattaaacaataaaatttaaaagcaatatatggacactagaaaatgggacttgagaatatgttcctgatacctggtagtggagccaaaacagaataggagctcctgcctagcctcagggtcaccaatgatagacagcaagaaagagtgggacaagcacaggactgcaggaagactaccttgaaacaaagctgactccatttcctgcatctatgggaactgaattgtttctttgaagccaagttccatatatttgccaggttactgctggcaccaaagagaaccagcacatgatcacattgatcctccccatgagaatgtttcctgttctcgtgggaagatgtcagccaggaaaaaagaattcctaagagaataacacatagatgacggacaagtgagtcctatttttcagttccctccagatgttctcagaagtcagacttaatgggaatttggctccttaacaaagaccccatcaaatgcccctgctgtgctcatattgacaaaggtgggttgcagtacttgtgttcgcttggattggtggatttcaagtgccaaaatgctgcttgcactgcatagggacaatgagggcacttttctccagctgagggttttaggatgtattctgagcacactacaagaatttcccttttttcctgaaattaaaaaaaaagtagagggaaatggggatggtgtttttgaaaaaccaatgtctggaagtttggttttcttcagtggatcttttgtagctattttgtgcatggatgccttaactcaaagaaagtgcagtcagcccacattgagaatccacatttaagaattaattaagccaacctcaggataaaaatcttttaaaaagtatacatgtgtactaaatatttacacactttttcttgccatttcatttaagtaataaaatgtaagaagtatttacctggtgtttgtattgggtcaggtgttatcaatgacctagagatgctttaaagaatgcaggaggacacagggaggtgatatgcaaatgtgtcatttcacaggagaaactccaacatctgcagcttttctccttcagcagggctggggagggggtgtcctggaactggtccctgtggtatcaaaagatgactgcatgttccaactctgagaatgcatcacaggctgcagaacagacctgacctgcctacccaaatttcagcacaggcaaatcgtgtcccagttgaactaatctgtctgcttatttgtaagattacaacaaagcctgagattggattcctcacctgaatcacttccttattgactgaatccatttagactcccctctaatttagcagagtattcttattaaacccaggagtacaaacatcaattatctaagctgcatctaatttccttcaccatttatgttccttcattggttgccaatggattataagacatgattagaattcagcaggaaaatatcaacaaaaatgagaatccagttctagaaaaaacagatgcttagacaagagtaacagtgttcagaattaaattctgtgtttaaaaaaagggtccttatctcaaccaatataatcattcttgcttgagttttatcagcctgatgcccactgcagtggcactaaattagcatggcaaattggaatagacagaaatagaaagcagcagctgcttttccaggcttcatgtatatactactgtgtgtgtgtgtgtgtgtgtgtgtgtgtgtgttctgtgtgttgatatatgcacatatttacatgtacatgtttacatgtgcagttgtgctcacctgtgcatacacttgtgaaggccagagctcaactttggtatcttttcttattctccatcttagttagtttgttagtcagtcagtcattcagtcagccaattgtttatttgtttaagatagtctctcactgaacatagaactaactgtttcaactaggctgggtgacaaagccctaggatcctccttactctgcccttccagcatcacgtttataggtaccatgtgccatgctgctatgccaaactcaggtctgaatacttgctcagcaagcaccttacccactgagctcaaaccccaccacaaattgctaatgcatattttaagtgaagcgtagtaacagaaccatactccaacctgctacggcgtattttggatacagcacagtaacagaacctccccagcctgctgcatcatctttaaacacagcacagtacttaaccgtttgtagcagccattgcaaaatggccatgacacacagaacctttctctttgttcacttccagcagtgctcaggatgggaggagaataaagaaaagcaaaggttctgtttgtggacttgtgactggtatagcatttgttctggtttggtttggtttggtttagtttggtttggtttggtttggtttctttttaaggagtagtagattggaatggacaaacttatgctattagttttattagatagcctgggcacctgcagttgtcagtgatggcaaggaaataatgcatcgcagatgccttaaaatctgaagggtattgtctgagacatcagagggttcaaggaagtgggctgagggcacagtggatttgaggagagctgaaacaaatcatgcctgtctcaggagttagcttacaagctgaaccggcccctgcttgtttttattaaacttcattggaatgcagccacacttcttcatttatgtagtactcctgactgttgtcccaatgaccaagttgtgtagttgtaaaagaactgggctcactgagcctggaaggtttactgcttcatccttaatagaacggacttattcctgatgcacattgctagctgtctgccctaaggttgctggctcttgcttgtggctcgtgtatgaaaacagacactggtatttctcgtgactactatgaatggcatggcctcccttatttctcccctgagccttagtttaacccataaatagaaagtaataaaccttgtcttgtgattttaatataaatgtgtagtggattctgggtatgtatgcgttccctgcctggtctgagtgaggtctaagtaggtgcctgaaatccacaagcttctcaaccaccaagagcctttacggtttgatgctgggtgtgggcagcctctcatttcccacaccccagcacctggtccagctctcttcacttctcagaggcacagttcttccagtacctcagcctttcccagatgtgcccacttctggtcctcgagccctgctcttgaccacctgtgtctccttgactgtctgtagccctagcttcaatgtctctgccctgagaagccggtctactctaccatcttacccttgggttctcatggtatttgttttctcctctccataacctggcagcatttacaatttcaaatacagatgaagaccacgtttgcctggttaaattattttcctgccaatctggatggttaaaggagtacctagctcagagtggaccctcaatatttattaagtagatagcttcctcgcttttgagcaatggcaacactggcatttaataaaagggattcttggcactactaaagaaaaagaagtgtggttttcagcccagcatactgtttgcataatctggcacacagcgtttatctctttgagtgtcaggcttgtttttcatttgtaaagcagggtattatgtacctcctgtattgatggttgaattagtgttatcaataagaagatattaagccctacatgtctcatagggccttataattttgatagctctaagtcattaagctatagcctcagtggtttccctcctttctgttttcttgtctataaattgaggatgaaaattatacccgccttgtgtgatacccatgtgtcaatcatgtggcataataaaccttccatcttctagtaaatagaatagttttgtttgtgaaaactagtatgttcatccttcatgaatgacttcccagaaaggtgtatcctaaaacaaaactttacatgtagttgaattcacaactcccttgcagctctccaccactatatgtgcacttgcacttcgttattgccacttggcatttgaagacatgctcttcagagcagtagctgtagggtatcccgtaggactgccagaacattccagacaagcatatatgagttcagtaagaaccctccgctgcagcaaaggggttcattgttgggttctgtgtttgttgtttgcttgctttgtttatttgggagcttaacaaatagcaatggctgcagcttttttactttcaaagtgcatcctttcaattatggactataatctgcagccagtgtgtgtttcgcaagctcaaacacacagagacatttgagaactgacgtttggatggcccaaccacctgcacagctgccagcagttgttccagactctactgctggggcagctgtctgggacctagggaccagtgctctctctggtaccttcaccaccttcttagatgatctttacttttgtgcaacagtaaatagcagctctgaggactctcacccgaatcttggaaatgcctgttactttaagcactttggaatctgctaggagcagctctgaatatttacagagacctacaagaggaaaggggttgttgttcttgttgttgttttagttcttggtgccaaaaaagcagacagtaaaaagttaaaaagccgcttttgctattatcgtggaacagcagcttgtggttgtaaaatgaatgaatctgtgaagcacccattgaaaatgtgacatgctttataaatgctaaataataataatgatgtcacaaggctttcatttttaaactgtcttaatttcattctcagtttgagcttgcagattatagtacttaattatagaaattggcccagagtgaaaccttaaatcagatttccattaaagtgcatgactgcagcaaattactctatagtggggaagaagctgagagctggaaggcctgctggaagaggatctccccaccaaccagaaggcacctcttctgccaggacatatgggacactgtgtcctgagcagagccagtctcctaaaaaaggcagcctgtgtatatcttctgttgcttttcctatagaaaagcttcccatggaagctgctgtcaaaccttaatgtcacttagctctggatttggtaggaatgcgccagcaaatccactctcctggccctagccctgattcggccacgttgtcctgcatggcctcaggttacctccatgtcaggcctgacatgcctccatgagttacattgggtgccatgtttgcctctgtccaggttgcatccccctccttaaagtccctgggttgcatgctggctaaatgtgttgctttccttttagataaaggttgctctataaggagaacctatgttaaggttgggctcatgctgagcacagtgagacactgttatgtgaggctcatgagacctgacacccgctgagacattcacagcttgtagttggcgatcactccagggcattcacccactaagtagaattgtcacagggtcacagacatcacttccttctcaccccctccgctcctgcctgtttagataaattcaccttagttcccgtgagctgatagaacagtcacatagttttagattaagcgcactgagtccctgtaactcagagcatccctgacacatgagcttgcccttatattatagaggtcacaggtaccagtctgtgcttactggaatgcccagtttttcctcataaatgctagtgtgtgcctcttcagttctgtctcaaggcccatgaaggaattattgcttgtgaacactttttcttctattgttctgggaagttcccttccatcccacagttatttggaaattagtgcttcattaagcatcaatgctaacagcatttaatggttgccattagaaagcaggcttctgcttaccagttagcctgctgtgagtggaaatgggaggtttctttcttgggagtagcccccagtccctaattgacttgaaaatattgcttatttgcttcattactaagctgttaccattctattaaagtttagtcactgtgcctctattatatatggggaaaggtttcctactcacagcctggatagtctgtccaatagtgtcattgcctgctgggaaaaagtcaggagcacgtaagctgagagctgttgccagatactgcacgtgtatcatcttcttgaaatcctgcaggggtctggtggaccagggactattactctcgtcttacagatcaggaaaccatattcaagagaagttatatagcttaaccaggtttcagccttagcgaccagcacggatgagcaaccagtagaattttaagcagggccgtcactgcccccatagctctctccactacagagggcccactcactgtatttataagcaggttctaggggcatcagaataggaaaaataagaattcctgtaatggcacatcctagagataagtgctgtagaaatgtaatcttttcttttctcctttgctattcgcagttaatttatcatatggaacctataggatctaaactggcatgctgcatgtaaatacatgcttggcaatttctgtagtgtgctctcattgccactgcattgttgggattttgatgcctcaagcctgatgaataactcttttctgtgggtgttatctattaatctaagtaatgaattcttttcattatctcgttctttgtgttaattatacaggattttcttatacccatttatcaaattaagacaagtacaatattctttttaccccacatgcctgtaaatgtggaatctgtacaaacaggtgaacatgatgggtttcaatttaaatttctgaaaaattcttgttagtaacttgactctttttttttaatcttttgtctttttttgagacagggtttctctgtatagccctgctgtcctggaactcactctgtaaactaggctggcctcaaactcgaaattcacctgcctctgcctcccaagggctgggattaaaggcgtgtgccaccactgcccagctaacttgactctttttatgttacctctttatcttttcttttttaaatcaaaacagttgttgtctcagatagttacattatgtctggattttgagaatgtgccctaagaagcatggcaaggttgtagtctttaccttttactacaaacagcacatactaagttctgagatttgaacctgttgtgttaggcacaagaactacatatcataaaagaaaaatagatgcatgagtttttaaatgacacatttcgttttggaaaaggaaaaaaaaaaaaagaaaacgttataccagttccaaatatttaagaaacccagagggcggatacagaagttggattcattttggggcctgtctcagttcataagactggatggtaatatgggttaataatgatatgttgttatttattcattaccgaagcttaatttttgtgacagtcttgtctgttcttagtatttctttctctgtgtaaaaactgacagaaaccaagaagccttacttaacaacctctgttatttgactagctgttttgaggctgttggctaccacactctgacagcacttcctgtttgggatttcaggtggaagccattctcgtcaatatctttggtgggatcgtcaactgtgccatcattgccaacggaatcaccaaagcctgccgggagctggagctcaaggtgccactggtagtccggcttgaaggtgagtcacaggagttcccagcactaattttcctttccagcatgctctgggctcacacacttcctaagctccagaaaactgggttaactgagatgcagcaggctcagtattacaatggtctggacttccagcaggcaagtgcagttgcagttcctcagacactgtgggcctaggactacccaggctcatttgccaggctggttccagagagctaaagcccttgtattatagaggccattgtacaaatacccagcatatgtgatctctttcctcttacatgcaaagctatgataggatcagtttatataatagaaacagtaagaaattagcaatagctagaaataagatagaaaataacaacattatggtgaaattaaagtgaatttgatttctttctctcaaaaaagacaagtaatattttcatgattggctactgtaagctactgatactgtgggaagagaaaccacagatcaaaggagatgatatgcatatgtatgtgagtctacttgtatatatattgtctttttaagtctttaataagactggtaactgttttcagctcccttacttacctagcttctctgttattcccataagactttgtcacaatgtatatgaacaatgtctaacctcagagacgtgtatatggactcaggaggaggaacgccttttctgacttttgttttgttcgaaatggggtctccttatgagctccaggctggccttgaacatgctctttggcccagtctaatctagaattcaaaatcccccacttcagcttcccaagtccaatgattccaagtgcccagccccacacccagctgggatgttttcgtcagcttctcatggagccatgagctttcttccctggtactgcagtacaggtgtcagccagttttactgaaggtgctccgctgtgaactaggaacatgtctgggaaagttctcataacctgctcttttcagcccctcggtgtgtctcacactaagttcatttcacccatgcacgctgcataacctcatgctctgataacttttttcagttatgtcccaaaggttattgcatttcaaagcacaaaagccccaagtccatgtttgttaggatcaacactgctcctgataggactgcatttaaggtgttgggaagctgtcaagtatacagaggcagatgcaacttattgagagtttgggttttcagtttaagatataaattttatcttcaactgcaaaacagttgttatcctcaaaatgacaagttcatttcacttatatttgaggaaatatcaccagataaccaagtctgaatagccacagtatggtgattggtctttgaagtggttacagtgttccatggggatggcaatgactccggcccatgcttgggtgtagaagcacttctccatagagacagtggccatagttagccaagtagctgagcccattgctcaggtgcagaagcaccttcagtaaattgatgtaaactgtttgattgagtgctcaagggctgaggcataataaaattaattttctttttactctctattgcttgaaacatggttggtatggagagtgtgtggtggggtatcagtgaccactagtgccttccttccttatacatcagcctcacccaccatcacatgacgatcatggcagcctcttcatccatgccagtgccaacccagtcttactgtcattcattactgctaccactgcatgacagtttaacagagaaaaccttcccgtatttaacaatcattttaatatgaaaactcctgaaagccatccacattgtcattgcattctggtcataacattcagcagccccactgggttggtttcttcagtatcaccttaggggcagcccagattgcccaggctctgtgctggtgctgttctcctagtgatgaagtctgagggtcatttgatagcactgtatatctcatcccctgatggagaggccagaggagctgcagcctgcttaaggtctcccttttctctcttctctctctctgcaatactgcctcttccttacctgaaactgtctgccttgtgacctaaaaccagaacatcctggacttgatagaaatgctgaccccagagaggaggtcgggcagcaggcgctccaggcagcaacgttgagtgtggacagcagaacattccacagaattaactcattgtaggagtacagagacataattgattcccgtgaaactaataaaagccaatgattagtgataccacagtacagaaagctggccaaggagttaacgaggccatcggcatcagttataattctgattaaaatgttgatgtcagactggttttagattcaaaatgacccctgaccctcgtgttgtaaaagccaactgaggcaggaatcacattagtatctgacacttggaaataattagaagtattcctgcagtggattcgctttcttccagcaatcctcactgggcacatagtattattatatatacaattattatttgtacatttctagaaattgcttccttttcatttttcttgaaaacttgaaaatgagcaaggctgataactcactgtgcacacaaatctgagtttgatcatctggactcacatttttaaaaaaaaatagccaagaattgtagtgcacatttatcatcccagcactgaggaggggagggcaggagaagccctgagccaccaatgcagccagcttcatgcgttccaggccaatgagaaatccatctcaaacaataaggccaacaagacccgagaaacaacagccaagggttttctctggcccccacctgcaagcatacacacactggccgccacctacaagcatacacacacacacatacacattgtgcatgtgtacctacacacacttgcatctgcacacacaagagcaaacatgcacatacatacacaaattgaaaacagcccttgtcttattttcatgctatacttagtattccagagtagttgttccatgatacctgggaggtaagtatgtatgtaaagatatgcaaattaacacacccaagattatctccgtaaatagtctctgatgtttgtgttagaagtctgtttgagataagagagaaaagctttgaaatttctgagcttgttagacaatcctttttcttctacagtctgtgcctgtggtttttaattagaactcagttattaagaaatgccacgcacaggtcacagaactttaaacatcaaggaagatgagtagaaatgtagaaagttaacaggagaaatgaagtagaaaaatgacagggtaaggcagtgagtgcactaagcatgaaagaggccttgccttcctgggacctgttcctgtcttcttggcagtggtcttgggggccccggctgcatcactgaaaatttggaaacactgaggtatcacactgtctgtgtcccgaacgtgaaagtgatggctcaagacaagcccaaagataccagtgtctcccctaactgaagtaggcaaggctatccctggtggcctttgccactatcctttctatactctatggtctctcttgtgtcccaagaaccttttaccaagaggaaagaagcaatgaatttggtatttctagagtagtaccaggttttctctacttctgctatacaaattggcatcttgtgtgatcagcgttcttgggtaaatgtaggctctcacatcaacccagcagatgtgcaacccagagaaagcatgtggaatatctaagagacaaacagctcaaccaacaccaaaaccagaccctccccaaactgcatggttatcacacactaaacacagggagcagaaggaattttgctttgactctactcagcggtctgaccataaataacaaaatgcagaatttggagaagatacaaaccagaaaggacccataacaaaactaagtgagaaccaggccagaactctgcgagctaaggaaacccagacttctgtgaagtgtttgccttggagctgggtgcttgtggctcagccgctttcatcatcatgttcctcatttaacttgtaattgtatttttaatctaattcacaaaaacacaatagctatacataccatggaatgctgaaaacatgtatacgttatgtaatgttttaatgaagtgaagctatgtgtacctcagctacaccattctttgtggtgagaacagattttattctggctttatgaaaagtataacattgttatttgtagttatcttgtgcaattaatacccaatggttagcctgtctctgtacttatgtactctctaagctccctagtctactctgcaatctgtttttcctatctacctgtccatctatccatcatctatatatatatgtatatgtatatatatatatatatcttctctccacatgtaatatatgtgtggatatgtctgtcatcctttttactcattattgactactgtaattaggaagtttagaagtatgtctttcaaaagtaatttttagttttaatttaatctttaatacatacaaactgtggtctgttttgttttgatttttgagactggttttttgagattagctatgtagccaagatgacctttaacgcctgatcttctgcctttacctctagagtgctaggattataggcatgaatgccatgcccagccccaaatgcatactataaacggggaatttccacgttgaatgtggaaggataagatctgaatgactgacaggaaggaagaggggattattagaagaaagtcggcatccatccccgagagttggaactctaggagctgaagcccaggccctgcatagctgagaggccatcctggagagagtgggggctgcacagcagtctgtgagagcagagtggagcatgaagcctttatctgcagcactggctggagcttcggactgagcaaggacagggagaaaaccacaagaaaacaggaagcccaagagccctaagtccaggattgcagcgggctgtggtctaggaagctgggaagaatgaagtgagagaaccatctcacctgggatgggggatggtgtatggaaagcagttcctctagatctggaatgaacatgagtccctgctggcactagccctggctcagtgttgttgaagcctcagacacaccagtgcagatctgtctaacctacacaactgtgagaactccaataatcaagatagcaagtgttcccaaagccagatggcctgtttagttagtagcgtctgtttcctctaagtaaaggaagcagcttgcttgtttgttttttgtctatgtggaagacccagaacccctgtctacattcacccactcacatccatgccatgacagctttggcccacacacagtacactggaaacaggctaaaaacatcaggtttgcttcggtagaattttgtgaaccaagtccttgtactctgccgtatactgacggcaagctgtctttatctatggaagctttttccctgctctttggaatgataacaccataaccccatgcattcatttgccttactaagcaaatgaatacatgaaatgtttctatcagccaagacacaggataattttgttttaaaagacttgtgggtaattgaacagccagttaagaggtagaggttgagcctttgtaaacagttgttgctagctagataaagagcatggtttctgatgagcgtcctgaaatgtacacagacattcagtatggtatggggtactgctgagatatggacacataatgactgacagttgtgtggggtgtcacagttgtgtagcgtctggatttgctaacatcttcagtgtcttttttctcctttaagatgcattctttcttgttgttgtcctgtttaaatctgcaccacaatcctatatttgatggatacttggggaagaatttcctcttctctcaggtgcacattatgattctgagttgagcttgttagtaacaacagctaataataatgactgtaagcccacaaagtttgtaggctggatcacatttctcgtcaccaggtctttcaatacaattcgtctacccagcaacgaaagatttgtctcagcaatgcaaatatttttatttctttccccaaagctcctcaaaagccagaatcccaccccgtttgttgttccccttactgccaaattctcccccgcttggtgctggaaacaggatgagtggcatggggaggaaaagggacagacacacatacagaaaaactgggatgggacaggcagtctgatggaaggcaccttctgtgcccagaaattcagtacggttattatgtacaacacatgtgtagtggctgcttttatgtcagcttgacccaggctagagtcatcagagagggaggagcctcagttgaggaaatgcctcaatgagatccagctgtaaggcatttttctagcacatcttcctttggttactcaaggcatctctgttcccagggtgaccaaccattcttctcaagccttcctaggcagtctgcaccttgcattgctccctaccacccagggtcctgggtcctctttcatctctcccctccatccgcattctctggggacacatcctgtgtgggccaactttcactgtggtgatgccccacccctcctctgcctctactcattagcaccccaccttccccaatggccctccttcttcttagtgtttcttcagcagctcgcactgcctgtggcatgggagggactctagtccccaggggtgccaggtctgaatggctaagtatacagtaatgcgtaaacctctgctgctcctgatagttacaccaactccacaggtgctagcctcaagcgttcctcagaacaggaaaagcttctgtgggtcaaaacttttaatctgcattaatctgctctcttaggcatttcaagtttccctcacctcacctctagatagataatgtgcataaccagcatttctgccatttggatgtctgtggccttgtcatatctgtaagctaagtcttctcaaagaagataactccagcattatgcagtgtccccaagctctctgggcagtgaggtgatggagggaggtagctgtgacagactaatcctctctggccgttgttatgcaaaggaacagttttaaggaagagtggttaaagcagagtactcattaggcccactgtatctaatgcagactccctgtctgctttctggatattgtcggtgggaccagtcagttcatgtcttcatgcaacactgtagttattctaattagcagcctgctattagggagcagcctgcagggagatttagtcccttgttttacagatgatgagtctaccctgccaataagaatgttgaagagacacccctggagactattcctagtctatccctatagcctccatgacagtgttttaggacagaggacagatagctttcgccctatgccaccttctgctcattgactgtggctgctgaaagcgctgtgccaataaaatcctgatgcactgtagctcagagaaagaggttccataatcatgattgtacactacagatgtcaaaagagatgctttttgagccaaccatttgccattagtgaatgaaaccatacaggggactttctcccctagaaatatagcattctattctattgggagcaggaagtaaagtgggggctaaaaactgggaaagaaccaagtaagataatttcttactttgtacagcccatcagacatgagctggggcattctgataagctttcctgtgaagagtcagctcttgtcctttgaggccatgtatccctgctgcagttgcttagctctctgcggtaggtagtgttgaagcagctctggacagtgcccggggagatggctgcccctgggtcataataagtcttttggtacaaaaacagatatcagagtaggtctggcttatgagccctagtttgcagacccctaagtggaaaagagcccagcaacaagacctagtgttttagaaactcctcctattatccatttctaattctggctgtgggctcagcctgtaaatttcttataagagtcaagttagaacttgacaaacaatatcagctcttcaaatacagtgtttttcttaaggacaatcttagcagtagagtccacactcaggcatttcccctacttacagtcccataccgtaatgcagtggtatggcttctcaggcagtctatcagtctgtttgtgctgctctgacaaaacacctacgtctggataatttaccaagaaaagagctttactttgttgccacatctgctggcgtctgctcatctcagagagcctggatgacacgcgtggcagagatgcatttggaagaaatcatctggcaagccaaggggcaagagagcaggctggctgtccacacctgtggcaccagcacacgggagatggaggcagaattaggaattcagagtcagccttggccacatcgggtttgaggccaaccaagaccgcatggaaaacaagacgagatgaagcaagtgcagcttcactctttttgtgacaatgcacgttctaaccagcattagtcctttaggtaagtccttgtgacataattaccttccactagaactccccaccactgtgctaagagcactcatacagcacatgagtctttgagggggacattgccttctatagccaaaccatagcaaggacgactgaaggtctgggtcagcattgtggactgatgtaaaagaaaggccttgcagattttaagagctcttcaaaagatctgtcctacagcatgcacaagacatgaacaagctcatgacagaccaaaccccaccatggagggggcagggaagcctgaagcccactcctacctagctcagaagctattggcaactcatggcttcgagagaatgagagtaacacgtccaaaaggaaggccacacatccaagactatgcaggcagcacttcctggacttggctgataaaaagaaagacaagttaggtggatgggatgggatggacaggagaggaattgggaagaggagacaaaacactctggataaatcctcaaagaacgaatgaatcttctaaaaataaagaaagatccgttctgtcctgtagatgatgggagtaagtagactaagtactgcagccagttttgcttgccagagggttctttgcattctagtttgatattacagttgaacatggcttgcattaatatttatgctgccttttttagggatacataattgaaagcaaaagcatatgcacctaggagtggctctcagtgaacacgcatagacttgatcccgaaccttgcttttgtggtcagatgattgcatcttggtcagagacttcctgctgctaaatctggctactgcccacagcagtcctcaccctgtgtatcttcttaccatggctgtgaaacagtgtcacagaccactttttatcagccttaattttcatagaatgtgtgggtagataagatcctcacccaagggtgaagaatctccagtcaaatggacagtgactttctcaagtcattcagcttcttaggaataaagccaggtgtgaaatttcaacctcctctcttgtagtatgtagggggaaaaacagtattgatcggggaggtaagatggctcagtaggtaaagtgtaaccaaagcatgagggtccatgattccagtattgtgctgaccagcccgtctatataattggtgagatgcagattccatgagagatgctgtctcaaaaaataatatgcagagtaatagaggaaggcacttggcatagacctctgtttttttcacaagtacattacatgcacatgggcatatgcacaaactgacatatatacaagtagcagcatcataatgtaaggcacacattgtaaggcacaaactagctttccaatagtctgaataggtctgctcttagtaaatgttagcagtgcaatttgtactagctgtcacatctgaacccttgttactgaccctatgtatcactgccattggctgccaggtggtgttcaacctgagacttgagttatctccaagaaggggaggggtacgggcacagtgggagtttgatctcttgattctgtgctcagaaagttctttacgtattgtggatattagtcttctgtcgaatccatagtagctagagattctctcccacttgggggggcttcctctctgctcagttcattgttttcttagccttgtcgttttggtttaatgaagtcccgggtgtcagttgttggccttaatttctggacaaatagagtctcgttaagagagccctctcttacacctgcatcctgttaggtgctgcctgttttcttgcagcagcttcagtgtttccactctcacatgacgtctttgatgcacttggagttaattttcatgtaaggtaacagatgcaggcctaatttcattcttttgcatgtggacattggttttcccagcaccatttgttggtgttttctctccaatgtggttttggcatctatgtcaaataccagatgattctagttgtatgtactcttatttgggccttctattctgtttcattggtctacatgtctgctcttgtgccagtaccatatggctgttttatgactgtaactccacagtataccttgaactttagaatagcaaattttagaatggttttgttctgtttactcacggctgtttactcaatagctttggctattggggccttttgtggttccatgaaaattttaggatttttttcctctggtgatttgaatatgaatggccccagaggcttctgtctttgaatgtttggtcctcagttggtggagctgtttggtaaggattaggacttggggtcttagtggaggaggtatagcactggggctgggttttaaggtttataaaccccatgatattccaatttgcattctctctgcgttggatcaggatgtaagcgctcagacactgctccagcgccatgactgcctttctgctgctgtgctcctgacataatagtcatgttctcaccctccaaactgtaagcaaggccccagttacatccttccttttataagtctccttggtcataatacttcttcacagcgctttctctatttctgtgaagaatgttttggcaatttcgattagaattgcattgaatctataaattgcttttgttaggatgatcatttttcacaatattatttctactaatcctgtccattttctagtttttcctcggtgtctttcttcagagattgaaagttcattgtggtgcctttgcttcttttctgagttttattcctaggtgcttatgttctttggagctactgtggatggaaatgtgtccatggtctctttcacagtatgtctgtggaatcattccattactaaaggaataacaagagagaagagattccaaacattggctaaacaacagtgctctgtctgatgatggctggaaagaaggaacaggacccacggacaccggaccccaggaacctactgctttgtagagtgtgtcctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattaggtcagctgctaagttcctggtaccttgggtactttatctgtgaagttgggctaaaatgatgttgcttttagatttgctttgagaattgagttttatgatatttaagaaccagtaatcatacatagacagcaagcttatactgtttttaatattatcttcgtagtctcttttaaaatctggtaacatgtagtcaatatgtacttaatagtggcgttgtattcttttaaaaggagcaaaaacctgaatgatcaggccagggagttgacttagttatagtatagagcccgctgcacaaacatgaggacctgagttcagatcccaagagcccatgttagcaggaggggcagcagagttcacacctgtaacccctgggctgggctgggctaggctgggctgggctgggctgggctgggctgggctgggctgggctgggctgggctgagctgggctgagctgggctgggctgggctgggctgagctgggctgggctgagctgggctgggctgagctgtggaggtaacagtgaagggaggtaagcaggtgccagtttctggccagccagtctggccaatttggtaaattgacctctaggttcagtgagaaaccctgtctgaaaacatatggtagagagtgatcaaggaatatgctcagtgttgatctctggcctccatagacatacatgtgtacacacacatttatataaaaacatacatgcatgcatatgtacatacatacatacacacatacgcacatctgaatgcctataaaagcagtaattcaagagaggcgtctgcactggacagtgttatcctctgctcctggggtaaaggccagcctgagttggggcagggcagaggctgcatctcttcactcaaaccctgtcagccctgcccagtgtcctctctcttgcatggtgaaagcacagggtggattgataaattacccctgcatctctgtttacagctctcttcctccacccagtggcaggaagccactatagaccacttggaagcagagacgtttttacctgcttcatgtgcttctttttctcatgtctgctagcagccgagtaggagtctgtgctgagccagtgccccctttgtttctctacacgctgtcattctcaaggcctggaagtgggtaggtagccacatggccagacagcggtcaagaagccagagttgagaagtgacagccagctgagctgtgcgggttgatcggttatgtgtatgggtggttattagcatgttgtcctgcagccccattgagaagcatggcagcatttaataaatattaaagcatatcagcagcaccatttaagtgtgggaaagtgatcagtccccatcctaattgtgtgcagggcataaacacactctttagaacacttaattccatgtcagagtttaaagtggctgtgatggtttctacttagaaataaagtcagaaagggggcttggaatagatgtcagccatggaggtcagaaagaagcctcaaacgcgccaataacaccattcccccaaagatggagacactcacaagcatttgcccagggcatcctcactccccatgacctgatttttactggctcctttttctttgcaatctctcttctctttcccctccagctgcttcctcaaccagaaggaggaagcaaatggtagtaattgctggccaggccaggatgcgggcaaagcctagccatgcaggggaagagagggagacaaaggacagggcaagtgcggaggccacatggcaagctccccaattcctcaccctgcctttctctcctcacatgctcatccttctctggcttgttccccatgatgtcctcctcacctgtgtcctgggttggcctccccccagcctccttctgacctccgtctgctcatggcggctctctctggattcacttctcagtgcagtccagtttattcctgggctctttgagtgttacaatcccttcacaccctgcttcttccaagtgtgatagtatgtgcttaataattaagactgtaattaaagtataacagcaagtataattaaaattcgctttagtagatcctgaaattataaagcaattaggtattttggtgtggcactgaagatgccgccaggaggtagagggaaggctcccttcaccgtttccccgactgcacccatcaacataactcgagtgtgaggactctcttcacttggctcaccacatggtaagagaattgtttgcagcttagagcctgccctggagagtagccagggcaaatggaatgccaggacatggagtcactgccaaggcctctggagaaccctcagctcttcaaaatgatcagagaaggatctgtccaaacctctgtcctcaggcatcatcgtttgtgactgtggctgtccttacccagtctgtcagctcacatgtaacatgtagctgatactgcaagattccctgagaagcaaacccagcgctgacagggacgtgtagcaggctgtgggaaatatcactaagctgccccacagggctcatccctgttgcgatgtagagatcactgagtgctccagcagcacatctgacaagcctgctgtagctggaacattgaaggcagtggcagggaaggaggcccaggagactgggagagacagcttcgagcgagcgcatgggcatgcagggcaaaggccagtggggctcggtgtgcctgcctaggcacttgtgaattttaacatggagccttcttattccccttgagaatactgctcctaagccagatgctgcagatgatattaattaagggcctgaattatttatgctgtcggctccaaggaaaagcagcttcatatgtgagttggtttcctttgtttgtttgtttgtttgtttgtttgttttgtaatcagcatttgtttcgtccttacgcatggaaaattcaggtaatagtgaatggagaattctgagtggatagttctcagaatgagtgaaggaaaccatgaataaagaacaaacaagccaacccccaaaataccaggagaggggtgggagagaggcctggaacagttatgttccacaggtttgtggaggcctggggagctgggtgctgagactggagaatgcccgaaaggaaaagctcttgtactttttctttcgtttggtctctggccgacaggaaggcacccagggaaggtatcccagtcgactcctttgtgaaaggggataggaatgacacatcagacttcaggtccagaggtgtgcttctagcccaggccttatttttgcttcactctgccattgctccatgacagccacacctgcaggttaatgtacagattccttagcctctgacctaaccatgatgcacaccctgtcctgcttctcagcctctggaacccagactcagcttaccaaaggagtcagaatggacactggggtcctgtaatgatgtaactgagctttacatctgtgttacgtctctgtctgtgcatagcagatgatcccagagtttgaaagtgctaaagaagggtgtgaatatcatacggacccgaggtcaggaatcggggtggggcctagctgagttctcgcactcagtcttcaccaggttgcaggaaaggtgtgttccgcaggaccccacggcttgctaagaggtagttcactttcaagctagcgtctatggttagcaccagatgctgttccctggttgcctcatggctcagtagcagttagctagagggtgcttgacaagtgggctttgtacatagggtagcttgaaacatggcattttgccagcaaatggtagaaatatcaaagcagacaaggcagacagaaagcaaggtttttatatctcatctcagaagtgatgtcccatcattcgtagattcttacacagtgaaaggggacaagttacacgagcgagcgtgtggtcgcaggaggcaaggtcagtcacatgactgtcccagtgctgttttagaagctccctgtgacaacattaaaaacaatgggttgggcatagaaatagctcagttagcaaagtactcgccattcaagcatgacgacctgaattcagtcgtcagaaccaacgtaaaatagccaggcattagtggtgtccacttgtgatgccaaccctggagagtggagacatttggatccctggggttcctgctttgtgactccaggccaatgagaggccttgtcttaacacatacacacacatacacacacatacacacacacacacatgtttgattccaattaaagccagcccctgaataacaaccattctgtcaagagtttagcattattgaaatttccttcctgttcctataaagtctggaagggtgagtgagtcagatgctgggctccacctcattatcaagtgtctagctgaagaagtcattgccatccttagaaaggtgcctcccagggttatccttaccaatagtgtagctgaaagtaaaacagatgtaaacatcactttatttcctcagatgaaatggtgagatgagggctctgcccaagctgtaggttaggctgtgtccagagcttttcctgctctgttctaactctccctagacctaggcctggagacttctaatctgatcttacaggttgaccgattcagtccagcttccttcagtttcggactaaattgctctgcttggccttatactaacttttggcaatctgttctaatctgctggctccttctcattctctggctcattctgtcttcacctgggtctagcttgtcttctctgcaacctgtgtctataaaactgtccctgtaaaactgtcatacacatacactgcatcaccacaccccctcctttctctctctccagtactgacttacttcatccataaacacaggacagtagcacttccttagagctcgtgttgaaaaatcatatgctgcatctaagttgctgggcattatcctggcatgcgtaagtacagagtgatcagtagctctaaggaagatcatgttacacggagataaaggagctggggttccaccccagcacagagacaatgatatggctgtgagagcaggtgatactttcctcaaatgacatcacgcccaggctcaagcaggcagccttaatcaatccagtgggtgacacacaaaagctgtggaagtaggaggggcgtagtgggaattgtattgggtgaaggagggatgtgagaggggttaactggttcatagtaactaaagttcattatgtaagtttatgaaactgtcaacaaataagaaaattttaaagaagttgcagggctggagagagatctcagtgttaagagcacttgttgctgttgcagaggacgtggggttgattcccagcatctacatggtgggctatgaccgtctgtaactccacttaaagaggatctgatgtcctcctctggcctctgcagtcaccaggcatgcacatggcgcaaggccctatgtgcagggaaagcagtcataatattttttaaagttgaaactcaaggtagtcaagtggttaggtaaacaccagtctcgtaatgcatggcagaggtgagaactctggctccttcccctagtcactgcacccaggggcccttggcaggtgtgacgcccagtgttcacttcccactgctgcagcagatgcagtgtcccagcgcctcctcagcagcacagtgcgctcacctggccactgtctgagagtgagccgtgctgaccaagtgcctgctgttatctgtgcccacatagaagggcttgttctccatggccatgccttcagagtctttgttataaagacatcacctggtagccggttgggagcacaggagccgtcccgtggcatgcttaggccacttctcaagcctcttctcccagacgcggggaagagacaggcccagtgcagactttcttccttcaaacttactgagcaggtgcctgagaaacattgtgcgtatgcatgatctggaagaatgcttatttctcattttggagtgccagggacaatacaggaagtgtctttctaatgagagttcattaaagtgaaaagaagaggggctgaaaatgtcagccgggcatatctgaaaagccagagcttggcagtaaaaagccacatgtgttctacttaaattgttggcatcaaggagaccgggcatcctggaattgcagttgtccaacttgactgggtgtgcccctgtcaaactaatttatcaattcccattgttcccccttctaggaactaatgtgcaggaggctcagaatatcctcaagagcagcggactccccatcacgtcagctgtggacctggaggatgcagccaagaaagctgttgccagtgtggcaaagaagtgatgctctcccctggctcccatgaagaagggcatgtaccctgactactgtgaaagcaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgatttccttagaaagttcaaggccaggcttacctcgtaaagctatacttacgggttaccgccgttccccagctgaaaagttctgaattcatgcagttgaatccttcttaacagtctgctttacgggaacctttattaccgcgacccgcagttctggttctggaatgagggatcttccttgcgccggtgaaactcccgtcccgagtttcctcccgggttttttcttcccggattttttctcgtcccggaatttctcgtcccggatttcagcaccaattcttaatcgcgttctcacgcccggccaggaaagacgcaacaaaccaaaatcttctgcggcaaaactttattgcttacatctttgggagccaggagggcaagcgcccagcgcccagccccaaaaacgaaagccccttcaataatgaaaccgaaaccccttccctatttaggagagttatatttcgcctaggacgcatcactccctgattggctgcagcccatggccgagctgacgttcacgggaaaggtagagtacaagtagtcataaaatacccttggctcatgcgcagattatttgtttaccacttagaacacaggatgtcagcgccatcttgtgacggcgaatgtgggggcggttcccaacattaggccacttctcaagcctcttctcccagacgcggggaagagacaggcccagtgcagactttcttccttcaaacttactgagcaggtgcctgagaaacattgtgcgtatgcatgatctggaagaatgcttatttctcattttggagtgccagggacaatacaggaagtgtctttctaatgagagttcattaaagtgaaaagaagaggggctgaaaatgtcagccgggcatatctgaaaagccagagcttggcagtaaaaagccacatgtgttctacttaaattgttggcatcaaggagaccgggcatcctggaattgcagttgtccaacttgactgggtgtgcccctgtcaaactaatttatcaattcccattgttcccccttctaggaactaatgtgcaggaggctcagaatatcctcaagagcagcggactccccatcacgtcagctgtggacctggaggatgcagccaagaaagctgttgccagtgtggcaaagaagtgatgctctccctggctcccatgaagaagggcatgtccctgactactgtgaaagcaattgttttctcactgggaagggacacacacaaggatcatcatgtgaaaaatattaactctgaactttctcaaatacgttatccagagtgcctaaagctgaatttatactgtagtcattgtttaaaaaaaaaaatcactccttacaatttcacatcttctcttgcccattcagtagcagggtctaccagctctgggccacagtcagtttagccaaatagtgtgcatacatacagtatttaaagccagatctaggttcattcacaagggcatttattctacattagaaaattttacaggaccctcaagttcagacaggctgatatttaacatagtggcttccagaagggtacagctaagacacctgagcttctgtgaccagtggcctccactggcccctaattccagtacattaagaaagcccatgaacatttctaaagtgtggcttatattgggcatcccgtgttgatatatgtacattgcacacattttaccctgtgccttaatgttgaatctactgtttgcctcacactaagttactaccagaagccttagtcatgggtgtgaggtggaaggtttcattttgtgtcagagttgctgaatgttaatctatttcataaagagtcacactaatgatctagctgctggtagcggccaggcttttccctcttgtcccctccacctcacatctatcagtttgccacagaaagatgagagatgccattggacagaatgtgaccttcctaatgatgtccttttttgtgacaggaattttcttaacttgatttttttgatttaattttgataaatttatagtcctatacattttaaataaaattgtttttcagtgctacttagcctcacagttcttgtttctgtctgttatctgttcttgtgaagacactagcctctgtgccagaggcctagctctagttaagaaactgcagttgacccggattgttccagcgccacagtgccttgccatgtgaccatttctgtggtggtgattcagtgaagggctaacatgtacacattagacacaagcccaggaatctgtccctgacggtggtcagggtggtgtggtgcagtcacgcactgtgccgtgtagcaggggccacgtcggtgtaacagtcttcccatccgtacgccccggcacagcgagccacactttatttcatgttagcctcacacagttcacagattgataaaataaaaagtcttcacttgataaatccacatgtgccgtggagaaataaagaaacatcgactagatcaaatcctgcgtcttttctcaaacatgacaaggagtgaagactattgacaaggtctttttaaatctcctgttttctgatagctgactaactagtttgcacagttaaatagaagtaaatgtgcatttcctcagttagcaaacaataaaggaactgtgtctatcttgtatattgatgtttctaatcaaccagtttggaggggaaagaaacgaaagcatacgtgtagttattttatagaagggttaatattagttaataataggcaaatagtttttctcttcaaatgagcttccttttctctctcttcctttctttctttctctctttctttccttctttctttctttctttctttctttctttctctctttctctttttctctctttctctctctctttttctttatttctctttctttctctctgtctttctttctgtctgtctgtctgtctgtctttctgtctttcctcctttctttctttctgaagtgccaattgtgtgtgtttggattgctcaaatccccgatgttgtaccagtatcatgcctgtatcctgaagtgtgtggaacggaccctgcaatacttagtcatagagaatctgctgcagctatgctgttggttcctaagtccccctatgtgccctactctggtgtgtcccatgtcttgaatttcttaacagcctgtaactatataaaaatattaaaatagttacctttcagtcttgtcagtagtgtggggtgtgtgtgtgtacacgcatgtgtacatgcgtgtgtacagaggccacatgaggatgttgcatgttctgttcagttactaggccttactcacttgaggcagagcctcccactaagcctggagctagactgatggccagtaagtgccagtgatcctgctgtcctgccatctctgtttcttacagagccaaggttgcaggcatatgtgccatgcccagcattttctgttgatgccagggattgtacctcagatcctcacgcttgcacaacgagcactgtttcccactgagctgtcttcctagcgctccttatcagtactttggctctgtaaaagcacagaatgtccgtgaaaagaacggtctaaatatccaaagatgacccctgaactgctcagtgtgtgtgggtttgtaactggcttgttcttctactgttgatggccacagtttcctaggacagatactgtatttagagattcgtctctgactctcccgcttattaccatccatttctttgacttggttagcctattgcatttgtcagtcagagcctttccgttggggttctgtctccattcataaattagtaaaccagcagggaaagtttccagataactggacctggctagacctaacctaaccagaccttcgtgtgcatggcttttaacgactccttgtacagtatgtgtctgtgtcctctctctgcttactcctcaaggaaaagaaaatcactgtgaagaactatgtttgtttttaaattggaaacttgaatacaaatgggaataaaaattctttttgacacttctaagttatacatttataagtctaatgagatccttggcaggatctaatatatattcaaaaatacagtgatagaatttataaaaatagtaaaaaataaatattggaggagtggggcagggtgtgttattacatagactttgtgacctgaaggtgccgaactaaggcaacagggcctattagagtacattaagtttctgtgtgttatgtggccatgtgtatgctacaacagctcacatagttgtcatagaaacctcatgaccctaaaatattaatctctggcccctcacaggaaaagcatcttaacctccactttagatttcaaaaccaaaccaaaagccagtggcctgttcttgccttggaattgggaagggcaggtgtcggcatcaaggtgaaacagaaacgaaaaagtagggaatatgtttttcctaattttgaccctatgggaccttactaatctacagaaggccacacttgccaatggaaacctatccagtcatgttagtgtgtcttttcatcagtattaagatctaccttcattctgtggttctgagctcatccctacacggatgtgttggaagagcatcagtgccaataccaaattccctcagggttgcacacatcaagttatccttgaagccatccttggtggtgaccatttgcaggggctcacggaacattaaagcaaggggcaatgaccctctctgcttcatcattggtgcaaaaggtcatggggattgtaagaaagtgctgtcagtttcccctattaagtgttttacttgcacagtgttaggctgatggagctctgattggtatgcatctctgtctcacttctgtcgtccaacagaatgctctgtgacgatggcagtggcaaatcctggtacagtccactatctagccatcaaccatgtgactaaagatgataaggaactgaactattaggtctgggaagatgtctccatggcaaccctgatgactgagtctggatcctgaggatccagaagagagcagtagcctccttgtctgtcatcccagcatgtctagaggaaataggagtcagagacaaggacaccacaagtacttaggcagctttgcctggctcatgaagtggagaaaagactgtgcctcaggtgagatggaaagaggactaacacctgcctttggtttctgacttccatgggtgtgtcagggcacgtgtgcatgtccacacccatatgcaggaccatgaatgcttcattcacatatacagagagactgaatcattcaatacagtaattaatagccacatgtgcccggtggctgcatatcgtaggtcacagctcatttaaagctcatggtgattaagctgtatcgcgttcacttcaggggagcccgaattgatcaagtgctctgcttgtgaggccccatactgtggtaccttaattaatcctctcagatactcagactctgtcatcatcacaggtaagaaagatgtattttagttttatctgaggaggtcttttacctgcatgtatgtctgtgcacgcatgcatgcctgttccctgcagaggccaaactagagcatcagattccctgtaactggacctacagatggttgccaaccatttgagtgctgagaatcaaacctgagtcttctgggagaacagacagtgttcttaaccactgagctgtctctactgtcccaagaaaaggttattttaggctaaatattgaattctaatttttttaaaaaggtaaatacatacccatgccactttgtttataggccggactacccaagagatgattaaaatgcctgttcgctttcttttttgctatctcaaaatgcttgcccatgttggtttgctgtcttgaactgggagtaactactggtccttggcttgcttattttatgtgcttttaaacatcttcactgtctagaacttattcctatgctattgcccagttgatggtgatatttttcaggttggttgtatctctgcagcctatgatgtacaatctaaaactctagcttgtagaagtttcccatttttgtctttcacttgtggttgtcaaccatggatgtcacctgaggtgtttagtgtttcggatgattcaggatgtaagactcattcagccccttgggaacttactggctaggggcaacagggcagaactttctcctctgagaatacaaaatgatgtgtgtgttctgtccgagtagctgtcttttctcccacaactgtctcccagagctgtaaggggtcaaatcctgttcagccaccatctcagactgcaaataggacgagttagtgaattctagctttttcagagctcttttcatactctgaaaccaagccactttaggatcacttcccagaatatgccatttaaaaataggggatggaaacatagctaattaagtttaattcaaacaaatgtttgcctaacatctgctctcccctggcaatgtggcagctgcaggacaaaagcctattcaataaacacaaaccttccactcgtggagggggagaaccacacatgctcagagctacccagcggctcttgacaggacttggagaagtgacagaaatggaatgtgaaaaattctacaggaacttctcatcagtaatgggcatatcgcttgctcgtgtgacgtgtgtcggtgttgttagcaattttacatctttgggggcagagttttagaaactatatttttcagacacttaaattggtttaaaagtgaataattgattaaacgaagtcttaaatcttccctcctccatttatgggccttctatctttacttgtagatctatcctattcctgacaagtcactctcggccagcctttgacttgtgatttcagacttgctgagctgccctcccatattgaaggcccatagagtggatacgtttgccttccgagcgcttcagatgtgaggatcagccagtcccaagtgctacactgggtctcagaactccaataaacgtaacgtttaaaaaaaaatcacctttaaattatcttcattgtcttgctgttgtttgtacacttagaaagatttctgcctaaagtcccacaatttggtcaaggattccctcacatttcagtctgaaaatacaaaagagcttgttaatctaaacatttttttttaaacacaaagcacatgccaaaagtaccaagtgcacaaaagtagtgagcactgggtgtcttcaacatgcctgttctttattccaactcgtcctgggctaaccgaagtcgtaccacctcgccattatggcccccagttttatattcagtcataatgtgtgttgctattacagatggaagtcacttgggtcctgctacaggagagctaacaaggcctggtgggctggtgaccctggaacctgggatccatgcagcaatattccccagaatcttggatttgatcaagcttcttcattgttaaggcatatgtcatgtgaaaaacatgttaagtttccaactgctatggctttccacactctttcatctctactttttccttcccctcattccctgggtgcaaacataagaccctttgctgtgaccccatggctcatttgagggtctggtcatggcttttgcttttggtcattattactgttttcagcctgttttctctgttgtttccccagaccgggagcttgtttttgtggattttctctacatcatccattttgttgttcatcagttttgttgtttattttcttttattttaattcctatgccttttcagttctctaatttccatttgggatcctgcaggggtgtctcagcagttaggagaatgtgtcgctcttgtagaggaaattaggtcctggttcccagcagcctcattcagcagctcacagccacctctaactccagctcggagtaatggatggctatggcttccctaggtgagtgagtgttgcaacagcaaacccattgtctttataatagagccttaaatagctgagaagatgttggtgtggcttcatggtaaagtgcttgtctagccctgggtaccatgcccagcactgtacaaaacccagcatggtggcactcacctctaattccagcacatgggaggtgaaggaaggaggctcagggtcattatctctatactgtgagtttgagaccagcctggactacgtgagaccatgtctctagatagataactatagtatttctgccatcttgaccttggtgtctgttgactgctattcgctctctttgaggacttcgtgatatttcccttctcctcatgaaaagtatcttttcactgaaatgcggatgttaggtttctagacactgagtcttacttaagcctctgattatctggctctgttccagaagtgggagaatcttaaccaccaggacaggtaggtggccaagttccaccacagaccacattcatatctgagcacaggccaggaaaaggtcaggcattctgattttttgttgtgcctctgctccctggctcaaaggcagggaactgcctggtcacttgggagtcccactgccacctctaacagagcagcttacatggccttcttaccagaaggtgcggctagaagtctcgattccacgtgggctcctcagacatcttgacagagcaatgggaggaggcttcatttctgctaagtctgtgttggaacctacaatgcctgatgttagtagatgatctcctctgacagcagttctgagtcttgtttttgcctaccagggctaaacgtctagctgtgccactcagcatccctggctgtcctctcatagcttggtaaaggagagatctaagctcccccgactccatgcctgctgacttttgtaggagtgaggccatgggtgatcttggtgggttttgctgaatgaaggcattcgtggtgttaatgtgttctgccttgctggactgcaccataaggtggagttatcagagaagagggagcccaaatacagacaatgctttcataagatccagctgtaggtaatgcctgtggggaggcttgatgggggagggcccagccaattgtgggtagtatctccctgggctgttggtcctgagttctataagaaagcaggctgagcagggccatggggagcaagccagtaagcatcactcttctgagaccccagaaagtgcagtggcaaggtcccttttatgtcacataagccaggtcaggaagtactaatggacaaggacaggaaaaacacaacaaagctgcctattatgtctaagcatgtaagtgtgtgtgtgagtttatatgagtgtgcatgtgactgtgtgactatgtgtgaatgtgtatgtgtgtgagtctgtgtatgagtgctgtgtatatgagtgtgcttgtgactatatgtgtgagtatatatgtgtaaatacaagtgtgtgtgaatgtatgagagtattgtgtatttgtgtgtgcatgtgtgaatgtgtgtttgtgaatgtgtgagtgtgtgtgcatgtgtgaatgtgtgtttgtgaatgtgtgagtgtctgtgtgtgcatgtgtgaatgtgtgtttgtgaatgtgtgagtatctgtgtgtgaggagtatgtatgtgagtgtatgtgtgactgtgtgtgaatgtatatatgtttgtattatgagtgtgtatatgtgaggagtgtgtgtaaatgtgtgtgaatggttttaagtgtgtatatgtgtgagtgagtgtgtgtgtgtgtgtgtatgtgcacatgtgtgggagtcagagacaaatctctagtgtcctgccgttgaccttgtttgcttcccttgttggctcgccagggagccgtagtgactgattccaggcgggggccaccacatccagcttttcagactgggggctctggggagttactttgtcctcatgcaattttgccaactctcggccttcagttttcttttaacctcacatcatagcatttttcccaggtactgtcacctcactgttaattatcttctttaatcagctttttatcttctttttagaggggatgatgtgacaatctgtggagtcaaacaggaggtgcctccctccacctggaaggatctgttaagcagtgtctgcttgtacagtgaggggttcaaatatgtgaacaaatagttcccatgaaggaatgagtccttgacatatgttcgtacattttatttactcactaaaaattctatattggaaagacttagtattaataaccagtgagactctagccaacccccaaattattagatgtctgtgagtacatgggccttcaagaaacctgcattcttgtttacctctatccaagatgtttcacagtggatattattccaggttctaaattagttgttttccttcttggctgaacaagaaatgttcaaattgaattcgtgttcattcttggctggggtgggctgaaagcagaatctgagaggggaaatcttatgcaaatggtttactttggtcaacttctcaggagaagcataaagaggggagggagtggattgtgctaggagagggaaacacacagaggtagctggctttcaagcctagtccaggccttaccccaggggcattctagtcagaaatttcactgtgggaaattctgtcccccagagcccaggtaactccacattccgtcaaggatctgggtagcctctgctaaagtgcgctcatttgatcctgtcatggggttgaaaatgaagcagctcctggcactcggaggcttacccttgcagaaccacagtgtcagctgcagccatcactcacaggaggaaagggagacatgcacctgacacagttatcttcagtaaacaaaggtgccacagtattaaatatcgtgtatctagcaccctgtgatctccacattaggagacaggaggcagttaagtctgctaaactaatgtacctgcaagtctaatggttgagacagacctctaacaccaacgatcacaaaaatgttaaatgtaacttttaaatattttgtgtggatagcgtgtgtgtgcccacatgtgtgtgtgctcatgtgtgcacagttgtacaaatgccatagcacgcagcatttgagggtcagaggccaacatttcaggagtctgttctctcctcccactttgttttgaggcatactgtctcccttttgtgtttctgccattgcattgttgcattgcatactgatgtttacacaattctgtctctctgctccctccctgcttcttgtatctctactggcaatacagatgcacacaacggattcagcttgttatgtgagtttcagggactcgctgaaatgcacatcaagttagttgccacaccacaaaataataataataataataataataataataataaaataaaataaaaataaaaagttctatggcaagccacctgaagctcaagaacgttccttatagcatccagcatccagagtttgttaggcacttgagtgctagtgtgtggtttttagtgggctcagctgggcagctgttcttgctggcccagcttagcaatggctgatggttgacctaggctggctttgactggtaccctggattacttatctctgctccatgttccttatcattcagctgcacgtcctcacaaacacagcggagagaatacaaagcacttttagccacctgttagtgtcccaaacataaaaatctcattggccaaatcaagtcacatgactgcatgcagcaccagttttctgtaggtgcaatctacctcttgataggagctgttgcaaatcccatggcaaaaggcccgaatataaaaaaggaagtggagtccagccattaatgtcatcatgagaaagagttaaacagagatcaaatgactctggatcggtctggagcaactaggatggtccatcattgccaccatccagtatcccgcttgaactctggggcagcagtttgcctcattcatcccctgagccttgccccagaacacaccccagcccctcagcagcactgtttttccttcttccggcttccagctgcagttacagtgcacataacctgcctcctaaggctcctgagtgctgcgctcacaattcatagctcctattttccttcccttaccactagacttgcta

SEQ ID NO: 1034 - DNA, 2129 bp, Mus musculus
ctctccctaggccggtcacttaaccccccgaagatggctgaacctgcaggagtaccagagcaagaagctcatgtcagagcacggagtgagagtgcagaggttctttgttgccaacactgctaaagaggctctggaggcagccaagagattgaatgcaaaagaaattgttttaaaagcccagatcttagctggaggaagaggaaaaggtgtcttcaatagcggtttgaaaggaggtgttcatttaacaaaagaccctaaagtagtgggagagttggctcaacagatgattggttataatctagcaacgaaacaaactccaaaagaaggtgtgaaagttaacaaggtgatggttgctgaagccctggatatttctagagaaacatacttggccattctaatggaccggtcccataatggccctgtgatagtgggcagtcctcaggggggcgttgatattgaggaagtggcagcttccagtccagaactcatctttaaggagcagattgacatctttgaagggataaaggatagccaggcccagcgcatggcagaaaatctgggcttccttgggtctctgaaaaaccaggctgcagatcagattacaaagctgtaccatctcttcctgaagattgatgccactcaggtggaagtgaaccccttcggtgaaactccagaaggacaagttgtctgttttgatgccaagataaactttgatgacaatgctgagttccgacaaaaggacatatttgctatggacgacaaatccgagaatgagcccattgaaaatgaagctgccagatacgatctcaagtatataggactggacgggaacattgcctgcttcgtgaatggtgctgggctggccatggctacctgcgacatcatcttcctgaacggagggaagccagcgaacttcttggaccttggaggtggtgtaaaggaagcccaagtctatgaagcattcaaactgctcacgtctgaccccaaggtggaagccattctcgtcaatatctttggtgggatcgtcaactgtgccatcattgccaacggaatcaccaaagcctgccgggagctggagctcaaggtgccactggtagtccggcttgaaggaactaatgtgcaggaggctcagaatatcctcaagagcagcggactccccatcacgtcagctgtggacctggaggatgcagccaagaaagctgttgccagtgtggcaaagaagtgatgctctccctggctcccatgaagaagggcatgtccctgactactgtgaaagcaattgttttctcactgggaagggacacacacaaggatcatcatgtgaaaaatattaactctgaactttctcaaatacgttatccagagtgcctaaagctgaatttatactgtagtcattgtttaaaaaaaaaaatcactccttacaatttcacatcttctcttgcccattcagtagcagggtctaccagctctgggccacagtcagtttagccaaatagtgtgcatacatacagtatttaaagccagatctaggttcattcacaagggcatttattctacattagaaaattttacaggaccctcaagttcagacaggctgatatttaacatagtggcttccagaagggtacagctaagacacctgagcttctgtgaccagtggcctccactggcccctaattccagtacattaagaaagcccatgaacatttctaaagtgtggcttatattgggcatcccgtgttgatatatgtacattgcacacattttaccctgtgccttaatgttgaatctactgtttgcctcacactaagttactaccagaagccttagtcatgggtgtgaggtggaaggtttcattttgtgtcagagttgctgaatgttaatctatttcataaagagtcacactaatgatctagctgctggtagcggccaggcttttccctcttgtcccctccacctcacatctatcagtttgccacagaaagatgagagatgccattggacagaatgtgaccttcctaatgatgtccttttttgtgacaggaattttcttaacttgatttttttgatttaattttgataaatttatagtcctatacattttaaataaaattgtttttcagtgctac

SEQ ID NO: 1035 - protein, 404 aa, Mus musculus
AGHLTPRRWLNLQEYQSKKLMSEHGVRVQRFFVANTAKEALEAAKRLNAKEIVLKAQILAGGRGKGVFNSGLKGGVHLTKDPKVVGELAQQMIGYNLATKQTPKEGVKVNKVMVAEALDISRETYLAILMDRSHNGPVIVGSPQGGVDIEEVAASSPELIFKEQIDIFEGIKDSQAQRMAENLGFLGSLKNQAADQITKLYHLFLKIDATQVEVNPFGETPEGQVVCFDAKINFDDNAEFRQKDIFAMDDKSENEPIENEAARYDLKYIGLDGNIACFVNGAGLAMATCDIIFLNGGKPANFLDLGGGVKEAQVYEAFKLLTSDPKVEAILVNIFGGIVNCAIIANGITKACRELELKVPLVVRLEGTNVQEAQNILKSSGLPITSAVDLEDAAKKAVASVAKK

SEQ ID NO: 1036 - DNA, 296405 bp, Homo sapiens
  misc_feature (1)...(296405): n = A,T,C or G
ctctgctaacattcattttgcctacaatatcaagagttctccacattatttcagcccatggttgtaggaactgggggcctaactaggtcaaaagcctaggattctttgccctgctttctttgctgaagtgagcagacctccttcagaagctgatctgcctctttgacttggctttcagtcaatttactcctgccataatcacgtttgcttttccaggaacttaacaaagcttgatatcagaagaggagaaatcatcatttgcaccacttctatctacttctgctgtaaaatcttttttttttttttaaccaagtataggttctctctgattttcttctcttgctgtctctaatctttttatatacatcaataaaagccaaccaaacaaacactttctggaatgcttgagtcttcttatgtctccactgagaaagtcccagggcagcatttttacagctaccttgcagggcccagactgcaagaatgttagagaatccatgctgtgctagaaataatatggaacacgatacaagttagtaattgaggtggtcaggaaaacaggtaggaatgtagtttagagctacagtttcaaaactttttttttaaatagcagaaccttttttctaacagtctcaaatgcttctcctcctattccagataaaacactaatatgagctaatatggttggttgtaaatgagaggcaatataatctatcctgaccccacattcccttgatccaccctggaagttatttgcagctcagaaggatagacccagcctcaagcacctgaatctcttggccctaaggctttatctaggtacagtggcatgaaatggcccataagggaggcaggctggagatgaagaaggagttcagagcaggtgtgaatgcccctaggagcatccttcaaccaaaaaggcatgagagttggtgaataaacatgatcagttccgtgctcctcaatgaaacaattatacagtgttttccataagtctctcgaaggtttccaaaaaaacaaacaaacaaacaaacagaaacctcaagtgcctacagcatatcaatgtagtcttttactagtattcaccttctccatctcacctcctcaatccctctcctgctgtctaggatcacctcttaaataatctctttgtatccaaatccttgttttaacaactgctgtgggagaaacccactttagaaaatggaatgatgatgcagagactgtacatcagaattagatagcccatgttgaccagtatgatagccactagccatgtgtggctattcaaacttaagtataaattaaataaaatcaaatgaaattaaaaattgatttcttcagttgcaccagccatacttcaaatgttcaatagccacatagcatgataatgtacagcacagatatagaacattttcctcattgcaggaagttctattggacaattctggcctagaatcaattccagattggttggaattggccttctcctattctttacatcaggccacttactctctgctttaagactcagtttgtacgtctgcaaaataagtcggtagtgaggattaagataatttctgtaaagcatttagaaagcacctaagtgttcaataaaagcagggagaaggagagagtgagatggagttctatggtgtccaaggactctgaggaactgtacataaaaaccactagtgtagtgcatcacacagggcaggttatttcccttcatgggcctccacttcctttctcactggggactactggcagatttccagacactcatgaatctttgcatcttcttattagggagatttttgcaccagcttcatctttatttatttacccatccagttaatagcagttgggcacctcctgtcttccaggcactgtactgtgggcagaataataacactgcaagaacacggtccctgtcattgcagattttaaaatcctgaaggatgaagcagacaagtagcaaatgcagtaacaaacctctaataaccactgagatacccctagctcccgcttcagggaagcttcctgaagggggtgactgaaactcaaaggatgagagaaactcatgctggtgaacaacagggaagggtgtttcagacagagggaagagcatagaggcatcttttggagcctcagtccatacttcttgctggcatgtagtaaattaggttttagaggggctggggaaagtttgaagaggatggtagaagtaggggaagaaagggaagagaaaatgtgaaaggtgggaatgggatagctgctgatattccctctagctatgccaaagtgctacctttgatgcactgcaacctctgcctcctggattcaagtgattctcctgcccctgcctcccaagtagctgggattacaggtgcctgccaccatgcctggctaatttttgtattttcagtagagacgggatttcaccatgttggccaggcaggtcttgaactcctgacctcaagtgatctgccagtgacggcctcccaaagtgctgggattacaggcttgagccaccgcgcccggctgatgttggtgtttctccaaccatgaagcatgaaccacctacaacaaagacagtggagtaggggcattatttataagaatgcagatcctcaagccccaagacagacctactgaatcagaacttctggagaggatggcccaaaggaattctgttacacacctaagctaagaaccatggcctgtggctgggcacagtggctcttgcctgtaatcccatagctttgggaggctgaggagggagaatagcttgagtccaggagtttaagaccagcctgggcaacatagtgagcccatctgtataaaaatatatattttttaattagccgggtgtggtggcacatatatatagtcccagctactctggaagctgaggtgggaggattgcatgagcccaagaattcaaagctgcagtgagctatgatcatgccactgcactccagcctgggtgacagagcaagactcaatctcaaaaaataaaaaagagaagaagaaaaagaaccactgctgtggctgctcactttataatgaggcaggacatttgtaaaagaatgttcctttaatttttactttactgtttaaaagaagctatcttaataatattgaaggtgctgaactccgcaggttccaattgcaataagaatttaggttttgtttctaacttcttttccacagtcaatctaatgctacttttctctttcggttcaagaacctccacagtcctttgtgtaaatgttctttcctcagcttttaccatcttcttcatccagctccaaacttcctgccaaaagaatgtcatcacccttgtttccaccatttcatcttgttctctgtttttagtctcttccactgaccttgtctccagctgggccttccctaagttaatgatgttccttactcttcctcctttcttatcttaactttgacctgtcaccactgctctaaacttgcttcctgtgaattctctccaggatgcagtgagaatttctcttgagcacacttcagtgttggcaaaggagacagtttttgtcataaatcccttttcttctaggcaccttacatagtcgtccctcactgtccatggaggactgattccaggaattcccatggataataaaattcatggatgctcaaatctctgatataaaatgacataatatttccatataacctatgcacatcttcctgtatactttaagtcatttttagattacttgtaataccaaatacaatgtaaatgctatgaaaatagttgctacactgtattttttacttgtatcattttttattattgttattttttattttttccccagaatattttcaatctgcagttggttgaatcatagatgtggaacccacagatacagaggaccgtcatttaaataaagctgctgagaaataccatcaaaattaatcattttaacgcattattgaagagggaaaaataacttgagcacaatgaccattctttctgtgccactggcaaacaatacaactgaatcactggttaaaatggctatcacaaatagcaacagtgatattacctatgcatacaatgaaagaccaaaaagtttagtctcctgtaaattccagaaatctgttatccattaaaaaattaaccagatgaaatccacagatgccctttatttcatcattgtaatagtgattttcattcttgacatgcagcagtatgaactcaaatatgtaattcatgaaaattagggttgtttcttaaaatattctattcagctctgctggttacaattagtatttgtcaaacagtttttatgctcaagtgaaaaggtaatgataaaacaccaccagaactgctagatgcagtatccctttgctgggtttcatgatatgtctctctggtaaatctgcgcccctagagtaatcagtgcgaatatgaaaatgagcacattatttcactgttaacaggcactgctaagatgaaagcgaaggcatataggcctgctgatgtttttatttttctttttgcaacaattaactgaataagaaacagtatagccaaggtgctagaaatacaaagcttaatcgtagagttttacaacttcatatttcaaatgcatgcagtttatgagaagtgttacactgtcaactcacagctcaaataagatgtcatacttgaccttcattttactaataggaaaactgaggttcacagatgtaaatactaaagaaataaacacacgaaaaagagttcttagtcaaataatgaaggtatggtaggtaacagccactgggatctcaagtgtttgaggatgcatctcattggcaaaataggtactatcataatcccctttccacagatcaaggaattgagattgttaagtacctggtccagggtcatggagcttttaaatcacagagtcaacacttgcaatgtctacctctgtgcttcagtctgatatcagagtgcagaatgctttcaatagtgctattgcctatggccatagttactgttcaagcagttcacaattgccattttgacacagcaaaagcgtagaatagctgttcattcaccttaagccaatgcttctacatgtcgcagccgatttagaccacgggtagaaaatgggtctggtaccaggtgtcaaggctctctgaaagcaccagtcatcatctccatctatgatttatcaactttttgtcctatatttaggaaccaaatgggggatagcagagtaactcgtctttggattcaccaggaaacatcttcagagttcaccactatggtttgctttgtttgcttttttagttctcaaactaaagaacactttgaaaagattatttaaaatgcaggtcccagtctccatcctaagtgattctgatttcatgagtatgaggtggagaccaggaatctgaatatttgaaactctaaaacaaaatgtaatggttccttgaccactactctctatcctcttcttggaggcaaccactttagactcttaatacttttgtctggcatttgtacatctctgtaattctccagtgctatcaagataaattacaaagtgtcaggggtctcctaacctacatctcagattggccctagtgtttcacatttgatatcaagcaaatatttgttatggacccactagaggaagaaaaagaacatctatgaagtctttactatgtgcaaggtctttacatgcaacatctgatcattgactacttactactaccctatgaaccaggtattttcctagtcacaggtgttcaagggggtggaggtcagatttgaatccaatccagtttggctgaaaacttaatgcttgttccaggaaagcacagtgcagaactctggtagaatctagattccctgttctcaaagagattcctatttgggggaggttggagggtggaagcggggagtatgaaatagggagaaatcttacgaggaactctataatgcaattcattccacatatgtttattgattactttttctaatcaaagtccagtgctagacactggaggtgctacataaatggttctctttcttccttctgtcccttctcccctaccaccttcctgcagagaaggcagaatgagataatacgagtaaagacactgaggaattgctgatgaaagatttggaccccagaaccaaggatgagacagtcttccaattcagacaggaaaactcttaggaggctgctaaccctggaaagaccccaagttacgcaccagtagatagtaaacaaatcaaagaataccaaatgtacttggatgacaatcagaaagcctctcccgactccactttcaaaaatccccccataatagaataatcgcatcttaaaagaacactcatcaatcaaagacagtcttaagagtctctcctttatctctataaaactaacacttctttcaaacgacttctagtctcatttggaaggaaagtgatagtagccaactcccttagcatagtaacgtctgaataaacagcctttgattaattctataggtggtcttcctccttttggcaaaatgttcacaagctctcaccaagtttaaacgttcactctcaaacattagcaagtctttgctctatcccggcggacccagtaggggtaatgatgaacaatatggaaactcaaatccagttttgtcaagaggagggtgctaagagtgattggagtccagctttgggaaatttgatcccaagctgtgtcacccttggcaagttacttgaccttagagtcatgtaaatgtcatgtggaactctgtggccaagtttctctctggcaaaatgggaataatagtaggaccccatttgcagggctcctgtgaagattaaatgactgaaaacagaggcagcagagtgtatgtatcaggaaagagcatcggtttgccatttaataaaaaagaatccatgagtccacagtgatacaagtgaataaaacaattcaccgacgaatagtgttacagtgaactaaatatggcctaaggaggactcggtacttctatatttgagtccttgtggacgaactgcaacctagcttaataggtagacaagattgaaaacctaacttagaagtatggacctaaaacaacagctaagtcttggcaatcccagtggccatattttaaccatttatacattgccgagtgttcaaactgtgtaaggcaaatgccaagctgtaaccaatccagctgttctgtacctcacttctgatttctgtaagtcatttcccttttttcctctataaatcttcttccaccacgtggctgcgctggagtctctgtgaatccactgtgattctgggagctgcccgattggcgaaccgttcattgctcaattaaactcctttacatttaatttagctgaagtttttctttcatcaatggagatgatggaaagagtgcagtttttctgagtagaatacagactaataaatgtaggatggagttagaccttgccactttgccaccatcgtgacaataattgatttaaacaatcatcatcatccttatcatcaaaagatgctacatctagtgggtaaaactatgtctcgaaatgggctagaaattatattaaaataaaaatcctcagctcccccactttccaaagagagagattaggaaagaagctagtagcaacagctgtctacttatgtcacattgtaccttttttcatgatcatatgctcaagaatgagtaaggttaaaaaaaaaaatctaaaatagtgcttaatttgggggtgggtggaagggatgtgaatctcatctcttatcagacctgccacctctggcaagttacttaacctctgtgcacctcagttttctcttctgcaaaatggggattgtacacttctactcatttaaaactttgctatgaagactaaacaagtttatatttgtctaatgcttggcacacattcagtaactttgctgttgtttttattatatgcacattgcttagactcgcgtaaactctgtgaaagggaaataatcttgggactcccaaatcactaaggtaaagggaaaagttaaggtgggaactgcttagggcaaacctgcctcccattctattcaaagtcatccctctgctcacagagatagacgcacagctgattgcttcctttggaaaggccaatcagaaacccaaaagaatgcaaccctttgtgtcttatctacccataacctagaagcccctccttgcttccagttgtctcgcttttctggaccaaaccaatgtacattttacatatattgatgtctcatatctccctaaaatgtataaaaccaagctgtgtcctccaccacaccttgggcacatgtcaggacctcctgaggctgtgtcacaggcacgtgtccttaactgtggccaaataaacttcttaaattgattgagacctgtgtcaggtatttggggttcacagctccaaatgaatgttgcttttatcactctgattactgggcttaaaatcctccaatagctttgtgtccggaattggttccttcccgtgggttcttaatcgtctcgctgacttccagaatgaaactgcagaccctcgcggtaaagatggcgtgaccagaatttgttcctgcagatgttcaaatgtatctggggtttcttccttccggtgggttcgtggtctcgctgacttcaggagtgaagccgcagacttcacagtgagtgttacagctcttaaaggtggcccgtccggagttgtttgttcctgcctgtgggttcgtggtctcgctgacttcacgaatgaagctgcagacctttgcagtgagtgttacagccctcgaaggtggggcatacggagttgttcattcctcccagtgggttcgcagtctccctgacctcaggagtgaaactgcaaacctttgtggtgagtgttatagctcataaggatagtgcggacccaaacagtgaacagcagcaagagctactgcaaaaagcaaaagcacaaagcaaccacaacctggaaggagaccccaactaggggccactactggcgccggtgtccagcttttattcccttatttggccccaccctcatcctgctgattggtccattttacagagtgccaattggtccattttacagagtgctgattggtccctttttaaagagtgctgattggtgcatttacaaacgtttagctagacacagagcgctgattggtgcgtttttacagagtgccgattggtgtgtttacaaacctttagccagacacagagcactgattggtgcatttacaatcctttagctaacagaaaagttctccaagtccccacctgattagctagacacagagtgctggctggtgtatttacaaacctttagctagacacagagcgctgattggtgcatttacaatcatttagctagacagagaagttctccaagtccccaaccgacccacccggcttcatctctcagctttacattgattttaggttaaggatagaacaaaacaaaacacccacaactccttaagggatggagagcctccaatggcctctccttgactcacctgaagccctgggctgcaggaacctcacctgtctctattcgttaaagtctcagctcaaacaccactgtcccagataggcctcgtgaccgcaggactagaccacggttctctgcggagggcgtcagctccgtgagccacccttccagcacccactgccatggcgaatatttgcttgtttggccatccagggactgtttgagccccaagaccgcagggctcggggtctgtctttgctcaggacgataacctggggactggacagtaggccctcaggccttgggaccgctcaaagtgaaccggggccgggtgggggacccagggctctgcagccttaagaacgcctgtgcccccgggacgcaggggtcaggcccggcccggcccagaccgcctctgcctcctcctccttttcctccccgcgcccgcttctcctctgacccctcctcccgctgctcctcctccgcctccttcccctgcccgcgcccgccctactgccccgtgccgagtttcctgtttaagatggcgtcccccgtagcagcgcaggccgggaagcttctgcgagccctagcgctgcggccccgcttcctggcggccgggtcccaggtgagcgtgggggcaggagctgcgggcgccagcagcggcgccggcctgcccgggcttccctcgccccctgctactcttggtctccgcctgaccccctgcgcggcccctcgggcgccccacttcgggaggtgacgcggcgccgggtccaggcgcagcagggaaccccgctccagtgtggggcaggggcggcgcggcggcagccccgggtgcctcggggtatgagcgacccaacgcactagagtctccgctgtctgcccgcgcagactcatggcgaaggcgctgaagcaggcgctggacgcaagtttaagaaaagtttcttggaccgggttttggagccctgaggttttattgtcagctctactaattctgcttttcaaacttctggcactaaccctgagcacgtttagaccacgtgataaacatgcctggaaacccgtttcagcccaactaggaactcaccccctagggtgaacttcctgcaggctacctgcttttgcagacttttaatgtgcctgagttggtcaaatccgtgggtcaaggagaaaaatgggaaacgatctttctcctctttccaatgaaaaatcaggcctgtcactaaaacgcattagaccattgaccctgtccatgtcctccttgttgatggagaatgaaatcaaagagggtcagtggtgggctggatagcgattggaacttggcctctagcagatttttaccttctgcagatggcaagcgttaaaatagtcagaaggacttcaggaaagttttgagttggtgatgactcttgtagaaatcactcaaccactgaactggttagtctccgtagattatctctcttcccttttaaagaaagcacagtctgggattcagccacagcagagttaatgaccttgcctatttccccatttttaattgatgagaggcaaattatcactcatacaattttaaccaggatgtgcatagtatagttttttagaaaatttaaaaaatagtgattaatgattttttgagttcctctaaactttgattatgacatctgtgagctatttttacccctctcctttcatttcctgcctccccatttctctgttattgttaatgtaaatttaaaaggtgctaatacttactactgtaatattcttaataggtgcttgacagtatagtgaggtagcaaaaggaatggcagttttgtctaattaaaactcactaataactgttgtaatagagtaaggagaatagctctaggagatgaagtcctattcattatttaagtgttagaaaaaacaagaactagggtgcttaccatgagtgtagacttgaattgatgagaaacatggggcccagggcagtgaaaactcatgaattgtacagagaaactgaaaatgcagagtgtttagctgaaatatgtgaagcctacttctctaaccaagaaataagaggctgaacgcaacacaggagaaaatctggttggggagagatactcttggtttgtcaagaaaactgggtaaaaagatctgttagcacgccccatctggttactatgatttacatatttgtggatgttgtgttattctgtaaattcttagaaggtaaaagtaggtttttttaaagatagaaaggtacacagtgtccaagaactggaaatggacattagcaatcatttagtccagccagctcatttcatgggtagagaaattgaggcctaaagaagttcaatgacatattcaacgatacagtgagagtttgtggcattccagagtaaaggcttacctttacgtttccgttacaccatgctgtttcctggtgagtatatacttcctcatgaaaatatattatatcaacatgcaaattaatctgcatgccagtagtaactatataacatccaagtcattagcaccactgacacatttttatttttttctttatgaccatcttagaattgtccataaaaatggtgagtattgctattttcaaattcttgggtgcttcctatgatctgtttcatgtacactgatttgatattacgtttccatagtcccttgcccgtggcagacattgcagttaaacatggcccacttctctcatcatacttaagaatcctcaccaagtgtctcagaaatctgttgccactcttggcccagacctattttataccaccaggccttgtgaaaaactgttgtctgtacagaaataaaagacccagtttctgcttagagaaataactttaactggtctctcaaagatacccatagaatgacattttgtctacctcctccctatggttaaatttaacatttgacacatattcctgatgcttagtgtcattgaagtttttttttttttttcacctttgctgttagctttactgttttgacttttgattgatagtacgtccttaaagggtccactttagtcatttcttatttttcatatagtttttattcagcccataccatttggcaggactgttgtaggccctggggtttggggatggtgaatgaggcaggcagagtctttggccacgtgatactttattttaatggaggtgggagagagtgagccagtacacatataaccaataatgaaaatgatttcagccaatgacagattctgtgaagaaaatcagtcagggtcatgggatggagaatggattgcttcacagcagggtagtttagactggatgatcagaggagacctatttgatatggtgtgtttttgattggcataatcttttaaactgaaatataagacatactgaaaaatgaacaattacaaatgaacaacttgatgaattttcataaactgaatgcaaacccagctaactaggtacagatgaagaaaacgatcatttaacaacaacccagaggccccctggtgctcctgcctgtcactacctccaccctacaaagggtcaccagtcccctgacttataacgctggttttgttcagttttgtactttaggtgaaattatatgtaggcatacacatacttcacattgctcagcattatatgtaagtgatcctggagatggcctttttgacatatgagctgagacctgagcgatgaaaggtagccagctaggtgagactaaggggaagagtgtgttaggcagagcagacagcaagtgcaaagactgagatgagaatgagctgggcatgtctaggtaattagagggggaaagtggtagtagactaggtctgagaggaagacaagggccaaatcatgtggagacctgcagggtctgctaaggaggtttcaggggtttaaaccatacagaggctgaatcccagtcctggcagccaaagcacaggcatgtaattaatgtactgtacacgccccctgttataaatctaagttaggctggctttgaaacttttagcagagtggtgttcagtgaatttagcagtaagggtctaaccatggttagaagtctttccaaagacctaaatcctggtagacaggggccatgttgctgtgtccatatagccaagtgaaaagagtgtgcagtacttggtggtgtaatatagccaggcactgccatggtgggcaagatatgagtacatactgccagtcaagtcttaggggaaatgttggctgagggcactgagtttgaaatggttcttaagtctaagcacagttttgttgtctcttagggtatttcccctctctttggctagtggaagttcatggagctctcttgtaggagaagcactgcctttcaggtctccaattttattttactttttttttgaaagagagtctcactctcacccaggctggagtgcggtggcctgatcttggctcactacaacctcctcctcctgggtacaagcgattctcctgcctcggcttcctgagtagctggtaccacagatgcacgccaccatgcctggctgatttttgtatttttagtagagatggggtttcgccatgttggtcaggtttgtctcaaactcctgacctcaagtgatctgcccccttcagcctcccaaagtgttgggattacagatgtgggccactgtgcctggccaggcctcctattttagaatccttgttgtatgttttctgtgcagcccagagcttctgtccagggacttacagaggaatgtatgttgtcaaagaaactgcttaaacccatgcccctgctgttgtatactcagaaagaatggctccagcctaattttctgcctttacggaagtgggaggagaaagatgaatgcatgacttttgtaagtgaaggactaaaggttatgggcaagttcttatcagctaaatgaggctgtggcggctgcattggaagttgtgacttacctgtatctccctcttgcctaggagaataaatatttgacttttttctttttttaaaatgaagtacagctgcaatttctgcttttagaaaagggaatccatctcaaataatttagatgctaaactattgaccttccttgtggggaagaccgttaagtgatagctttgtcctaaattggttttgtttgctgtaaataaggcatttcttttatgggtgagtgattgagtgcacagacccacagtagtgagaacattcctgccctcgtaccctggtctagttctgcaggcgcaaagcccagaaagtcactgaaatatggcatatttgggggaggaaaagaaattacataagtaacctcagatcatttgtccttcagctgtctttaccactcaatctgcaattgtcacttgatgcatcactttctgttacttgatggaaaagttttactgaagaacttgagagatttggaaatatttgaacaaatgataatatcagtacactaatgaaatttggagattaatcttgagagtttgtgaggaaggtggaggtgatgaagaaggcagtccaggtgaattcatgcagaggcagaggtgagagaacagggggagagtagttgtagtgagcagtttagtatggagaagggagaggtggtggatagcagaagttgagggacaatggcactttcgggtatacaaagaagtctaaatggggcttcagaaagcccagaattcagcagggaataaaattaacccccacaactgaaaaatcaaacaaatatcatttatgtagcaaatattttctgaatgcttattacagctcattctttatagaatgttgggcagataaatatgactgagtgaatgcagacaggaataagaaacacagctcctaccttcagagggcacagaggtacaactggcctataaacctgtagttatactaaaacatagtgggtactgcaattgagctgtgttcttagccttctaagatactgttggcctctgtcaaccacttaccctgtgtctgcagaactattccctctgatcattcattgcctgatctctgtcttcatcagctttctgattcaacgttgattcttcagataggctttttcctaattaccttacccagccctgcctttccagggattattctctgtacccttatctgctttgttctttataacacttgactgtacctggtagtgttatttgtttattggccatcttccccgctctcctacaagtttaagaacgtaagctccacaaaggcaaagtgatacagcttaatgtaacagcgtgagtgattccccagctggccggagttggtattcagtaagcatttgtggtctcagtcaatgagtagggtgcacagagaagggagagggaggtaaggaacaggagaagttgagggatgatgtggctcatttcagcaaatgaggaagaaggaaggggctatagaaatcctagttgtgaaagggtcctcataatcatagaactgttccttgggcatgtagtatataacaaggctgcgtgaagtaatctccacacattatttctttaacccttacaacatcactgcaggggagatttcacagtctccatgttttatagaagcagtcagaggcatagagaggccctatagtcatttgcttaaaatcacagtgccagggagtcacccgcctcatgctgataaaggacttatgctgttaaattattaagctctgtcactgaaagatcctagttgggctgaactaggcagttaaactgattgcttacctttccccatctttttgcccttgagtgacactcgcctttggtcatttggacttgtgctgatgaaggtgtgctgatcaacttggcatggttgccctttctggactcttatccaccttcctctctctctggcttcagggtcttgtcaacagagtagtagggagattaaagacacgaagtctgggttcaaattcaacggagttcaaattcttatgggatctcccatgttctttctctgcaacctggagcaaattattgaacctgactgagcctcaatttactgttacttgaaaaggggatcatttgcacagatagttacaaagattaaataagatgatatttaagacatttggcatatgacccgatggtgggcccaggatgattatttctcttgcactgaatttgaagctaaattcgctggtctttttaaaaggctttattgagctagaataattttgctttcccagattcagtaagcatttatcatgtgctgccatctcaggattagtcactggcttggtgcttccatacattttatttcacttcatccttgcagtagccatgtgaaataggagttattgttcccagcttacttctggggaatctgaggctcagaggggtgaagatctgcctcccgggctctgattatcttcaggattccacagttgggatgaatgtctggtgaggcctgaggtggcagtggggaggagctcatggggagcttaattgtaccatcctggttattactcatttcacaaacatttacatgtctcagtgttgacttagtagtgacgactgctggacctcgtgcatcaaagatttgaggtgagggaacacttaaagaattggcagtagccacagcatgaaccaacggccaactggacatgactttcactgtgtgcttagcacaaactactgccctcagcgtttcaagaatgctggagaaattgtgaaatgtcattgcctttgcagagtgggctttgggggatggtgttggaggatggagtttcctggtattctgggttcagactttgaccagtgtactgagtatggtcagcttttaccctttctagaaatgattccaaaagaataggacttaggcagtagccataaatgcatagatttctaacatttacctttgaattttatttttattttaaaattcgagggatttgacataatatatgaattgttaatggagacatggcaaagcacaaggcatggtttgtgtaagtttgggtcctgtgggttggagtggggggactagcatcttttttctgctcccatccatttctccctgtgcttgctgtatttccatttgtgggctgtcttagtcccagagttgtgacttgagagccctaaggaggttcaggagggctgccttgtagagtttacggtgagaaatgaggccagagacaagagcaaggacaagatcgctgatcctggtaggcctggtaatgaagctaagcttgttcttgaggagggcaatagggagccattgaagggttttagacagtgaagtggcaagggcagtttaatgcgtagagtactctttctggatatagtgtggagagggttggagaaatgcaagaatggagatcatttgggcgactttggcatcgattcaatgctgtgagtcattatgccaggatactagacgtacaccgtgagtggaatcagattgcccgggtttaactcttgccttcagcactccatagctttgtgatcttgtgacaattacttatatttctttgtaagataccttttttttttctttttcacatttcagtgtctctgaaagctgaatttatttatttttatttatattttttcagacagagtctcactctcttgcccaggcttgagtgcagtggtgagttcttggctcactgcaccctccatcttccaggttcaagtgattctcctgactcagcctcccaagtagctggaattacaggtgtacaccaccacacctagctaatttttgtatttttagtagagatggagtttcaccatgttggccaggcttgtcttgaactcctgacctcaggtggtccacccacctggcctcacaaagtgctgggattaaggcgtgagccaccgtgcccggccaaactttattgtttcgatattgtctggttttaagtaagggatccacccccatcttattgtctgtggctgaagtcgggaggcctgtggagaggaacagcaccatgctttcctccctgcctgaagcagggctcagggctctgggtacagtgtctggggagtggcctgatccatttagggcaccatattctcccctcccctcccctctcctcccctcccctcccctgccctcccctccattcccctcccttccccgtgcccacagcattgattggcttgcccacagcattgaatagaagtagggatcagcattatagctttaccagaaaatattaaggttttctccttatcaatggagatctcttcacatttttataaggaactattttttatcctttgctttttgtccccagcttctgcttgtactctcttacctgttgttgagatgctatgctataccatctggacttgaaggacttatttgagttagtaagtcctttcctacctttgaaagaaagggggaaaaccagttctcataggcattctcattccagcctgagggcttacgtgggcctttaataagtaatagaaagtggagagttatgaattatttttgattaagggaataaactattaatgatgagtgtttctttgttaagattcagggctcttttaaagtgatgtatcattaaaattgaaagccaacaatacagggaaaaaaggaatttttcagcttttaacttttttataattaccatggaaaaaaatatacgtgctatttggcacattagaaaaactaagtaaattttgagatggtgaagttgtaaacagattatcctcatgaattttaaaatgatgcagaaggactgaatggctgagtgttgaataggatggttggaaatggaggcagaaggcttgtgacttgtcctaagcgagggtgggcctgaggacgcttttaggattggagtcccacgtccaaaactcacagcatagcatgttgtgagtgtctaatggatcctttcttttttgtttgatatgagtatatgatgaggcttttatgaccagtataaaatagcttttatgactatattttgtataaaatataattttaatatgtggggagacttacagagttaaactttataggaagatgagagaaaaatactaaattttctttatgttaaagggccccaagtgagaatatttagtagtggtatttcattttgcttaatattggcagtatatcagtaatgttacgcttatggtaagccaagagtcatagtgttcctttcttgaagatgtgttgtcatgtgctacaggatgaatctatttcctcctgcatacttcagagtccttcttttcaggtcagtggaatatttttcctggaattttgatgttaagcaacattgtcataatttaggtaaaattaattattgacacaaagcagtgttttctgattgacttttagggtgttgagggaggtggcaaaagaattgcttttttgattaaaaatttggatcattaagttccttttttgtctctgaaaccttgtttttgatttccaaagcttctaaagatactaaaaaatatgaatgtgtatattctttaatttaaaatttttattatatatttattattgtagtaaaatatacatgacataaaattgaccattttaaccatttttgccatttttatcattttgccattttaaccatactcgggcattgttatatattcatattgttatgcagccatcaccatcatccatttcctgaacttattcatcctcccctactaaaactctgtacctattcaatgctaactcccccatctccccttcccctagtccctgccaaccactgttctacttttgatctctgtgaatttgcctactctaggaaccttatctaaaaagattcatactatagctattcttttatgactggcttatttcatttagcataatgtcttcaaagttcatctgtgttgcagcatgtgcaaaaatttccttccttattaggctgaataatattccatgatatgtgtatatatcttttttttaatccattaatttgtcggtggacacttgggttgctttccctttttggctatgtgaataatgctgctatgaacatgagtgttccgtggaggtataccttatgttaacattcacctgagtagaaatgttgtatcatatgtagcttgggctacattttcagtttcccatgtccaactaaaatgtctattaagaaatatctttcctgataatgtttctgttgtatattcatattcattgattctttcagtgggtcaaatgcagcacaggtccactattaggcccactattaggcggtggctcacgcctgtaatcccagcactttgtgaggcccaggtgggtggatcacctgaggtcaggagttgaagacaagcctggccaacatggtgaaactccatctctactaaaaatacaaaaattagccaggtatgatggtgtacacctgtaattccagctacttgggaggctgagtcaggagaatcagttgaacctgggaggcggaggttgcagatggtgggtttgtaggaagcttggggatatgagacagttgctgcctttaaggaacctacagtctcatttgttggagactgatgagaaatgggcaattacagtgagatgtgtttggtgttgtgagagcaccccagccctctggggatactgtaagtcctcactaaagacattccaatttgttctctgcttccatacccattccagcactgaatgtaggaagaggataagaagttaattatacagccttggaggacagaaatggtttcaccataaagcaaaccagttttctataggctaattgatgtaaacaagagttttaagttcagcatacttcaggttacagaaacatcatcaaacttccaaagaccaaaaacaccgctaatattaaacagtgaattaaatgtaagctctacttacatttcaaaaagattaataaaaacaagtaagataatgatttacccagtttctggtgataagtgagtgatggcggtcgtagtcgttgtagtttaagtcacagaataaatgtttgcaaagtgaaaatggtagggagcacctcctttcaccacaaagttcagaaacaaacacaaacactgagtacttttggaccacgttgtttagtgtgtttgtatgattattgtagacttgatgaatgtttatttgacaatcatttacattcattcattttattccagttcggtgtcacaggtggcagatgcccatcccagtagctcagggagcaaggcaggaacctgtttgccaggaaccaggatgccattcccttgcagggtgccatctctctcacacacacacacacacacacacacacacacagagtccttttctgttggacttgcctgtacaatggctattaatggtgtctggataacacacacacacacagagtccttttctgctggacttgcctgtacaatggctattaatggtgtctggataacctgaagtgaagcacatgtacaaatagacacctgatgtttatcaagcacattctgtgggccaggtttggtgctgtgcacttgaggaggattatcatgttgagtattcatggcagccctaggaggaaggcattattatagccattgctaagctcattttattttctttacttatttatgtagagatggggtcttgttgtgtcatccaggctggagtgcagtggcaagatcgtataacagctcactgcatccttgaacttctgggcacaatgaatcctctgttctcagcctccagattagctgggactacaggtgcatgccactatgcctggccaattttttttttttaaattttgtagagacaaggtcttgctttgttgcccaggttggtctccaacttgtggcctcaagtgatcctcccacctcagcctcctaaagtgctgagattacgggtgtgagccaccatgcctagctactaagcccattttaaagagtaacaaactgcggctcagagatcttaaacaacttccttgttgtcacagctgttgccctgcacatctcctcaggatgccactcacgtgggtccactgaattatgcctgataatgggtggaattgtgtcccccacaaaattcctatgttgaaatctaaccttcagtatctcagaatgtgacctaatgtaatttgattttctctgtaaagactctatctttaaaggagatagaaggtaagagatagatagaggaaatcaagttaaaatgaggtcgttagggagggccctaattcaatatgattggtgtctttataaaaagagaaaaattatactcgggcacacacgcccagggagaaagccatgtgaagatgaaagtagtgatgcttttgcaagccaagaacaccaaagattgcctgtgaaccactggaagctaggagagaggcatggaccagattctccctcacagccctcagaagaaaccaacccttctgataccttgatctcagactttaagcctcctaaactgcaagagaatacctttctgtagtttcagccacccagtatgtggtactttgtatgccagtcctaggatacccagtatgtggtactttgtacgccagtcctaggatactaatacacacatcaatgaactttttgtggtctgtacatttgtgaagaatgagagtgacaaagtcatcctagtattattatgaaaatagttttgacctcacagacctccagaaccaccctgcattgagacaacgtgggtgtggttgatttttttgatcaaacacatctgaaattgtaggttggtgcaaaagtaattgcggtttttgaaatttgtaactttgcaccaacctaatatgtgaccagatgagcctttgttttttcaccttggcacttctggagtctctgaacttttgctggagatgcatgcttttctggctgcttggagagctagcccatggaccactgccatgagttcttttgctttatgcttccagcacttgttttccaactaaaacattgtttcctacaccttatttgctggtgttggatttgagaagctctgaccatttctacgagtgaaatcaacttaaagacagacgagttgcaattgagaagaatatcccaaggaaaggggcacaggtttattgtcatttcccaaataggagctctagaaatattttaaacaatagcaagagattggaataaatgcagagcgttgttcagatgtatcaattttggtatttttttattttgattttaagtaaatccagcaaacctcattattatttttaatctcacttagtttttaaccattctctttatccagacagctcacccaaggttaaacaaaaacactaacattttactacctatgttccaggccttttgaaaaacagttttgtaacttaattcagctgatctttggtaatcagaagctaacaccaagcactgtttttcttcagcagtctaaagttgaaatttaagaacaatcagcatgcaatcaaaagctgattgtaaatgaacaataatgaacataaaagtgaaatcacttctgagggttctaatgaaagaaaaaaaggagtaatagcagtagttgaaaaaggagcatgataaaaagtgggtgcggttatgccaataggcaaatagtggtgaaaattagccagcaataatattccatggaatgctcaacgagttttggggagaatggggaaaacaaatgttataagagagtaaaaaatctatataaatgtgtagatttactgctgtagatgaagtcatctaggaagaatcgtagtggatttttaggagtgaatcacatctctgttctagatgcaggcagatggtatgcagagaaaaggttcagttgtgcctgtttctggcccactgatcaacagcatggctttagggaagagactcagtttccttactaaactctgtttaacattcattgtacatctatcatgtatcagggattatgctgtgtgccagatacatgcttaactttgcaaaatggctgttgaaacagtgctgcccagagcacgggacacatccattggcagtacacgagatgagtttaggtaacgcagggatgcagcatccaataccagtgagtcacatagtgctgaattcattgttactgtctttggaaccttaggattttgtcacggagaaattttcagttttgtgcttgtgtgcttttaagatcttcagcttaggactttatacctcaaataatcagaattgaatcccttttattttttaattatgctatctccttctacttaaacaaacagtataggtagtgctctaaagttttctctatctttaagttaaaataaacatcataaataaactgatactggtattagtgttctctagatgtagcaagaattgtgtatgagtgattcttgtttggggaaccttggaccatagtaaccctaagacttttcttattgttccctggtcacacatcctgagaaaaggattcatgtgaaagtggcttttcggggaggcattctcaggaaaaactcaaaggggtttagagaagttgaagggaaggaggctgagaagggtgtgttattaaactgaatcccaaagagggtgactttgcttaattccacaggacagctatggaaactgtgtaggttacacctcagagttgtagttaggggcaagagagttgaagtatttatataccctcttcaaggttctttaagggcatgttgtcttcagcatcttaagacaaagacctgccggggctgctcttgggagtaagagtgcacagtgagtctgtataaaaatggtggcgcgatctgaggccatgcggatggagcactgagagcatctgctgcaaggctcttccatggctaatgtgacatgtaagccacttactagctttgtgcctcggacaactggtttaacacttcggtgcctcatctagggtaatacctcttcagggctttttgtgatgtttaagtatcaatatcattgacttcacatttttcttctaaatctattcactattaaaaatatttaaatccacatttgagcccctccataagtaatagtgtccatgaaagtatgggcttggtaaattactgatacatatacatttttttcgaatgtacattacaataaattacacagaagaaagccttgacagagctttctttaaaaacatgccaggaactattatccgttaactgaagccagctcttcttttctctggacacatggctgtactggatctcccagcttgccttgcagctggacaaggccacggaatagctctagatagttaatctagataatttttttttcttattttcttaaacttctatgagggaggaagttcttcctataaccttcccattagacttcctctaggttatcactgctggggattaggtcatatgctcattgctgagccagttattggcaaaaattggaaatctccattattggctaagctgctgaatagtttagaaaaagatactggcgagtcacttacaacatccgctacaattgggttactgcttagtgaccaagataggatttgaacacccacctgtcagactcccaagtctacgtgatttcttctgtgccttacagcctttctaaatctgtctgcttgctataaaggctttccattgaattgatttatttctggaattagactttgatgaccagtaattccaaattatgttcgattgtccacttgctggctttctttatccaccaaacttgcctgtctctcagctgtagggcatctcctgatccatggagctcctaggtaaggcaaaagaactgtgtttgcattcagctgtgtgctgccctatagcagtatgaacagcttcacgctgtcaactaggaggtgaaatgccaagtgtagctacaatctggaaatgtgttgatgtatatcagcttggaaacaatgcagggggcaggttttgggcctttgcagtggagagaccagtccagagagggccactaagtgctaggcattccaatggcattttctctttgacactcagcagcaatctgtaacataggtactatcattatcattatctatcatttatcttcattttacacaagaggaaactgaagcttagagaggttgagaagtttgtctaaactcatccaacttgtaaataatagagtctgaatttgaattcacagctgtgagacttagaagcttacactcttctttaaagctttttaaaattgtgcaatgtagcataaaatactgaaaaaatacttatcatatatgtagtttaacatgtaattataaagtaaacagcacttcctaggacctaagtagaaatttactagtacttaagaaaatctccctctgttcactctttttttgtaacttcatgtctaattttaatggttgtcatttagttgggaaacttgccctctgtaattatcctgtttaactgtcctcttatagcaagtcataatgtggtataggagaaagctacatggatcaaaagttactggcatggatgctccctttctgaactggatttaccttgggcaagtcatctctctccaaaaaagaaaggcagagtaccagataacttacggaaacgtcaaccaccattatcctgataaagaactggttccctggagcatgaagatcaggttggagggcagcctttgcttgcttttttctttgttaatttagtagtgtatttatataaacccttaacaatttcagtgacagacttcactcattttgaatagcaagtattttgttgaattatgtaagtcagtaaattgccctcacactttattgattaaaatgtcctagcttttgaaggactcacaagtacaattttcctgagacagactgtactttcgttttttaaaatccaccgttgaggactgtgcatgataaagtggaagcaagtggttattaattttttattgaaatcttctgaataagtgttttctcctggttggtttcaaaaggagtcatattcctgaatctaattagaggcagttcatatactgtgggcttattaagattcaaggcacttttttattttagcctgtctgatatccctttttaatttcacttaaatttgaattactctaaacatcatctgggcatattgaagaaactcagtaatcttaataatgatgatgttgacaaatctgtccttattcttctcaagtcctataaccttatacttgattctggcttgtgaatacctgagactgagctgcccctctctcttcctgtcgtagacatcaataatcactcatgatgctgttctgagtgattattgatgtctaccatgacaaagccttgaggtcttactttctacagctccctgggcagccatttccagctggtcagagttaagaggctctgccatccctggtctggatgttgtctgttttgggtctgaacgtttatatcctccaccaggatctctgagtaagttacattatcagctgattctaaaaaaaaaaaaaagatactgccagccaggcatggtggctcacacctgtaatctcagaactttgggaggccgaggtgggcagatcacgaggtcaggagattaagaccatcttggctaacacggtgaaaccccgtctctactaaaaatagaaaaaaaattagccaggtggctgggtgcagtggctcacgcctgtaatcccagcactttgggaggccgaggcaggtggatcacgaggtcaggagatcgagaccatcctggctaacacggtgaaaccccgtctctactaaaaacacaaaaaattagccgggtgcagtggcgggcgcctgtagtcccagctactcgggaggctgaggcaggagaatggaatgaacccgggaggcagagcttgcagtgagccgagatcctgccactgcactccagtctgggtgacagagcaagactctgtctcaaaaaaaaaaaaaaaaaggattctgccttggtgtccattttcctacctctttgaatgagaatcttctccttttctagaccctttctattaccatactttgtgtgtgttttcatagctctcaggctgtctgcatagtttgttcatcccaaacaagctcctggacttattctttggccagtctttacccatttctttggagtttctgcttggaagtgacttcctctcctaaggtgaagactctttgtcatttaataggatgaactttcaaagtattgtccctgttcatgagttagtgttccctggctatgtggaatagaaaagaacatctccgcttgagcttgaatccctctggaatatgtgtcattgacagatcctatttcctgtgtgaccatgtaagctcttaacagactgggctttgcatagctagtaactatctgctttggagaaaatataaaacaagtacttgaaggttttggaaagtgccaaaggctgggagaccctggaggggagtcgaaactggaaggaggggagttgaaatgggaaacaaaaggcctgctttgagtttccagtttttacttccagcttttacttccagctttttggtcttgatgacagggtgcaatggtggctaaactccggtagaaaacctgtagtctttttgcactggagaactgaaggacagagttcaggatccctaagcagcgggaaactgggggtgggagggtgtctcagaaaggagagagtcagagaggaggagtcctggattctgtgtataaactgaccaaatcagaaggtgtttcatgaacaacacatgcataaggctgactgtaagtggcccagctaaagtaaaaaagaactaaagtaagacttgagctgctgcccaagagacagagtttgcagtttgagtctgaatatgtgtcacccatgaatcactcttcactgggatctcagcttttttcacttatgtctgatacacacaatgtaaatattctcttttcccactgttcagttgcctgtctcagtttcatatgcttagttcacagttgttgggctttgaaaggcaggcaagaggtctgaaaaactgataaccagtgcaaagcctcagccaaggcaggaatttgatatgaatttttaagggtgatggttctgccacagttcctacctcttttgcacaattactggtgtgtcatgaagattttcctcatgtatttgaatgtcctaggtcacttcatgttgttttgctggctcttcatgatgatgttggaagcagtgttgaatatcgcaaaaatcatagtataatagatgagaatagctgatattttctgagctctccttacgtgacagatgccctaagcactttactcatcctattctcctagcaatcctgtttattattcttgttttacagttgaggattaaaggcacagagtggttgaatgcacagctattaagtagtaaagccaggaactaataggaaaaggaagattggttagtatgacatatacacacgtgcacattctcaaacatgtggttagaattggaagacaggtattgtctgcactgagtttcagcagattcctgaggaagataaatatgaaaaataccattttcatgatactgtgccctgtcaagtttactggcatgaacttggcagggaaaagactaagaaatactaatgagagcccaaagattgaatgaacctttagttaaagagataaatagtgactgagtagtttgcttatccagatgagttagattctgtaggcaatggtttactgactcttgtagctagaatactgctgaaattttcattcatattgaggagcaaattattaagtatagttaattagaatgaaatgatgaaaataaactttataagataactaatagttgactttgtttgcaccagaattcttgaaatctgctccaaaagaagcatatactcttaaaaaaattttttttaaattttaatataattttacaaattgagagtgggtcttgctcaagcaatcctcctgcctcggcctcccaaagtgctgggattataggtgtgagccactgtgcccagctgaagagtcctacagactcttgatagtaaccttggtgatggtagtggtcctggtgaagagttagcaaaggaaagagaattccctgcctgttgtggcaccaaagagctttttacaagacactgagcactgcaatatactggctatgaagaagctagacgatgcaggatcatgtggatacgaaaggaagttgtagcattaggcttagataatatatggagggtgtctacagtggggacatgatgtttcagctctgttctgtattcaaccacatctgaaaattttagttttctgaacaccatggttataaaatgaatactttattccaggaatggagtagtcttatactggattaacagataacagataaaacagtgataacttgtggacaaaatatataaaatataagaaatattttaaaaatattaaaatattttaaagtcttggagtgtaactaaaagtaggcagaaagcggagaggattccatccttgaaggaaaggaaccacactgagcgagacccacattgacatggcttttcctctgagggcccttcatagcccacagcgtgcattaaataactgtccattaaaatgtttctgcctaacaaagttttgttttattattgccaggtaaacttattgaacatagacattgacaggaagcattgttctttaactggcatttactacaactaggtattttcctggcatttcattatggaatttttatttaatttcatccaaacctggggagcaaatcactgtaattatgcctgttacattattttataggctatagaacatgaagaaatcaaatacagaatgaaggagtcagggtataataactctgacttttggtttagaacttggtgtttgaaaacatgcagaccttggtttgctttttctgtatttgaaaggtttgacctctgtgtaaatgactttactacagaaactgattgcagtgtactacattgtttatgaatattgatataataaatatttaatggatacattttgctagtaagtacttcatctagcataaaattagagaaattttacttgagacagtctgcaaaacagcccaaaaaaataatcatgtccttttgaataaccttaaaaacattttacttttcgttattaatttgttcttgattttgttttctggcttaagcacattaattaaaaaatgcactacctgtaccttcatcctcctacacttgtggattctagcgatgagaatggtgaaaagcaccgttggacaagctcagatttatatctcaatatgaaggattataaaatatctttgtacatgttagctaaatctgtgaaagatcaaatgagttctttgcttgacagtgtagatgattatggtgatgtgatagttataatgaaagcatttgttgagtgtgtactttgtgttaggtactgtaatgtatcctcaaaagcaggatctcattgattacacatgataacctggcagcaaagtgattaaggtcatagactctagaagttaggtttgtatccttgtgaccttggaaacatgtgttaatctttctgtgcctccgttttccatctgcaattggagatcaccctttacctaccttatgatttcaaaagcaatacgctgaaacagtgccccattccctggtcagcttgtattattaataagtggttgtggtcattatcatagtggggccagggctcaaacaagtccgtgatccagtgtccatgatcttaaccacatcactgtatgcttgagcatcactggtgctcaagcatgccacctgacacatagtagatgctcattaaaaaatgagctttgggccaggcactgtggctcacatctttaatctcagtactttgggagggcaaggcgggcagatcactcgaggtcacccattcaagaccagtctggccaacatgatgaaaccccgcttctactaaaaatacaaaaattagctgggtgtggtggtgcgtgcctgtagtcccagctacttgggagactgagacacgagaattgcttgaacccaagaaggggaggctacagtgagcagagatcgcaccagtgcactccagtctaggcgacagagtgaaactgtgtctaaaaaaaaatgaactctggattttccctgtagaatttgtgcttgaactggcttatttgtctatttatttgtacataatatatggctcaatgcagagagaaactttttagctttgaagtcttagagataaatgatgatgggcatatgggctgaaatctgtattattctggaaacacgattactgaactgttagccctgggaagtgcctgaccttgtctaataatttgttgtcacaggaaccattattatttgtctgctatgaaggcaagtcagtggccccagttttagatcgagggtcattgtgtccttgggctttgtatctaattaattaattatcattcaacaaatactaaagaagcaccaggtctgtcccaggcatgggaaatgcattggtgaatgcatgagacatggtttgtgcctttgagaccatcatagtctcatgggacgtggcagacactgacaaatcacccacatgtataattacacattgagaggtgttatgaggtaaaatgagaggtcagtaaactttttctgtagatgaccacgtagtaaatactttatttttttattttttttgaaacggagtctcactctgttgcctaggctggagtgtagtggtgtgatctcagctcactgcagcctctgcctcccaggttcaaacgattcctatgcctcagcctcccgagtagctgggattacaggcgtatccaccacgcccggctactttttgtatttttggtagagacggggtttcaccatgttggcaaggctggtctcaaactcctggcctcaaggaatccacccacctcggcctcctaaagtgctgagagtacaggtatgagccctcacacccggccatagtaaatactttatactcctgggccttacattccctgctgcaaccattcacctctatcactgcaggtaacaagagggtcatcttttcctgtggtctaggccagtgaggacgactagcagggagattctgatgagagtcagagagccttatcatttgcttagtaaagcaaatgtcttcacatacctgcactgggaggctgctgaatgctgtcaagtagctagtgaggatctcctgtgggactctcagtgctgttgtaagagagcatcagcctgcaatttcctcatctggactctcaagaagtttatctgcatcttcttataggacattggtcttcttcataggacattggtctgcaaactttttcttaaaggatcggggagtagatactttaggttttgcatgagactactcaaaagcaaaagcagcaatagacagtacataaaggggcaggcatggctgcattacagtaaaacttgctgatgcagggctttgtatcgtatgttagttcaggacagttgattaaagtttagtattctaggcaagtaggttcaccttgtatttcaactcctgttgatggtatccatgtggaacactgtgtaatgaggattgtgaggctgaggtcattcttttgggaaaaggagacgattgactagtgatgtctgtcataggttcagcttgtgggagcactggttggtacaagtgctgggcatctttaatccttgcggctaggagtgccttgcgagcaaggattttgccatctatctttatacataaggtgcttggtacaattgttagttttaaaagggtttatcaaatgaatggacatttatcttgatgccttcccacaaaaccatatttaaatcatttatcctacacaataagtacttactaaatgcttatagcgttaatggcaacatctttttattccagttgttttcgaaagaaaggaaattcattgcattctatgtttaatgtccttgaccatcagtatttaatcttctatataatagaaccaccaaagtctacagtttaaatgattttctttccttgtgtccttgtttgtgcttaaggcctttacatttcttataggtaatattaaacaacataatgcaattagaatttgtttaacatttattttgaaatatgtaagatagataattaaggagtttttttttcacatttgctttataaagtaggtttcattcctttatcgtaaatagagtgtacagtaccttgtatcctcataatacatttctctgaaaagtttttttttatttttagagacagcataagaatccttttataagctcaatatgcatttcctggctgtaccacataatttatcttttgtgtttttagggttgcaagatgagaagggggcagagagtaggattagagaatgctgtaatgaaagctgattttcctagcatgtaatgtgtggtataatgaatatatatatatttggtcatggttcctggttcctggcacatatctaaaaccctgagtggtaggagcttcttttgttacttataaaatgttcttttgttatttttaagctcctttcagccatacctgggtttttatgctaatgaggtgactgctggtggccctttaaatagttttaagggaggggttagccatgccaagaagggtggataggacttttagttttcagtcccctaccccaacacctctaagtaggggagagaggctggagattgagttcagtcacgaatggccaatttcttaatcatggctaagtaatgaaaccttgattaaactctgaaacactgacattaggggagcttccaggttggtgaacacatatgggcgcccccccctcccccatatcatgttctattgcatctcttccatttggccatttctgaggtttatcctttataataaaccagtaatcataaatattctctagagttctgtgagttgttctagtgacttattgaacctgagcagtgggaacccctgtgtgtgcaggtggcctgccaccctgtttgcagctggcatctggagtgggagcagtctgggggactgagcccttaacctgtggtgtttgtgctaactctgggagttagtgtgagaattgaatggaatttttggacaaccagttggtgttggataattggagaattctgaggaaataacacatatttggtgtcagaaaacaccacacatgacatctgtctttgccagtgcttaactcaatatggtgctcagcctctcttcatattcagcagaaaacgttcttacaccaaagcgtaccgaacagattatgctgcaggtttcagagaagaaatgtgaaggcatgctgaatccacaacatcttttctcacgcattctcatcacatgtgtctgttcttccttgttctcttcccctgtctgccttttcccgctgctcactgataacgttctcctgtgttaacatggagcagttcttgctatatataattcccaacttgctgtattagttcattttcacactgcaaataaagagatatccgagactgggtaatttataaaggaaagaggtttagtggattcacagttccacatggctggggaggcctcacaatcatggtggaaggcaaaggagaagcaaagcacattttacagggtggcaggcaagacagcatgtgcagggaactctcctttataaaaccatcagatctcatgagacttactatcatgaaaacagcatgggaaaaacccacccccatgattcagttacctcccactggtaattatggaggctgcagttctaggtgagatttgagtggggacagagccaaaccatatcagttccatgtccactcaccaaaaagtcctgtggtcagctagacacccttctcttcgatggaagtttgctttctatctgtggttacttaaacataccctctgggtgtctcatccactcatcccaaatagtgtatcaaaatattccttacaattgcatataggggtaaatctacctttgaccatcttatacattcatactcaccttcattcaataaaaaactaaatcgaatgcctacaatgtctcatgcagtgttctgggcacggggcactcatcagtgaacaaaacaagtgattgccctgtggagctgctctagccatatacatatataaaattagtacacataagaaagtatgaaacagggaagtatttactaaatttctatgtatttatatatgtcttcctattcctgcttttattatttggggtccagttagaaagatagagactatgcccattattttaacagataaaatttaacatagagaattgagtaaagaagtattggaggactagaagggcaaaaaactccaaaaaaaaccaccactaactaaaacagagattataacttgcaggaggcagtgtcccccacccccaacccaagataaaaggaagaggttgaagctctctaagaacttgggaacttggaacataggtcctgcagagctgggatctagagttttcggaaaggctgctgcttggctggtttcagtggctccaaggctggtcagggagtgctggtagcacctgtaaactggaaccagctagtcttgaaaccagctccttttgccaggatgaggagctgtggggccaggggctatggtgacaaaacattagaaaggagcagatatcatctctatctgccagccctttagtctccctatagtgtgccccatatgggcagaccctaataggaagccagatggcgaaagagaaagtaatttgcaggattatcagccccgcagagcaatgaacacctagaaaggagattttggagctgagacaaaataacttcataactggcacgtcactgataatggcccaagtctaggtcctcttcatctttcttttgatttactacattgaatcccaaagatgctgttcagatctaatgagaaaataattgtgaaatatccaagtaaaagtattttcacacagatgtgcaacagctccaatttgcttctatatggtgtatggttagttgtgtactttgtcctgttttgcagtctatggcatttcccaaaggagtaactaattccatgggatttaaagcagatgccaagtaaaaattggttgggggataactaaatatagttaagtagatttttttttttaatggtcaagctcctcagaacctcaaataaagcatatatcgagaacctctaagtgaagaaaataaaactgtatttcccagatatttgaccatgaaatccccccatcttcaatttcaagctcactgatttgtcttctggttatagtctctctactttcaacccatctctagtccttttttaaaaacaaaaacatttcaaacttctagttgaaaattttttgatacatatactgtcctctcacgtctgtctgatgtattatgcttttttttttttttttttttttttgagacggagtctcactctgtcgcccaggctggagtgcagtggtgcgatctcggctcactgcaagctccgcctccggggttcacgccattcttctgcctcagcctcccatgtagctgggactacaggtgcccgccaccacgcccagctaattttttgtatttttagtagagatggggtttcaccgtgttagccaggatggcctcgatgtcctgacctcgtgattcacccgctttggcctcccaaagtgctgggattacaggcgtgagcaactgcacccggcatgtacttttaaaaagcagttttgtgctatgtcctccttcaactttttctccttcagcgttagttcttctatttgtttctctttcatgatgttggtctgtgttgtttcatcattcttgctcttgtgccctagaccatcctgtcaccagtgactgccagtaactggtcttttcctgttagtagtcccctgaggcactatttcatctcttgggcccgtgtaccctacaattgctgtttttgtccagcataccccttgctgcttggtgctgatcattttgatggttgcccgagcccccgctctgctccatgggtgcccagccttcagacaaaagataaccctagtggccgggtgcagtggctcacgcctgtaatcccagcactttgagaggctgaagtgggcagatcacgaggtcaggagatcaagaccatcctggctaacacggtgaaaccccgtctctagtaaaaatacaaaaattactcccagctactcgggaggctgaggcaggagaatggcgtgaacccgggaggcggagcttgcagtgagctgagatggcgccactgcactccagcctgggcgacagagcgagactcatctcaaaaaaaaaaaaaatgtaaatatatatatatgtagctactcctactttgggtacaaccctgtcctatgctcttttgactgtgggatcctacttcaatctagttcttatctgcttaccattctcctctaccaggggcactccattaatttttttcccctagtgctgctatgaatatagcagcttggtttagacagcttggtccagtcttacattcatcctttctgtgtccccactgtgcttagcactagatcttaccgtgtagtgtaggtgatacttggtgttcagcagattgcttttgggagggggcttgttctcaaggcctcagttcattttcccggccatcagtatacttccttggggtgtttcttctgccctgagaaggtgagtagctttcatgtctagtgttttcagaggcagcaggagcttcagagatcaattttaattttgagctgactgtcctcctttagaggcaaaggtcctcaagagaagagagtaatggccaataagggagagttgtttagatctttctcctgcattgggtagctaattagatgctggctggatctacctggtggaaggtcatagaaccaaatccccactgtggtgcatttctcacctccctggtgttgcttcttgatcctggacgaggtggaaaagagatttcacagaaatctttcattttactttgccagcaaacttgtaaggtcatggtggttgatatttgcagttagcataaacaaacagaggtcacctgtgaataaatggcagggtgaagatgacccaccgagccttcgatgccactcacttaagcttatttctcaattatcaactcccagaactgtcatcttgacattacagcatactttgatcctttctgcctcattctctcttcacttctagtttgggccagttgttagcttgtagcaatatcatctagcatttcactatgggttcctaaaagaagagtcattagtataaaactttcttgatgtttcttaggttcttcggctcctctgattttaagagggtatagtatgtttaggatattgtttcctttgctgcttagatactgtgtcagattgtctatttgtaagagtctttttgtgtgtacttttctgaggtctttgtcatcacagtggacttttcaaatgaatgacagtatgtatttcacacatttcctggacagtgtgacaggctcatttgactaccgtgcattctgcacttgggtataaatttttttttcagggattattttaaagtttccttttcatgatatctagttttctgaaagctcaccttgaatttaacttctatggattattcttatagataaaagtaatatttggatgatttaccctctccccctccctggctaaaggaattcaaattactataagagaagagatgactaacatagatggaaaaatttggcatgtgtttttcttttttataactagggcattttatgtggaatattggggagggccatggaatttaatcatcaaaattattatttctccttaaatggagattttgacaatgaaattgtgaaagaaagggtgctctctgcaatgttatatttttctttaaaagcatctaagatcaagttttccatagcagtagtattttattcatcaacaagaatgaaatgtctttctaaacacaaatagtggacttcagacctcacagacaccaattatcattctgcacagagaacattcaaaatgtcagatgatctcaggaatttccccagcgaaggtcgctcatttcctactctacaagtcatttctttggcaagccagtgtgacaggcaaacttgtgagattgagttagctaggtcactcaaaactgccgctataaagaagtgatgagaagtctcttgctatcaggtaaatcccattaaactcaaatgtatcctaaactattaagcactattagatccttagaaggagcaggagtgggttgattgaataaagtctgtcccttgcaagctttcatctggatttattggaaaggactgtggggagtaatttaaggagggctaacaaattgctaactgcagggtgtggagatggtagcagggccctgtgagacagtcaaatctgatgcattgagatgacatgtttgacccctggtaatggtgatggtgaatgtgcacgtaggttctttagggtttacaaagcaccttcacgtacattatcccagccaccctggaagctggtgttttgctaatatctctgctttacccgcttagtgtgcaagctcatttgaggtagagatcttgaaaaacactgctgttgttcctctcacactggtgatgtgtttgggccacatggttgaataaaaatatctagtactttcccttctctgagtattgtaaaggatctgctctgatggtgtagttgggcgggttttaatgaataatgaatagccccagaacaagattttttcccctttttgaaaatttaaagaatgatcccatggcctagtattgtactctttttaatgttttcttttctttcttattttttgtttcttaagatggagtctcactctgtcatccaggctggagtgcagtggctcgatctccactcactgcaagcaccgcctctcgggttcgcgccattctcctgcctcagcctcctgagtagctgggactacaggcacccgccatcacgcccagctaatttttttgtatttttagtagagatggggtttcactgtattagccagtatggtctcgatgtcctgacctcgtgattcacccgctttggcctcccaaagtgctgggattacaggcgtgagccaccacgcccagccgcaatttgttttcaaatgaacactttgcatggagatgattcttggaacacagaccctcttttgccaccacagagactcacctgagtgggtggggggaatgacatatatatacacatacatacacataggtatatatatatatatttaaatgagatggagcagtgacttaattttcaggaaacaacttctagagttatttgtgccacaagtgagcagagactcaatttttatgaacatgaacctgacataagaccaagctacttggcacaaatatcctcgccttcttccatgagctcacctgttctgcagagatgttgtcttggcaggctgcaagggcagtgcctaagcacagggatgggtgcttaatgctggcctgttgagggagtgtccgttactcttgtaacttcaggcctcagttactcatgtgtcacatggacttttggcctgtcataatctcaggtttccttcagatcttattaatcttttcaaagtagttagaaaattattaattttattaaatgtaattagattttttttctttttctagcttgccttctttcattttattaataaacccatctttggggaattaaatgtagttattaaattaactacatgaaatagataacttttattcaggataaaacagcgtatagagattaatatcacagtcatctgtgggtccaatgtgaagaagttccaactactattttctcagatttgctcagatcactttaaaataaaagacgtaaagtataagtgatgaaatcgaagtctgttgttgtctcatcggaaaatccatgatcccttctgaccctttaacatagtcagtgtcctaaacttggcatgtcaccttccaaatggttttgatatatctatgtatgtatcttcctaagattgtttactattattattttctatttaagtgtgcatactcttatgtgttcctcttgttctaccacttgctagtttttcccctgtgttttgctttgtaaatatatttgcattgacatatttcaagagctggttcattcattggaaccattttacagtattccattggataggccaatcttattaatccttagctttaatgtctttggtttttgttatttctatgtagcatctctgtaatcaagggaggccttgtgttctctcctaggagagaatctcagatgggccactgtagcagatagaggtactgtagcctgttgcccgctgagattgatattaaataatggaagaaagttataagatcaaaggcccagcagctctgatgtggtggaatgatgtgcagaaatgtcaataattaaatgtaatacataggccatgtcttagttcattttctgttgcttataagagacagcctgaaactaggtcatttataaagaaaaggaatttatttcttatagttatggagcctgaggagtccaaggtcaaagggctgtatctggtgagggccttcttgctggtgagacctcttctgcatagtccccaagggatgcatggtgaaggggctgagagtactagctctcatctctcttctttttcttagaaagccaccgatttcactcccatgataatccattaacccattaatccattcatccttgaatggattggtccattcatgagggcaaagctctcagaacccaattacctgttatagatcccacctctcaatactgccacattggagattaagtgccatatgacttttggagggaagaaacattcaaactataaggccagtttgggcaaaagatttgaggttaagattgtttttaaagaagtgccttttttatgactagcaggtacatcagatttaccacatgcatatcaactaacattgtaaagtgtgtgtgtgtctaatactagatttcttttttttttccttaaacccacatctaatccacaagtaagctttacctcatcaccaaactttatccagaatcccctcatttctttctgtccccacctctactgcccttctctatagtctagttgagagatcagcacactggcctgctagccaaataaagctttattggaacacagccatgcctattaatttatttatgattgatggctagtttgcactacaaaggcagagttgagtagttgcaacagagtccacctggcctcaaagcctataatatttactatctggctctttatagaaaaagtttgctaaccttaatctggtttaatgcagctctctcccaattggttttattctccaaacagaaaacagtggcttttctaaaacgtgaatttgatcttctcacttccctgtttaaaactgagtgaatgaagtctaaactctgtatttgccttaccagcacctgcattatctggtccctgctggcattttcatgctcctctgtcaccatactcccttgttcgtgcacgtgccaacccctttcctaccccagagccttggaacatgctggcctctcagcctgctgtgctttgcctcagttccttcacaggtatacctcttttctgtctccagatttctgcacagatgtcatttctttaaaggtgaccactcagtctaaaattggcctgcacagctcatcatgtgtctttcttttctttttcttttttctttctttttttttttttttttttgagatggagtctcactgtgtcacccaggctggagtccaatggtgcattctcgtttcactgcaacctctgcctcctgcgttcaagctgttctcctgtctcagcctcctgagtacctgggattaaaggtgcgtgccaccacgcccagctaatttttgtatttttagtagagacaaggtttcaccatgtgggccatgctggtcttgaactcctgacctcaggtgatccatctgccttggcttccgcaagtgctggggttactggtgtgagccactgcacccggcctcatcatgtgtgtctttcttttccctcatagcatttgctgctctgtaattacactcttcattaatgtgttcatgtctttcttccctgcctctcctcctagggcaaaagcttgctgaccacaaagaacttgtctgtgctgattactgctagatcttggatgtcaaacacagtgaccacattatggatgcagtggaaaattgttaaatgaatgaacaaagtataggtctgccagtttccttggtaggagttaaatgccagtatatgtttatattaccttaatttgttttctttatctataaataaatcttgcctacttctgtttgcagggtaaaattaaggtgattttcttctacaacatgattgagctagcatactctccaggagggaacagacaggcattctgaaaggatgttcggtatttttagagccttttatacatttgtttctgctgttgtgctaatatgctaatgtttatcaaggttgtatttttttccctcccttttctttcttgctgctggcagagcagcattatagagttatgcagcaaactctcctttgggcatttgtcattactacaaagtgttttacatttctttgctccttaaaatatatgctgcttttctgctgaacctaggataaaaagaacaaggcagtatctttgcgaatcttaattctttcgagttagggaaaccgatccagcaacctctctttcacaccttcccattttcccagtgaacctcatattcggtacagctctgtaccttcctgcagtgaaatctataaaccagagcctcctgcttcttttgccccagttgacttcaaggctcagggcccatggttgtacactgggagataatacaccagcactgcctagttaaagggcacaggctcctcagtcagacatacctgtatttgaaatatggctttgcctccaaccagctgtgtcaccctgagcaggcacttagttactctgaaccttcttttgcttatctgtaaaatgagcttctgctggtatcttcctttaattggagaatctcacgaggtaatgctttccaagtggaataacacagtttctggaatttcatgggactcagaaatgttcactagtatttgatttggatcagcaacgtaagactttgccaaggcaccccaagaagaatgaattctaaaatagcaacctgctgtgatccagtttctggataatctgaaagctcaactgtcaattcttttttggaagtacagatgattttattattattattttaaactgatgctgcttgctttactgctagaggccttagataagacatgtggcactatcagagatgcgttgtcaatggaacaaaaatggtctcggacgctggtctgatcctagtctgatgtcctgtgaagaataactcaagtgttgtttctcttgatgcgggaactttaaagtacttttcttctctagctatccactctaattaagttttacatcccttcaacgctggcttttcaggtaccatatcgtcattattattattaccaatttgtcagctgctttatttgttcatactttaaaatggaaaacagtaattttaggtcaggaatggcagtatagtttttgtctgtggtggttccaagtagtttttaattgacacaggatttacagactgactaaaaagagaaaaagtcagatgtgataatagaaagctcatgggttttttttaggcagggggacctggattcaaatcgtgactctctcttaatcagctgagtggccttagacaagctacttaaccaacctgtctcaccttcagacttcttctgtgagatggggataacctagttcaaatgagatgaaaagtaaatttacttatagtaagtagcacattttttctttttgagacagagttttgttctgttgccaggctggagtgcaatggcgagatctcggctcactgcaacctccgcctctggggttcaagcaattttcctgtccccgcctccctgtagctgggactacaggcacgcaccaccacacccagctaatttttgtattcttagtagagacgggctttcaccatgttggccaggatggtctcaatctcttgaccttgtgatctacccaccttggcctcccaaaatgcttgtattacaggtgtgagccactgcgcctggccctaagtagcacattttaagatgctttctgaatgtgagatttttctagttcttccttttgcaaattactgttctttttctgtgattgttgagtgattcaagtatagaaattccatgattagagtttaaaaatatctctacaaatgtatttaaaacaatgagcagggctcagtgggcactattaaaacaaaattatttatatgatcacctactatttttatcttaatgattgccaggtatctacttgttacacctttcctcctcttttatatttctggattaaataataatagctaactttttttgagtacttgtcatgggcactgttccagtttatttgcatatattaactcatttaatctttacaacagcctttgaagatgggcctgttagtatcctctattttataaatgaggaagtgaaactcatgtcagctgccatttctgccatccatagggtaggtaggatctctctgtaccccttctagagtttaagaactcagccacagggggctaattaattggttaattcattttcttacagtgtgcaaaacagggagaacccaagtggagagtggtgaagagtattgcagtgctaaacaaaagtgacgttctgttttcaaaggtgacttccaatgaagactactctttagcctgaacatggagggaaaaagaacagtgtcagtacccacagtcctattcttccttctacatctgacattattatttttttcctttccataggcttaggcttctaatcccgatgattacttttcttacctatttctgtagcatgttttcatgctgaaagagaagttgacgtgctgttgtcatcgtattaaggcctaagcagaacagcattattggtattattatttttcctctcacaaacaggattccacttaatctcttttaccggatggcacagttaaagtgccttcttcatcagagcctgttttaaacaagcaggccttttattttatgacacttatattgagacacattgagttatatctgtcttttcatttgcaccaacacatttatttgaggcctcatatttcctaggtaacgtgactaaggtagatttatcggtgctaatttgcatacagaacaacattggcaaaactaaaatataacaaacacatactaacttttgacttgccacagcccaccaagcatctgccttcattgccatgcctgtaatgagagggaaatatattttcctctgagtttaaatctaattccttgtttgtattccactgtcgtcactgctgttgagagctcgaagtgaggtttaagagcctcttcatatctaacagcaggagtttatattagaggtggtagttctgtataacagaaaatgcggcttttgctcacccacctcgatttcataccacatttgaagaaccctgctacatttaagtaaggggcaagccctttgttttgcacaaaagttaatagagacttaaggctacaccattgtgttaaagcctggcttttatttctttttctcaatgttgcttttaagtagattgatatttatggcacaaataataaatgaatttatttaaaaattcattattaaaaaattttttttaaattatagattaggttgaaatttcttggtctgcccttcccaagtttactggcaatagcttggtgaacatcatctggaccttttcctatacatttacttatgcatgtatctgtccttagaaggtacacattattgcttcatgtgtgaacatgtgtgtctaatatatgttcttctgctgtatgtattgttctgcagcttgctggtttcttttagtcttgtgccttgtagaataatcagtgctaccatgttcagacttaataggctagattagtcaatgctgttatcatgagttattcctaagatctcagtggttaacacgtcaaacgtttatttctcagtcatgcacatgtgggtcaggtgacatcccccatgttgtaactcttataatccagcctaatctcacctgtgattccaccatctccacatgtggcttccaggtccttgtagccaacaaatagggctctggagggttgcacatggtctcttaaaagttttggcatactagctacaagagaactgagaaatgtaggggtacacatggttacttggtgatactgtgttgccatagataatgttaaatagttcacacagtcagaatatattatagtttgttttgccagtcttctatttgatgggcatttggatcatttccaatcgtatccttttgttatgtacaattctccagagaagatccttgcatgtatctctggtacatgttttgctaggatagatacccaggaagtagactttccaggtcagagaatgggggtgctttagttttcataaacactgtcaaattgttttggaaggtggttgcactagtgttctgttgtaaggatagtatctgagaaagtgcatttcacctgaccttcaacaacaatagcatcagatctcgtgtgtgtgtgtgtgtgtgtgtgtgtgtgtttgtgtttgtgtttgtgttcagtggcatcttcattccttttggcaaaatggcttcttccgttttgtttgagtttctattttcttgattactagtaagtcctgggctctttctaatactgctttatgctgccttcccaagtgagcagtactagtgtgcaaagtcgagctgaagaaggctggagcaagtgcagagccagtgggtagacgattttccctttcaggggtgtcgagctcagggacatttcttttgatattctctgttgattcccccacctccccaccccaggtgctatttcagttgtttctacacctctaattttaaaaccatggggcgaaggatgatttcttgggcatgtcattttttttttttctgtgtagctgtctggttttgtgcttggagtttttatgtcagtttttgcccacttagccattgtcttgttatcttctggttctctttgtcccctgcctcatttttcattctttttcttctgcttctgctcccttgttcccataggcccttaaatctttatgtgttgcttttcttttaagttgtatttttccccttcccctccaagcttagaaatgtttgctctatcaaagaaacgcaggaaggaagggaatgatggcaaggatattgtacaagtccaaagggaacaaaacctaggtgcccacctaccccagctagtttaagaatgtgatgctgttcctatcacggtcactttgccaaaatccatgtgaaggaaggaaaaaagctgggaattagtccagctttcatcaggcctctggcttactatatgatccctaggcaagacactttccctcatcaggcctccaggttcctgactgtaaactgaggtgattggaccccagtggtccctttatatcttgaaaccccagtatttgaaacatgtgactaactgggaaacttctccagtatagggtcccaaagacctttttaaaagtggatcactgccattccccttcaccttcagcctgtgaagcactgtgtcagtaagggccagtcaggaagacagggattttgtgaggtcatttaatagaatttaacaaagggccggaaagattgtaaggcacacaggcttgggaggcaacacagagatggatggacaacagcaggaatcttccgtgagccataggagaggaaggaaatggtgttggccgagtctagggctagctgttacaagcagaagtcacagcaggggagatagcaggagctggaatgtggaagagagggctgtctggagagacctggagcttcagaggagatgctgttacacccacaaagaggacaacaaagcctggtgtcttccccctactgttcagtctctgaacagagtctcaaatttaggcagaagagcctgtggaatggtcctgagggcaggctggcaaatgactggcagaaacaatcaaaaggcactggggcagatgatctttatactccattccattccttgcattctagaattcatggattatctgagagattcttcatgtctcctgcagcaaagatgttatttttagggtcataacaggtagctcttcctaggagttgaaataaacttctaccattctagcatcttaggacaacacctattcacatctccacctccctccctcccaaagcctggagtagttacattttaccttacacgagctctgtcagcatttcgtgaaagtcctattcctggtagacttttgacgaaagggacactattttacttgtctcttatctcagtctctatcaccacagagcctctgggaccagaatacaaacacagggaaccaatagtgttacccagttgatccagaagttttactgtttcagagtaacttgtgatcttgggcaagttcagcccgtttcctaatttgtaacatggctttattggtcagtaaagccaattgggcaaaaaggttgtgcgatagtaacaaataacccccagaatttcagtggctaagaatccacaaaggtgtattttttactacacatttatgtaaagtcacttggtatatgtccatccttattctggtccctggctgatagatcagctaccatcttgaatgttgccattccccatatctagagagggcaaacttcgatggggtgggagggatggcaattaaacgttggcctgaatgtgtcacacaacatatgtactcacaacttactggctggaactagttaattgatatgatactgtgatataataaaaaaaatacatatttggtctttacccctggttcctggcacacagttcctaagacccttgggatatctgaagtgatgagtgtcttttctaccctaatgagatgactagtggttggagtccactaggtagcttcaggattgtgactggttactagaaagcccatagcataattagagggttgggactttcggttccatcctcccagtctctggggaagagagcgggactaaaagttgagttaatcgccaatggctaatgaggtaacaatcatgcctatgtaataaaataataaaatcttaagaggacaaggtttggagagtgtccagattgccaaatatgtggcggtatctgcaaggtggtacccccagagagggcatggaagctccatcggcataccttgttatgtacacctcttccatctggctgttcaccagtgtcttttgtcatatcctttataaataactggtaaatgtcagcagtggtttttgtgagctctgttagccatcttataaaattagttaaacccgaggaggaggtcttgggaactcccaattgataactggttggtcagaagcacaggtaaaataacctggggcttgtgcctggcatctcaagtgggtatagtcctgtgggactgagcctctaacctgggggatctggtgctaactctaggtagtagatacggcatcgcctaacttcagctgaagtaaggaagtgcctagaaggaagaagaccgaggatatttcttgatttgcactaatgacagctacagagagagataataattcttgacatttcctgattgttttaaccatgaaacatgaatatttaatataatgcctagctcataagtgctcaattaatagtagatggaactattattgttattattattcagcagtttatattacatttccagcgtactttctaccatccatttgcatagcagatttcttctcaccctttttttacaactgagaatgcagaagtaaacataaattatacttctgtagatgtatcacaatttttttttttttttttgagactgagtctcactctggcacccaagctggagtgcagtggcacaatcatagctgactgcagcctcagccttccaggctcaagttgtcctccagcctcagccacccaattagctggtactgtgggcatgcactaccacatccagctaatgttttcactttctgtagaggcagggtctcactatgttgcccaggctagtcttgaactactgggctcaagcaatcctcctgcctccgcctctcaagatgttgggattacaggtgtgaaccactgcgcctgcccacacccagctacaaattcttaataagtggagttgtcttgaagttttagagccagtcagggccctagttttccaagttttggattgacaaaaataggtgattattctgtaaaagaattcctttgtggagtgatagccgggtgtcatcagtggatttggaactgtgctcattgtcctggttttcaatttaagagcaatagacttcaagctggctttcatttgagtcagtgtggaaacagtcaatatatgttacatgtctgtgaagctggcctctggatcaattgcaattagtttccagcagattgcattaacatatctaaaattaatatggcgagtgttctgatgaaaaggaattgaccacaaccacattgtggctgtttttagtctccctcaaatgctcttttcaaactatattttttctttctttggttaatggctttaaattgttatgtcaacgtagacataatctattgattgttcctatttgccttttaagagtggtcctagataatagcacacagctaatgtttaatgttttctttcactaaggggctttttcgctaaatgccttaaactcgtatttttctttgtatgttatataacacgctattaagactataaagcctttgagtatgttcatttacagaattttgtgtttttcaaattactaatgtttcatcaagacttaaaaagtaagattaagaaataatgtgtagttaaaaaataatatacggtaaatgatgtgagcattgcttgtctgacaatttatttttatcccagtattatttatttctaaagaagaagtataggcaacttcaatattaaaagcaaaaccaaaccatcattaccagcagctacaaggatggaacagagagctatctttaggcttgatcatgttgaaatttgaattttttaccagcatgtatacattatattatgtttatttcacgtcttaaggactaacttgtacttttttatttttagaggtggccagtttctgggaatgaaaaattgtccatatcaggagacaaaaggcagagttgattcatttggccatctaagtggcatttttcgggtgtctttcatatgtcaagcactgtcaccttcttcacagagatacagagaagtttaaggcacactttctaccctttagtggaacacagtctagtagtgggggtatagagctttgaatcaccctatttcaaaagagctccatgaatacatcatagcttggggataccagaagaaaatgacattttaaggacacagtagatgtcccaaaaggtaatggctccatgtgatgaagccctgtgggcctcacttttatgatctgtgtgacactgccttggacatccaccaaagccgtggacagaagccagtagggattgtatcagatgatgtccatgtactaccagtcttgtgatccagttgtgtgattgatttttttggtttgtgcattaactgtattgtcatccttcctcttgtgagtagtgtttcctttgcatatgactcatggatggaaaggagtttacattaagtgtattcatttttcctggttttttttttttttccttcttttaaaaatggggcttacagatttggtagggaatactgttgatattattggataaaatgtaaggaatttatttgttcatgttattgtgtcctttgactatgtccttttaacgcagataaacacgtagtgcatattggaaaaccacttctacttgaaacttaagcaaatttcctttaatacacaagttgcagtttaggaactagtttaattaatagtcagtctttcaggttattgcactcaaccttggtggatgaaagagataatctcgttaaacacacaatggccctacccagactctgttaaaaactatggtaaagaaatgaattagtctgtggcccagtgacttcagagtgtttaaacaaatttcctgaaaaaccttacaatgattaacagtctatatacagttattaaaataatgctatgctctttatttatttggggtgagaaggggggagccatatccatgtaatagagtccttaacagtttttaaaataacttattttgaaatacttgtagactcaaaggaagttgcaaaaatagtatagcagccccatgtactcttcatccagcttcccctaatgctgacacctcatgtagttgtggtacaatatcaaaagcaagacattgatatttgtgtattactgttaactagatcacagagctcactcagctttcaggatttttaaaaaacctgcattcatttgtgtgtgtgtagttgtccttaacagtttttgttaaaaaataattaggcatgaatttaagtgggtttttttttcttttgcttctctcaactctgggttgcagattgccagtcaacagtacctctaagactggccatgtaggttgacttttatttttcttgctattaatgaatgctcttacctttctccttcaatttctgtaggcagttcaattaacctccagaagatggctgaacctgcaggaataccagagcaagaaactgatgtctgacaacggagtgagagttcaaagattctttgtagcagacactgcaaatgaagctctcgaggctgctaagagactaagtaagctgattcataatgggtgaaatacacttgcccaaatcagtgaattcacaggtagtggcttcccactagttaattttttttgttgtggattaaactgacagggacagatacaggggagagcttagaactgcaaaagcaaaaaagtccagattgcctcatgtacatgtgtgtaagtgtgcaggaatcacatggtgactgcagcgtgaagggaggggtctgctttcagagctttgtccctgtgagtcttcagtcctgctgacctgggaggagatgtggaatcacaggacagccttcagtgtgatggcctgggtgtaggagaatagagcctttcttccctggcacacctagaggtttcctctagactgggccctgcctgacccatgctgcatgagattcacaggcacctctgtgtcctcagttccgccaggatcactcactggaggcacttggcctaagtgtcaaaaaccttagaacaggctcagtggggtggctcatgcctataatctcagtactttgagaggctgaggagggaggatcacttgagtccaggagtttgagaccagcctgggcaacatagcagaacccgtttctacaaaaactaaaaaaattagcctagtatggtggtgtatgcctgtagtcctagctactctggaggctttggcaggaggatcacttgagcccacgagtttgagattgcagtgggctatgatcactctaacatactctagcctgggcgccagagtgagaccttctctctcttaaaaaaaaaaaaaaaattagaacaacaaacaacttccctttcttttcagtatcccttagggagggtgtatcctcagaaattcttacagtatgagcattagggtgttttcatcccagctctttttgaaatgaagaatagtacaacagtggagcatcgttcaataatgtgtgcagggagtggatggaagccttcaacaatatttgataacacaaaaaggaaattgtgatccatgttaactaataaaggaaatgataactgcaatttaaaaaagcaaaaaacatcaatttaggaaaactttattcttttgcctgagatagcagcacatgggatgttgcttcatggtaatttttcagagattttagtcactatttcacccacttctgtcagctgtgggttagtggctgggagaaacatggctgaagggcttgagaagcctttgcagggtgagtcagttgtcgacatccttctttaagtcccttagaacatggggagagcgccctctgagtgactggaggagaccaaagacaagggcatgactttaaagtcaagctaactttgcttcagtgttttgccttccctttaccagctttgtaattctgcagaagtaccttctccgtccttgcctcagtttctttaggtcaaagctaatagtacttatttcccaatgctattgcgagtctttaggagtgtattagtctattctcatgctactaataaagacatacctgagactgggtgatttataaaggaaagagatttagtggactcacagttccgcatggctggggagacctcacaatcatagtggaagacaaaggaagagcaaagggatgtcttacatggtggcagacgagaacttgtgcaggggaactcccatttataaaaccattagatctcgtgaggcttactcactaccattagaacagtatggggaaaactgccccaatgattcaattatctccccctggccccacccttgacatgtggagattattacaattcaaggtgagatttgggtggggacagccaaaccatatcaaagggagattgttgtgtggtagaacatctagctcattttcctacttacagatccagatattagggatcaggtcctgctgtctgcctttcagtgagcatccccgcctgtggcatacagactttgtaggtgtcggtctggattgccactgtctagtaggagtataatgtgagccacgtcagtattttaaagttttctaacagtcacattaaaaaaacgaaaaaaagggtgaaattaatgttaataatatattctgtttactccaatatatctaaaacaacatcatttcaacatgtaattaatataaaaagttatcaacaggatattttgtgttcatttttttgtcccaatcttcagaaacctggttggaatgctacacttccagcacatctcatttcagactagtctcatttcaggtgctcaagagactcatgtggctagtggctaccatctaggacagtgcacatttggacactagaaggatttgtatgtgcatccttcagccttgggaatgcagttatttcccactaaaaataaagaattgtgcgtctgctactcagtcttgtccaggtatcagtagcaaaggttgagagtttaggatagaagcactctccatatttcaatattctaattttctatgctcttttaagaataagtcgcaggtacttcagctagtaattgttgttctttgaactttttaaagttctaccagatgctaatacaccagaccctttctatgttatgtcagttgaaatgtatatgcattctcttctggaacaaatatttatcgagggtcaaccatgtactaggcactgtggacacagctgtgcaagacaggcaagccctttttcttcatagaatttatgttctagaaagaaattaatttgtgactttcagatgttaaatgtagaaattgaagtgacttatattttaataaatgaaaattggtttcatttttaaaagctatcaagattggtttttactgtgaaaaaatcccagtaaaataagatctaaacctggatgagagctcctcagtgaactttgataatagactcagtaaaggttagtactgtattccagccttttcataagaaaggatcatttttgttttatactcttgtggtttggggattgggaagtgagagcaaagaaatgtaaagttcaagttggtctttgatcttcatttccccattattttcttaaatacagtgaagcactagcattgcaggtataactaagttttttaaagagaattctggaggccagctgattactcccctcacccctcttaggcataacacctaatctctttgagatattcctggagatacgcacttagtgagctaattgacttcttagttatggttttatgaacatttatttagccgttgtattgtggttggggattgtataccatgctttttatttgtatttattttttacttcttttagagacagggtctcactctgtcacccagtctggagtgcagtggtgtaatcatagttcagtgcaatctcgaactcctgggctcgagtgatcctccctcctcagccttcagagtagctaggactacaggcacacaccaccacacctggctaatttttgtgtctttattttttgtagagatggggtctctctgtgttgcccagtttggcctcaagtgatcttcctgcctcagcctctcaaagtgctgagattacaaccgagagccattgcacctggctgtatcatgcttttaatagaatttctgctctggaggaatgagcaatgttgcattgacgtgttgggctgggacaagggagggaaaaaaagagacaataaagcaatttgaagtaaaagaaaattagttcttcaggtatgctctcaagaaatacaagctggataaagggttgagaatgataaaaggattgacaaaatcaagctggataaaggaatggagaatgatgcttggttgtgtgtgtgtgcttataggagtgtgtgagtgtgtgtgcacgcaggtttcaccagtgcatatctatgatgctccttaaggtggtatggccaacagagggcctccctgtgattctgtctagagctaaacaggaatttggaaaattcaagctccttatttggtgaatgaatgagtaatccttcccgaactcagtgagtagttttggtagaaggaaggtctcctctgatttctgttgttgaatagttttgatctaaggggaaatttatagcattagaagaggatatggaaccaattctagttggttaaaagtgaaattagttgatcataaatataaaaattgtgtgcacatcactgagattacctggagagagcaaagcaagaagaatctggcaaaacttcagagtatttacattcttgtcaccacaagattgacagaaccaagagcacgattaaagttttagcaaatagatttgaggttaagattaaaactggattatgcacacatcttcctgattgtcctgaaaaaatgggatcttcaccttgtaattatgataccatcatgggagaaaattgcctagaatgataatgtgtctaacactgagaaagtgctatataagattttattgctatcagcatcatcattgttgtcagtggcagcaaattccaggaggttcactactgttgtgattctaactcacagagagaccagagacatcgtaataactatcctgttaatcatgtgttaggagagttcatattttaattagaaagatttgtaaataattgaaagatatttgcttaccttcctactttattcatattttgatgtgttttgaaatgacattttataaaatattttgaaaataaatgtgacattaatcatatctgtgatttccagggtgacttctatgcggattgtctcgcagatctctttctttgtgcctgaagctgcattcctagttgtctgttgaccacttgttcatgagtgtctttggcacacctgacctaaatggaacttgtcatctcttggttgcttcaaaccttctcttcttcttctcgccaccctacttacccagctgaaatagctctgcatcattaatgtctctcatgtctactatattcagttggtcgccaaattcagtcattgtttatgtcattttacaagcaaggaaacaggcaagataaagttaaaaaacatgccgagattgtagagctaaatgacaaagatgatgggattttaatccagtcagattagattaaatctcccctagcattttccttttgctaacttgatgatgatatttttgggagatttttatgtgtgggtcagcattttaaacatggaaaatgcatattaataaaattagaagattggattaaaactagatgtggcaggttttaaggtgcaatatatagaaactgcaatctgcagatattttcttaatgattcatttgcttttatctctgagcaaatagaaccttttgctgtgtagttatggaaagcttgttaatttgaacatttgtttaaaatgggtaatgcatacattttgtttctgaaacactgttcataatggtaagatattgagtgagatcctcattttcttgcatagaaaatggatttatgtctgagagagcaaatttgtttgaattaagtttttaatgtgtggataatattcattgctgctgccatttatcggagccaccttttataatcacgctttaaaggaggagttgtttacgttgcatacaattttcttaggaggcttataagtacatactttttttctcttatggattaaattaatgaatacagtcaacagatcattacagaatacctactgtgtgaatgactgatcttcatgttaccttttcagttctctttgaaagtgagtgaaggattgtgtctctcatataactggaaatacctgtcttaaaaaagtatttgtatataaacttagatgaaacatatctaggatcactatctttcagtttttagaatctctacaatttattaattattccacacatgttgacatgagactcttaccatttgattaagcaagaaaattgcgtttcaaaagctcagttttattttttgttgggaaagaaaattgaactatgaatggagaaattaatcttctctggcctaatgacatgcatcctaaaatggagataaggagcttttattgaacttggctagcttttgattgctttcagctataacatgtttccattcgtcaatatgataacttgttcttttggtattatgtaatcacatcctaaagcctggtgaattacttaacaccattaaggaattgtatttgatgtaaaaaaagaactgttgtgcattgactactgattgatatgtactattaatcccatagtcaattaaatacattgcaagcctccttgattgttgtggctttgtcctatgacatgtggttaggatcttgcaaaaagatcttaatatcctttttgttgagatgacggtcatttttgtcttataatgacagacaaggataacattgatttttgtgaagtaagttttccttttaccaacatatcagctgcccattattttgactttggagtcaataatataaagctgctcctagggtaatggcatatgtggtccatgagaggttgaagcggtatctgctttctaggaataacagtggtgtcctcaccagacagatggttcctgtggtgtgatttgattgtgtgcctgcctgctgttggcctctttggttccttcccattttttaagtctgattgtcctgccttcttggtgattatgtgagcctcccaatttctttttcgtaatttagttcatgcttatttcagctagagttaatttctgttgcttgctgctaagaacctggtctcatgcagatagagtgcttctcataggtcctcagaggcagtaggtgctcacgaataaatattgttattcagaaaatgttcacttgctcatgctcgcttgcaaatgctccttaaaggagcacctgaatttaaattaatggttttccctaactgtatttataaagaggatatcccattcaacaagttgtagcttttaatgacattttctattgtatgtatttttgcaaagagatcccccttttataaaatgttcttttttcttcttcctaagtctgcaaatataaatggtcttctctggtcatctccttagaatttctctgtgctagaatatcttttccctaagtgtcttgtggtattcactgaataccactctgcaggagacctgcagagtgaagggcgagatcaaggcgggttgtgggcaggcaggctttatgggagtgtacatgtagcttcctttcagttttctcagaaacaaatgagaacagtactttgaaactcaatgccttaacttcaattttaacagcctactaaagcaaggattaattcttcttacacttttaccaataaaaataatagtggtggtgtttaagctttgggcctttaccatgtgcctggtattgtgctgagcatttcataaatattatctcctggaatcttcatctaaaccaaagggaaagactttcctttaaggactggtactgagtgtcaccagatctcttcatgcccatgattgtgtatccatggtaactaacataattttactttctgtctttttggtgtgtcattaatgcagttatgtattatcttgtttttatttttttaatttttaattttttaattttttgagacacttttgctctgtcgccccggctggagttggggggtgcgatcttagctcactgcaatctctgcctcccaggttcaggcggttctcatgacttagcctcctgagtatctgggattacaggcgtgcaccaccatgcccagctaatttttatatttttaatagacacggggtttcgccatgttggccaggatggtctcgaactcctggcctcgagtgatcttcccactttgacctcccaaattgctggcctttgggaggccaagttgggaagattataggcctggctgacttgtttttttaaagctacctcattgagaatgggcaaagaagttatgttggcatgtggtctcattttccaggactttcccgtgaaatattttaccctgggggcctttgattcaccccattgtaaagtttggcagttttgaaagttcagagggtactttatgggctataaatgcagaaaaacagaaaaactttacctagggtaaatgacataggacctcactgctgtgatcgctctgtctgggtggattgccccttttaaagaaatcttaaacataattagacaaatcttttctgattatcaaaggaacatgctcattattttgatattggaaaatacagaaaattacaaaaaagtaaaaaataagtaaaaaatatcttctaatctcattacttggaggaagcctgtgctaatattaacatattttctttcatttttgttttgcacacatgcattcagcaatattaatttctgtgtacatatgtatatgacatcattgagagagaatgagcttgtttataaatttggtgaggtactaagtacagttttgtttataatttttgttttaaaattctatattataaaatgaacattgtctaaatattaaatttttttccaaaatattattttaaggttttatgataatctctagattgactgtgttatttcctcttgtggttatttttggattgtttttctctgtattggcatattaggtagtgctagcttctgaagcacatgagctgccccattctcagtagcctggtgcaagaagaagttatttcctattcacatacaaatctagcatgatgttcttggtctgccacaggaacccaggctccttttgtttttcactctgctgtcttccacacatggctcccaaagatgacctggaaagtatgcccattccagccactcaaaaggcaaaaaaaccatggaggattgcatgtagaaatttgcatggactgtgtcatttcagctaaaagtaattgcaagatctcaaccaacttcaagggtggctgggaaatacagtttcaatccatgcttaggaaaaagaagaaatgggtttggtgatcatgtagtggtctcttctgaaagtagtgtttagaatcttgaaaatctttgtctctttgcttcaaggcttagaagaaacacaggctatacagtcagaacagagctcccatcccagccctactttgactgattaccctaaaccacaatttacttgactataaaataggggataataatacatacttcaaggaatgattgagatggcaacaaagataaacgaaacacatttcacacaaatgaggcactcaccaagttctctttctttttttcttctttttttggattgaactgagccagtgttttgagccgtcatgaaagaaatacaaaacaactattaaaacatcaacagcagataaaaataaaaattttcaatacttttgcaataacacccaagtgtgaagctatgtttttttatacaacttgtcagataacttgataatgaatatataatgacttgtgtactgttggttgatattttctaagtagatgaagatgtaagtcaaaagttgcataatttttaaagaaaatgagcgtcatactttctttacattgcaacagaataaatattacatatggaattatgcttttaagatgctacactattccccaaggtggttgtaacaggcattggcaatgtttaacagatgttcataaatagtactaaggctgtacttgagttttctaggttacggacaaaaaagtcaggaaatgaattgagaaggtttaaaagagttgtgttacttgatctaccttaggatgaaaattgggtaagtaaacaagctatctcagctgtgtaattttttttctttcattcaacatcgaacaagctaagagatttgggagtctatttctctcaaattaaatgtgagccaagtattagagttttttttttttttgtcttcaggcttttatttgagcaaatataccagtcacttcagcatggggcagaggaaacagatgggatgtggataacagggggaaaataacagtgctaaaggtatttgatatgcaaaaatcaaattgttcccagaatcttcaggtgctagatgcagcactgaaaaacaactttacataaatatatattttctttataaatgatctgtccattagcatcataaacatgagaaaacctggatcccgttgagacactcttgctcagaatttcttactactgttccttgtttagtggattcagttttaactcactgtggcatacacagtcagctgtgcatgacgcagtcacaatttacctttcgctcattgtcctctctttatgcctgttacccagtgtgtggccacatcagtttccttcctgccttcgtccaaattctttctttcatagtgcaccttctaatatggtgaggatgactctggagttcgccttgaattcaaatcttgcatttgctccacgatagcttcacaaccctaggcaagttacttagcctctagaatcctcagtttcctcatctgtaaaatgggcttagtaataatgattcctaggagagccaggagagtgaaatgagatcatgctgtgtataaggtttagcagagttgtataccctaaagtttccaataatgggtagttaggatcattatcattgtcacgatctcccagtttttgtggctcatcttatcacctcttcagtgatgtctttgagaaggcactgtggtagtatttaagaaggtgggctctggaagagactgccttagtttgaagcatagtcccatcctttttagctgtgctgtaacttctcgaaggctccatttcctcatctgtaaaatgtgggatgtcagtagtgtctactcatgggtttggtgggaggaatgatctaggccttaacagtgtctggctcataggaaacatcagtagatgatgtgctttttgctgttacggtaaatagtgtgttccacatcacagcatacactgggtgatgcaggggttgtaatttaacctgttgcctctgtacccagaaagaggaaacatattccttacaacatagttgtgaggtgacctttcacacgatacttttcatatacaaaataaagtataggtgtttctgtaaatctggacaggtttcaagattcatctggcatttaagcttagaatttctgtctcttcggtgtaggtgatcatccctattggtttgcctgggacagacttggatacatctgttattccagaactattattaactgcaaatcccttttactctcaaagttgtctccatttaaagaataaagtttttggttacctgaataagattaaggatgactctttgatagcagctgtctttaacaggaagcctgttttgtaggaaagacagtgagagttttggccgggcgtggtggctcacacctgtaatcctagcactttgggaggccgaggtgggcgtgttgcctgagttcaggagttcgagaacagcctgggcaacacagtgaaaccccgtctctactaaaatacaaaaaaattagctgggcatggcggcatgcgcctgtagtcccagctactcaggaggctgaggcaggaaaattgctggaacccaggaggcagaggttgcagtgagctgagattgtgccactgcactccacnnnnnnnnnnnnnnnnnnnnnnnnnnnnnnnnnnnnnnnnnnnnnnnnnnnnnnnnnnnnnnnnnnnnaaatgagagttttttgttgttgttgtttgtttgtttgttttttgagatggagtctcactctgttgcccaggctggaatgcaggggcacgatcttggctgactgcaacctctgcctcccaggttcaagcgattctcctccctcagcctccggggtagctgggactacaggcacccgccaccgtgcctggctaatttttgtatttttcgtagagatggagttttaccatattggccaggctggtctcgaactcctgaccttgtgatccacccgccttggcctcccaaagtgctgggaccacagacgtgagccactgcacccggccaaagatgagagctttaaatattattccatcaattcttgcagcttttaaatgaaggatgaacaagagaagaaagggccttccagacagtttgggatgactactgggagtggggtacagaaatagatagggaggacgaggctggatttgttccagggctaaaactttcccattcatctttgcattcctggtacctggactgtagtgtgaattccataagtgattactgaatggaagagttaataagagaacaaagacatccaggaaccctccatctaggctaaaagttgccaagcaggacttctggtgtatacatacccagtgactttctctaatgtcattgggtcatgattgtaagctttgtttaagggagaaggtaaaactaaggaagcagcagccctgtgggcaatggtgggaagttgggaaattaagaagggacacatcaactcggtgtctttgcctgttgccagccttatgtccagggttctcttcaggctgatcctcctgtctgatgccacagaacagccttagttgaaatgtggggatggttaggtctggtattaccaggaatgaatctccttagacaaagacagcttcaccttctgtgggttctctctgatccctggcaggtcatgttaacaaaagtccctggtccatagtggctttttgttctgtttacattgatgagctctactttcagttataggatctttggatatgtgctcatttcagtttaaaggtgtcccaaatatgcttatctcagtgccatttttgtcactgcctcccctacttctggaaaaaacatcagtattgctcagtattagacagtagctctccatccttgccagtgttgtgtgtgttataagtgaggggactataaggaaaccatgagagggctcaaaaccccctgtgatttaagtaacctcttttcaatgggacgttaattcatttaacagttattgagtacctgaaataatcaggtactgaggttggttgggcacaaggatgactacaaatagttggtgcttccaagacgttcactgcttggtagagagacagatgtgtaaactcatagggatacaggagtagtgaaggtgtgcccagatgtcatggcacgcagggaaaagggatgcctattccactgtaaatgctgggtggtcagggaagccttcttggaagaggcaaaaactactttccctttctgactcattattaaatataatacatttaacaaacagagtttttttctgacccagaatagaaaccttgtccttaactttctttctttctcctggctctcatgaaaattatctttcaaaatgattggcaggaagttggcaattctagctttaaacagagaagtaataactgtgatcatcttactgtttgtatgtaaagctagttacttgtgttgaggggaagagagaggtgttttccgatggaagtgtagaaggctgctttctgagatagatcctatagacaacccgtcaagggatactactttaaataaaccaaaccactccttgccttttaggtcaggaaacttgtgggtacccacccagagttcatcaaactaaggaggttggatgttcatcaaccaagcctgtgagaatgatgtatacaccagaatgccaatggcacatttacaaaatggaatgattttctcatgactagaatgttcagatctgccatcctgatgtcttaggagacacattcatcttgttttacctttatgcaattcttttccttttcaagacaaagagcacatttcaacaaaaccttagactttcatttacttatgctctcatcaaatattgatctggtgtgtgtgctaggtggtagaaaatacaatggctgaaatgttttgaaaactcagtgtatctgtaataaacactgttaagtgtttatcctgctttatctcactgaatcctcatgtgcccttcctgagatatgccattgtcctaatccatagtttataaaataatcatctaagaggcccaggcacaatggagcttctcagagtgatagagaaacagtcagtggcctttgcttctaagcccaaagtccagggaccagggcctccagcgtccagagccatgttcatgaggttgcttaccttcgcttaggacgcagagccatctcttcacaccctctttctcccaaaggtcaattcaaaactccctatactgggcagactcccaccctggcactcctttcctgcttgaggcctggctgacgttctgtgtcttcccttcttggggtgattttattagtcaaaactctcaggagccctggtgcctcctcacctctgtctttaatactgcaagcagccccctttagctgaacaaggaactggtctgttgtgtttcacattacacaggtattctcaatatagaaacacacctactttcatgattcactgccttttaacttcacagtgtttggagtttaaaggggtcttttgtgaacatcgaagtccctgaagaagtgaatagctaaaattttccacatgaccagtagtatggaagtataactaatgatagagaatgatactttcattgcttccgtttttactcctgtcactaaaggcttgtaatttcataccacaccaaacaaatttttatttgttcagcttcctttgacttaagcaaagtagtttttttggtggggagggggtatcgttattggagtctgatcttgaggtattatttcatttggaaagactgatacaactaaaaatctggtgtaattctttctggttttaaaaaagttatgtccagctaactcttaaaaaatcaaaccccttttgaacttttaatttaaaacaatatcaataattgctaaaagtcatctatagctttactatcttactgattttcactttctgttttcaataataaaaatcttttacccatcacaccagaaggtaccaggctaagggattttctgagcttttgggtaccattcaattggtatccactaacatatgcagaaaatagtttgaatatttgagcttggtgaggatgcagagtataagcaaacaaattagcaaataattgacagattgtgagaaatactgtgacagaaatacacagatttcatgttataggatagtcaaggaaggcttctctgaggaggtgatttttaagctgacctgtgaggatgaacacgagccagtcatgagaactgggatgaaagtgtttcaagcacaggtgacaggagaggctgagatcctgaactagaaacagctttatcaatttgataaacagaaaggggatcggtgagaatgaagtttagaaaaggatagtatggtgaggtctggcaaatgggttggagcccagatcatataaggctttgtgctcagctaagtatatttgattttattctaagtgaaatgggaagctaccaaaagatttggatgaaatccatgtcagttaggtattgcctcaacaacgctaggtaacaaaccatccccaaactcagggagtcatttgttcttgctcaagtgtctgcatattagtgggttgaggtggccctctctgggcttggctgcaaactgcaggttgggtccaggcctgtaccacgtgcctctcatcctcctcggacttgtgggctaggtgtgggtatagttttcacaaggaagtggctggaatgcaagagagcaagcccaactgcaagtatgtttcaagctccttgttgcatcacatctgctaatatcccattgttggaatccaaagacaaggggtcagggcctctagtgggaagaactgcatagtcacttggaaaatggcatggatccagggagagatgaggaattggggctagtgatttctgcaatgacctgatcttatctatcttataaaaagttcaccatagtcgggggtgaccaactgctcttgattgctcaaaaatgaggagttccctgaacatgggactttcagtgctaaagctgagaaagcctaaggcaaaccaggatgagtcggtcaccctgtggactgtcctgtggtaaatggattaatggggctgcaggagaagtgagaaagagatcagctgtcattatggtcttccaagtgagagaagatggtggtgtgaatgagaggtttacacgggagatgtggtggagctgatgtctttgagatgtgttttggatggacagctcgggacttgttgatgtttgggatggggtagttgaagaaaggcattggggatgtgttagaccgattgaatatgctatttgctggatatacaattgaatgtgttatatgtgttagaccaattgaatatgcaaatattctatagggtaggataacaacttttagttgttaggcattggggatgtgttagaccaattaaatatgctatttgctggatacgcaattgaatgtgctatatgtgttagaccaattgaatatgcaaatatcctatagggtagaataacaacttttagttattattgcgagaatataataacaagccactatttgcaaatacattatatattatagacatgtaatgtggtatctatctttaaaaccatgttaaagaaatcgatggaataaatgtggaggttgacgtatatccacctggacctatagtaatgtacacaaattgtatcagaagaatggttgtcactaacaaaggtcattttcctaatagccttcattggctacctaggctcaccatagtggtttgcttctatagtaagcaaggaagcaatggacattgggaaatgagtgtattttcttcattttgatttgtcaaggcctaacccatcaggatttacagtttataattacattgtgggtttttctatacagtatcgtgaggtgacagtgtacctggtgtggtagaaacaatatttgaataggatttagaaggtctggatttgagctgtggctttgatattcagtttttttttttttttttttttttttggaggatgtgagagttacatatgcttacgattagatattaccaatgtcttttcccacttgttgagttgatgtcttgaataacaaggaggacctattccccagactatttggggatgctggttgaattaatattgaattaacacctgttcatatgtggggaatgccactgaatacttttgtaatcttgaataacttgctcggcatatttggtctctgtttctttctctatgaactgggaatagcaattcagggacattgtgaagagatatcatatgagagattgtatatgaagttgctccataaggtcttatcaataagatcttcttccttctctgctaggatagtgagtttccaggcctggattcacattagctttatttgtgttgtttgtttttccttgcacccttgaatgtgataatgatgaacacagatttgttgaagggctggctgatcaagtgtcaagttcctggcagttcttcactctgtgccttacactctgaaccatttggctgcctctataaagccagaccttctgggttctaaatacttttcttctaattttcccacatgagatcttgggcaagcttcttaactttcctgtgtcttaagtttccccatctatgaaaggaactaatcatatttcttgaatcagattgttgctgagtcctcattaaattaatagcgataactcagatcagtgtatggaaatcaatcaatacaaaagacaataaatgttaactcctttattattattgctgttattatttacaggtaggtttcctgctgcatttatttgatttgtagacttgagagacaaggtagaactatttaattacatagaaaattggaaagttctgatatgatgaactctaaaggggaatgtgatatagatttctattatttagttttaggcagtttatgatttttccacagtgactagtgtactccatgtgatagatctaacgtattgttgtattagtccgtttttatgctgctgatgaagacatacccgagactgggaagaaaaaaagatttaattggacttacagttccacatggctggggaggtctcagaaacatggctggaggtgaaaggcacttcttacatggtggcagcaagagaaaaatgaggaagaagcaaaagcagaaccccctgataaacccatcagatcttgtgagacttattcactataatgagaatagcaggggaaagactggcccccatgattcaattacctctcctgggtccctcccacaacacgtgaaaattctgggaaatacaattcaaggtgagatttggatgggggcacagcaaaaccatatcagttgtgaaaaggggttttgactttttcaatctcagtccattgaaaactcattctgttttcccttgccctgcagagtctgtttcatctactgctataccctaacccacctgccagctcattttgcatttctctttgtttgtcctagcttccttgtatgcgctgtttgtgctcttgatttattaaatctctgagaccatcctttctctggaatggtaggaaaggcttctagacagacagccagagagatctaaaacagccccaggggtatatttcttgttcagttcattccagcaaccgattagagatcaataaatgcacagcattagtgtatattatgtacttttcctggaaaacatgtcagtattcaatagactaaataggagatgagatattttttagttggcacctctctacaactgtaaataattagaaaaggtttttttttaatttttactttagaaatttttgttaaagaactctctctctcttaatgtccaaagtcttagacagttggacatcttttccttctggaaagatgtgaaactttgtagaatggagaagaaatgtaaagagtacttaacactaaaagaaaaggcggtgaaaagccaaaccctgttgtgttagtctgttcttatgttgttttaaagaaatagctgaggctgggtaatttatacagaaaagaggtttaattggctcatggttctgcaggctgtacaagaggcatggtatcagcatctgctcggcttctgggaaggcctcgaggaacttaatatcatggcagaaggcaaagcaggagtaggcatgtcacatggtgagagagggagcacgagtgggaggtgggaggtgccatagtcttttaaacaccagatctcacatgaactcagagtgagaactcactcacgtctgcaaggagggcatcaagccattcatgagggatcttcccccatgacccaaacacctcccaccagctcccacctccaacattgggaattacagttcaacatgagatttggaggggacagacaccaaaaccatatcacctgtctagttcaaaagtttctcaaaagccacagttgccttggaattggtgatggaaattatcatcattctcacttgctggaatacacagggaggtatgtgggaaagaacataatagaaatattttaaaattatgttttttatttgtatgtattgttcttcacataatataaggtgttgacaggacaggaattatttctctttctgaaatgaggaaacagactcagtgaactgaggtacttgatcaagttctcagagtagcagttaggccccatccctaacatttataggaccagagacagaaggacaaatagaggcccatacaccatatgttcaaaatataaaatttcataaatgcatatataaatcaaggtaatgctgtatcaagtagactaaagtatatcccaaattgaataaaatgtcttgccctgacaaacataccttcagagtgacctgtaaggcctggcttccattttgcattcccggactttgtggagtttagtgcaggaacatgtagcacagggattagggattacctccccctagcctgtggttcctctttccgcccccagcttcactgtgcgttgtgaggtgcctcatgagtatgtgtgttcaggtccatccacctctcctgcacacagccaccccttgagcataggagtataattagaggacagcagatgcttcccttggaaggccccatcttgaaaagaggcccacaatgggccatttcggtagacttctggggaatgtgcatggcaggggatatataggctctggacaatcccttaggccttgaggacttatcacctcattccatggttaagtctaattatgaggccagtagtggggtatccaagatacaagttggattccattggattgtttggccacttcaatcacattattagtcagtttaatgaaaagcagtttgttccttcatttagcaggtattatgtacaggtacttggtgctggagatataactggagtaaggcatctcttgggagcggcttcgaattctagtgagagaagacagaaaaccatgtaaagacttacaatataatgttctcaagttagcaatgctatgaataatataaaagagggtagtgagatagtgatggaaaaataagggtgggaccaagggtcggagaagtcttccctgtggaaatgacattgtgatgcaagatgtgaatgctcaacagctgcaagaagatctaagggaagggcattccaagtgggtggatcacataggtgatggccaggtacttggtgacttcaagggacagaaagatgatcatggaggcatggcatcagggagtggaaggagatggggttagagggatgggcagggtcttagaggtcaccagagccttgtagaccctgtaaggggcttggattttgttccagtgaaatccactggatattttaaacaagggattgttaggaaaacttctgatcaaattcagtacttaacagttaacccaaagtagcctgtccaaattgtaatcattttgccaatattaaatgaatccccctgctgtacataccccatctcttagagtagttgaatgtcaccaatatattttgtagacattttgaagacttaaacattggtgctcctggcaagtaatgtgaaaaagtggtcatatatttagctatcaagtttcatgtcttttgctaaaaatgtagaaccaagagagctctgagcataaatacaggcatgctcttggtgttgggtatttcataactattcttaggtgccaaatgtcttcatcttcatgcaatttatagtaatgtaagtaatgtgttggagactaacaaatcaaaatctcatttcggatgtgtgacactaatgttgtgttgacttattgtttcatgtgttagatttctgataaaattactaaaacaccttcttgaaaggagtaacaggaagaaacagttggggtgtcagatattcagctgtgtgtactttcttatggataggagtttactgattaattcttgattgcattaaatagcatattagagtacctcaatttaggagcatttagcaacttaaaattttttgatagcaaaggacttacaagtagcatgatacttgttaagagaaaacaaagaccaattttagttcttatttattataatgattttcattttactattaaagatgtttcttcaacagtaaccagatgtgtaacatagaagcagctgcatgatattttcatttttatgcataatattggaaatcttagacaaggttcattgtctgttatggaaaatgaaatgatcttttcccagtctgaacatctgtgtaaaacagaatgctagcatcttctcctgtctctaagtgaccatctgtttttatgggatttgacaggtaatttattaattttaagtggtttgttttagggaaattttggcaaatgtgcatgtaacaaagtagtaggaaaatattataaagctctggatttttttagggcctgtttaaaggtctggtagaagctttaagagtcttttttcctttttccttatgtgttttgaaatggataaaaatatttgtcaatgaatgatgccatagggactggattataggctttggtgacacatttgacagtcgttctggttttggctaatttagaaatattaactgtacaattaaaaaacttattttttttctttcagtacaaactcatgttatttttgtggtcttaatataaaaattaaacacaaaaaataagtggtaagttgctttttaaactctgtcctcctccattccagctgtcactgcactttcctagggtccttctggcatcttctcaaatcttggaagaaatgccagctctttttcaacattcatttgtcacttttaaggtttcactgaattagccaggctgaatgcagaacgaaaagaaatgccacggttattatgctgactgcagacgcaatatgggaattctgtatgataggccctcactcatgtcttaatactttatttattccaatgtgcttagcaagccagcttggccttgtttgtctccaggtagatcagacggctagaaacagtcctacctattttcatttgggaagcttaaatatttttaagatgagtgataatgccaggcaaacagagccgagtgtcaccagttctgtctcagcctctcagtcaccgagggaagctaggagacgtaatcatttttagctcagttccccattctgtaaaatgagttttatgacattttcttccctagttcactggaatagcattagaaaaatgaatggatgtggtgactgtttattggatgacatttgctgaatgtggctttttggtgttcaagactggatacattaataacagttttaattgttatctataacatggctgtctgatagtgatgatgatgatgaggaggagcaggaggaggacagtcgtggtggtgatgggtgaacagtaacagtaaatgggaggcagcttagggtactgactaagcccataggagtcagactatcttggttgagatccctttcatgtcaattactacttgtgtgaccttgaacaagttacttaaatctctgaacatagtaaatgtcacatttggaattggaacctccacctgtcccagcctgtgttcctaaccaccatactgtgctgctttaagccaaaagcaacgaactttggtctagagcatttcaaaaggtcatccaacagaacatataaaaatagaaaaagccagcaacatccttaatcttctttatttagaatacttactttacttacttttaaaaaataccccataggatcatgaacatcagaccaattgggaagggtagattaattgactgcctaaggactgaaattggcacattagactctgctacaaaacttacctgtttctgatctctcgaaatcaatgaatctcattattattcatagctcttcctttaaaaaaaatgaaacacatcatttgcaaaaagaaaattttgtcccatgcagtctaggttgttccaggagcttactgagaaactacaacagccctctgaggttaactggtactattcactgaactctcaagtttctgccttgtgaatctggtggtgggaaatttggctgtagtaaagaaggagcctcacttgatctctgcggaaatcattgagaattacaagtaggatgcttcatccttgtttaaaaaatagaagtaattgtttcttttggaagtagcatgctatttatttaactgcacaagtagttctgataaagtgggtgtgatttttttggctggttgatgtcagcattattttacaaatgtggaggaaaatctatcagggaaaataattgaaataaagcaggagtctttgtgggtttgtttttttttttttttttttttttttttgaaatggagtcttgctcttttgcccaggctggagtgcagtggcatgatctcggctcactgctacctccacctcctgggttcgagcgattctcctgcctcagcctcccaagtagctggaattacaggcacccaccacatggatgcccggctaattttttgtacttttagtagagatggggttttgccatgtcagccaggctggtcttgaacttctgacctcaagtgatctgcccgcctcagcctcccaaagttctgggattacagatatgagccactgcgcccagcctaaagcagtactcttggtggacaagggaacttgagtggtagctgggagaagcatcagcatgatggtgatatgtacattcctggtgtagtcagctcttacattctagtggcttattggcatccagtggcagctggagacagatgatggaatatccgtgttctgaagaatgtcctttgcctgctctctaagcatcataatacttaacttgtaccagtatttacagtgccatcatttttcattatatgttcccttatcccattggagcacaaagggagcagagaggagcactgagtgtccgcttcatgttctttccatggtcaagaccatgtgttttcacaactaatttaagagagagttggagccaaagcaactttaacctaattcgaaggactggattggtgggatcaattggaaagttcctgaggcaggaatgttcctggaggtatcaggtgattagagaaagagagcaagcaagctgtgggacatgaggtgaaattggagcatggagaataacctgtagggctctgtatgcaactagaggggtgctggcttttgcaatggttttatttattgatttatttttaattttctgacaagcgaattaagttatatattgtatatcataaaattcacccatttcaagtatatccttcaatggacaaaatgtactgtatccataggatatggtttggctgtgtccctacctaaatctcatcttgaattttagttcccataatcctcatgtgtcttggggagggacccggtgggaggtaatttaatcatgggggcagttaccctcatgctgttcttgtgatagtgagtgagttcgcatgagatctgatggttttataaggggctcttcctgctttgcccggcacttccccttcctgccactgtgtaaagaaagatgtgtttgcttcttcttctaccatgattgtaagtttcctgaggcctccccagccatgtggaactgtgagttaattaaacctctttcctttgtaaattactcagtctcaggcagttctttatagcagcagttaccagagagtattcaattatatggactaatacaccacacaatggaatactctttggcaacacaaagaacaaactattaatacattcaacaacatgaatgaacctcaaaaacatggtatcatgatattaagtgaaagaagtttagttccatgatgtttagtaaatttaccaagttatataaccatcactgtagtccagttttaaaacatttcatcctccaataagattccttatgccctttactgttaatcccattactcctgccagccccagcaaccattaatctgcattgtgtccctatagatttgtcttttctttaaatggaatgctacagcatgtggtctcttgtgtcgagcttccttcacttagtatcatatttttgaggttacttcatattgttgaatgtattaatagtttgttctttgtgttaccgaagagtattccattgtatagatacagcacattttgtccatttaccaattggtagatatttatgttgatttgaatttttggctatcacgattaatgctgctatgaacacttatgtccaagtctttatgtggaatgtatttttatttctcttgggtgctgtgatagacagaattctggccccaagacttttacccctagttttgtgcccttgaatatgtggtattacatggcaaaaaggactttgcagatgtagttgaggttactatgcagttgaccttaagatcaggagattatcctggattaactagatggacccagtatgatcacataagcccttaaaagcacaagaggaagtagaggaagtcagaagagaagtttagagaggtatagcagaaatcaaagacatttgaagcctgagaaggatttgatgtaccattgttggcttcaagatgagggccttgtgtcaaggaactggatacctcagtcttgtagctgcaaggaactgaattctgccactaactagtaaggtgggaagaagtctctaagctgcaaataagaatcatagttccagccagtagcttgattttagcttggtgagactctaaacagaaaatccagttacatcctgccagacttctgacctgcaaacactgtgagacaataaatgagcattgttttaagcctttacatttgtaataatctgccacgacagcaaaagtaaactaaaacaggtagatccccagcagtgaaattgctagatcttatggtaaattaagactttgagaaactgcagtggttttgagctcaaggtgacatgatattttaaaaggatcctttcgctgagccgaaattggcctgtagggagccaagagcagaagcaggagaccagtgaggaggcaggcaagcggggaggatggtggctctccctagggtggctcttccaagttggaatttggacagggcaatggatgacagaggcatctgcagcaggtttggccctctgctggaagtggcatggccggagatggtgtggcaggaggtggtatcccagagccttggtgattgaacataccaaggccactggtgagtctcagtgggaggctgaggcatcagaggagagggaggtatgtcatggactcagtggtaaaagaaagacagtgtaaggtattttcccttttgtcactgcatacaagtaactgccattcactaccctgggacagttgagttactggagggaggtgatggaagtttgatggaagaaaacaaacatcaaaatgaatagactgagagttgccttatgggagaattatcgtgtgatgtaataaaaggtgttttttttggggggggaggggaatgtcattccaccaaaatgaatggtttagatgtgtggtgtagtcagtcagaatggctactagtaaaaagtcaaaaatagcagatgctggcaagattttggagagaggggaacacttatacactgctggtgggaatgtagattagttcagcctttgtggaaaacagtttggcgatttctcaaagaacttaaaacagaactacctttcaaccagcaatcccatgattgggtatatacccaaaggaatgtaaatcattctgccatgaagacacatgcacatatatgttcattgtagcgctattcactatagcaaagacatggaatcaacttaggtgcccatcactggtagaccggataaagaaaatgtggtacatatatagcatggaatactatgccaccataaaaaagagcaagaacatgtctcttgtagcaacatgcatggagctggaagccgttatcctaagcaaactatcctaaggaacagaaaaccaaatactgcatgttctcacttataagtgggagctaaacattgagtacatatggacacaaagaagagaacaacagacactgaggcctacttgaaaatggagggtaggaggagggtgaagattggaaaactacctatcaggtactatgcttattacctaggtgacaaaaaatctatataacaaacccctgagacatgaaatttacctgtataacaaaactgtacatgtacccctgaatgttaaataagttttttttaaagaaatatggtatattaatatgccatgcacatggcaaaatttctctggtacttattaagtgttaagtacaaaactttcaaaggatctagcttggtttaacctgagaactaaacagagttcctaatttggcttcttaatttgggtattgtaagttaatatttagtgctctgactttttgggagctaatttacaactcttactgatttaccatttctgcacattaaatgcatgtctggtgattaactgtattgttagaagtcatccttacctgactgaatcctataagttgccttaaataccaccgggtctttctataattattctttcctcccgtaggtactttagtgctcacatctccttagcctaatactccaagaagtgtctctgactttccatactcgagttaggcgtcattttgagatgctgccactgcactttatacatcatgcattcttttgtctttgttttcttttcatctgtctccctaacttgattttgagcttgaaaagttcaaggctcacttttcaccatcacagctttggtgcaaagaacttgcaacaggaaagtgctcagtaaatactgattgaattaaagcaaagaattgcagccatcacttcattgcatgccctcctcttctaaaaaatactgaatgtttaatctcttagagaaagattaagtgtccagagaaagtcacttctcattgacagaccttccagtccttttgacaaacaaatatggcagaagacagccccattatgttgaccatagacatgtgtgtgacacatctgcttaccaagtcttattttcagtattaacaaatagctgggtactacgtacttttgatcttgtgccttcttaatttatctgcatttttggactttactcttgagaaaaagaccaccatgggaatgactaaagaaagtgctaaccagcgttggtgacatgcgcagtaactccctttgcatcagcacacagagatacatgtgtgagaaatatctttattagaaaagtgactggatatccaagtgttaaaagattaagtattcttcagaagaagttagcaccatttaccttacaaggtaccagagagggaggatccttgatttcaggaacacaaacacaattcttaatagatacaggtggtcatattttcggaaggtatttcccaggcttcctgttcatatacccatttaggatgattgcatgttttccccctattataaacagctctaaacaatttcccacaaacagctcaatttaatttgacatttattgggttacacttgacatttccaagtgcaataggaatttttttttctccctgacaactcacttgtgaaattatgattgacggtctataatattcaactcaactgtgttcaaaactgaccaatgattttggaagatgaaacagcttcaaattttatgacccataggtaacgttcgcaccctggaagtagagataatagttaatcaagggacaatctctgccgtttgcctgttgtctcaggcttcatttctggactcagctttggccagcttccatacatctctcccagtgccccgaggaggcacttagcaaatgttgggtgaaagaataaaggtagccactttgaagatgtatctttcattatatttatctttttagcactcttttcctcaatttaatcaaaaaaagcttattgaaaaatttttcaaaaaataaaatatgaagaagaacaggtaaaattttcccacccagatgtaatcacttttgtcagtttgtggtgtgaccttccagacttacatatgaatgtgtaagtgcatacacacagccacgaaacatggctgtatctgtctgtgttatgaatgaaatatatatatcatggcaacaggtactggtgtgggcttctcctatgttgcttatctgaatatgctagaaaaaaaagaggagggatttttacgttgtattctttattccatgaagtttgatttttaaaaatgtattaggatatagttgtatagtagtaacataattaagaaataaagatggataaaaccataaaacataaatatattgagatttgctacagtatattctaatttgatggtttctcatttatttttatttttttctttttgttgactcacctccttgatttttaagtcttgtggagttgtactgactgacatctgtgacttaaatatttaataatgtgtctttctgtttatgtatctcagaataataggtaccattttaccttgtaactcaatgtcatgtgttttcctataaacaaggtaagttaatttttttaaacatactaactttatttcaaaggataacatcgcagtatctttgatatctgacgtggactttattttccattaccctgttcaagtttaaaaaatttgattttttctaacaccaccctgatttgtttgaaagcttttaggtgctacactgaaggacgttagtgcccagcttggaatatcactgtgctcctagaacagactttccaatcaggtagaaagagaagccaggacagagagacccctctgcaagtttcttggtttgtaatttagtggcagtaagcttattaacatccgttcgaattttacccctgattttatattgcacgtagtctgagtaataagatttttaaaaaatgatgggcaataaaacttgtagttctgaagggcagggtgttagcctatgattactgtgttagtctcatccaacttcgagtttcatctcagaaaaacaaagctctatgagcacttggcattaattaaattatgtgtagagaacttatttctacttaaattaatgccacttgacattctaaattcttctactcttaatcttgtaattgccttatcttgccatgatttataaattgtgaatatgagccctttaacttactggaaactcaattgtaaaatgatctattaatgaggaaggaaaatttttatttaagggtgaaataattttattttcagctttattttaattataaattctgatattgcacataacatactgaaattcctaattcctttctttctgaggaaattttagggttgcaagatagaaattttagcctttggaaaacagtataaaatcctagaaaatattctgtatgtgttccaattgatgccaggccaggtgttcctggatcttcttagagagcggcaacactggtgccaggtcaccccaacctcccttggcctctccgtgttgctctcctgcctgggaaccctttttctcctctgaggcccaggttcagtcccatcagaccctctgggtctcaggctgttcccgctaatgtttgactgactttgaccagtgagagaagggagtcagaaaaagcctgcagataaattccttgccttgtctttcttcctcatctccacccttcttccttcagggatgattcccagacacagtggttcgtatggcctctctagagacacccatctcccataaccaagcttccggaaagctgtgatctccggttcagccgtggtcacctaggcaacatcccattttgcattcctttccttcctccctggcctcattgccctgtcccctctctttctggcttccctgagattctactctcacataagatttggcatacacatttttcacatgcttttgctttctaggtaagtcaatctaagacattttgaaaacataaattctcataattattttgtctaagtacttattggaaaattagttccagcaggcaccagcttactcttgattagttgccactatttctttacctcttggatatagaataggctttaaaatcatatatatgtatatatatgattttatatatataaaattttatatatataaaatttttttatatatgatatatgtaaaattttttatatatgaaatatatataaaatatataatacatattactctgtgttccttatattattgagtttatgctatttattcattgtgtaacttataaatcaatcatcttaaccaaaagtagatgtgattttgaagtgttaggagttaaaaatgttgaccaaatcagagataaaagcccagaaagaaaggaagatacaaaataaacccctggtcttccccccttacttcacctgctctcaccaagcactctgcaactgatgatgctttttgaaattcagatttgacaccttctcttcttcctattgctcttaagatcttgagagggtatccttcctgatcttggcctttaggtctttgggcaaatggaactataagtccattgttcagtaaaattgaatgagaaagtgcatataaaatatgtagcatgatggctggtagtgtggatgcccctttacagtaggggtgtacctggctgcataccactttctgaggctctgaagagttccttgccttctttcttgccattcctgcccttatttgaggaaaaggatccagggaagacagaggctctggtagagattcttttggctgccagatttttgccctgagcaaaatgtgttaggtctccacaggttgaaatgccaccagattttaagaactctataatatgaaaagtcttttatttagcatttagtagctgtgaaaatttaatgtttacatcagctctcctcctgtgtcatttccatgtatgtcttcttttacttagtgcaattcgttttttttctctctcgctcatgattctacttaaacttatgaaccaagctctgctctgagtcctaattattttgtagtagagaatattccttaaaagtccttttatcttatttgtaacttcagtataagcacttaactttttttttgttttttgagacagtctgtctctgtcaccaaggctgaagtgcagtggcaggatctcagctcactgcaacctccaactcctgggttcaagcttttctcctgcctcagcctcccgactgggagtactggcatgtgccaccatgcttgtctaatttttttgtactttttagtagagatgagattttgccatgttggccagtgatctgctcacctcagcctcccaaaatgctgggattacaggtgtgagccactgcacctggccagcacttcacttttgagtgtcctagttggacttaattctttccttagaccatctacctgggtcgatcaatcagtagagttctttaaactcaggtggttaatccattttgggctttttgtaaaaaaaaaataaaataaaaattaaatgactgatattgacaagtgaagtttatttgaagcatttggttatcaattcttagtgaggattagaagtgttcaagctctgaatcaggtgaacctgtagtattttctgtcttctcaacttacatgcttttcgcctccaacccagtttgagatatttttatttagttggcagagtgagagtaactctcaactgaaattcacaaaaatcaacagttgggaaaaatgtggcactcagtaagtttcttcgagaaggtttctatttccttaagatgatctccatcttacatagcagagcagttgtctcaagcggagggtgttcttgacatttccctaaactgttgcagctcttcaagattgctctggaaatttaaatatatttatctcaattcatctattttctatttaaagaggagaatgtttcaacacacttgtgaatgggaaatacttctgaaaactctgttcaattctgaatcaagaaaatttcctaagtctaccttttttttttcctgttaaaacttggaccaattgtttactggcccacatgaaatacttctgtgatttgctttatacaaatcctaccatggcatactgtgtctctctcttcagagagtcgctaggttataaaggaacaatatccctgcaaactcaatgagcctgtctttcagacaagtcttgatctgggatttcttgagaactgtgttgacctgtgttatctgtttgctactctgttgattggagtatttcttagttattattctcatggcaatagtcatgtccacagaaactctgctgtggaaatagcaaggagacccatcttttccaatatattcattcagctgcagttacatggaaattcaagataaaaaggactcagctgtcagtgaaagaggattcccagtcaaggcccctgcatggaggtacctatatttcacgtgacaagaatggcctgatgataagtgcctagtttctctgtttcagtcctttaggaatccagagaacagctgcccctagaatccactagaattccactagattcatgttatatcacccattttcttcaaatctgtctaaatgagatggactttttttattcttaggttcagtagcaatagcataattgtaataatttcccaagaacacatgcttcctaccaggataattctcataggtgtccttgttggctagctttcttttttaataagttattcttaaaacaactttatagaaatgcagtttatgtatcattaatttacccatttcaagtgtataattcagtgatttttagtaacttcattgagttccacaaccatcaccataaattacttttggaacattttcaccctcccataagatccctaatgcctgtttgatgttaattgccattctcacccccagccccaggcaacccctcattcactttcagtctctaagtttgccttttctggacattgcatataaatggaatcatatgatatgtggctctttgtatctggcttcgtagcatactgtttttgaggttcttctatgacttggcatatatcaagagttatttcttttgtaatgctgaatagtattttattatgtggataatctgttcaccagttggtggacatttagattgtttgcactttgaggctattattaataatactgctgtgaatattcatgtaagtctttgtgaacaaatgttttcatttctcttgaatagatacctaggattggaattattggatgatattagctctatggttaactttttgagaaactgccaaactttttccaaagtagctacaccattttacagtcccattatcaatgcatgaaagtttctatttctttatatcctcactaacttttgttgttttctgtctctttaattttaactactgtagtaggtagagagtgatatttcactgtggttttaatttaccttttctaactgactaatgcagttgaatatcttttcatgaacttactgaccattcatctaaattctttggtaaattatctggccatatagtttgcccattttttgattgaggtttgtcttattgaattgtaggagttattcataaattctggagaaaagtcctttattagatatgtattttgcaaatactttttcccagtgtgttgcttgtcatttcatgtttctagtagtgccatttgaagtctataagttgaattttaacaaagtccaacttactaatttttttctgttttggagaatgcttttgatgttgtatctaaatttttttttacctgagtcacatctcgaagatttttctactgtatgttcttgtaaaagtttattattttagcttttacatttaagtctgtgaatctatttggagtcatttttgtgcatggtatgtggtgagagtctaagttaaaattgtgctattgtctctaccattttttgaacagaggatacattccccaataattgccttggcacctttgccaaaaatcaattgactataaatgtaagaatttatttctggcctctcgattctgttccattgatttatgtatctatctttataccatgtggtcattagaaaagtagttccccaaagacgtccatgtcgtaagccctggaacctgtgaatatgttatttatgtggcagaagggactttgtagatgtcttaacaagtataaacgtttagatgagagattatcctggattactagggggacccaatctaatcacaagtccttaaaggcagaaaacctttccattttaggtcagagatgagagatgaaaggaggaggaggtatttgagcatgacaggggcttgacctgtggttactggctttgaaaatggtggaagggggccactagccaaggaatgtatgtgtcctccagtagctgagaactgtcagcaaggaaacagggatcttagtactacaagcccaggaactgaattctgttaatcacctgaatgagcaatgacacagatgctacatagtgcctccaggaaaaaatgtagccctgctgttgttgcaggacttttccttagttcagctaaagatggggctctttgtcccacagccacaaaaattcaggctcgcagacaatttgaatggtgagtaagacagggttttattgggtgaaaaagaaaaaaaaagggggaaacaaggattctcaccaggccaagtccctgatagagcgcttcccaccaggccgtttgaatcccaggtttcacacaggaaaaggaggggccaggctgctttctgctggaaagatcctgaacttctcgaggctgtaccccagtgggcagactgggtggagtttctccagggaccccctcccatgtggctgtctcactaataccttgattttagcctggtgagaccagtgttgagtttctgacctacagaattgtaagataatacattgtgttaagctactaaatttgtggtaatttctaatggaagcaatcaaatgtaatatatgtcagaaacatggtgacgtgattactgttaactttattagaaagtttgaaatttgaaagtgaaaatttttcaatattcttttccttttcaaattcgttttggcaattctaggtgttttgcatttctgtatacattttaggatctgcttgtcaatttctgaaagtaaacctgctggtgttttgattagagttcatgttgatcctgtacatcaattgtgggagtatggccatcttcacaatattgaatcttccagtctgtgaacatggaatagctctccatttatttagatctttatttcagcaatattttgtggttttcaagcgtatgtctttcatttcttttgttaaatttatttctaagtattttatttttgatgctactgtgaatggcattactttaataatttcatttttagattattcattgcttgtatgttgaaatacagttgatctttgtatcttttattttatatcctgtgaccttccttttcttgtttattcatgcaaattgtgtttaaaattgattccttaacattttctctatacagaactatgtcttctgtgaataggccatgttatgtctttttgtttttttccagtgtgaatgcctttttttttccttccttgcctgcttgcagtggctcaacctctagtaccatgttgagtagaatcggtaagaggcgacttccttaccttgccttctatcttaggggagtagcattaattctctcccagtaagtatgatatttgtcatattcctggctgttttaacctgtagtctgtggtgtggtgttgcaaaatgcagagtagcttcctgctagtaagaatctaacctgttcttactgctctgggttaaatcattcattaacactgagagagtacatttttttactgtgcagggtatagctgcaagccaagttcttttgttgaacaattgtgtcctgcatatatgtttgtaagaacactgatattttaatgttgttgaagctcaagcagaaattagtagtactgctatttataggctaaagaactatttaattattcatttattccttcttgtatttgttcctccacttggtcttgtattttttcatccatttggccatctgtatctcttttcttacatttatccaagaatgatgaattaacatatacagtgtgctaggtgttgtgataggttggggatctgagggaaaagttactcctgtttcttggggaattcactttagatgtaggattgtaggagacacagacacaaagggaataaattaaacctttttagttctcagatataatatgcatagataggcatttgacctgaataatgtctgatgtggggcaatttgtaatttcctggaagatgatcataaaggaaggagctgcctacctggcagttgcatttcacaggtggttgtattaggtggactacaatctcctttctggattgcttgattgtttcctttgtcattgcctcttatggtaactctcatatgtgatataaactttgtttctctgaagaaaatggacacacaaggaagccacccataagtggtgataatggaaggaaagagcaacatgtggtcttggtaagagaagacaaattttgcatagaaagaaacatttaatttgttagtagcccacatttatgagatccaggagtcctacatctgttctaaaccaaagaaaaagtgatttgtgaccttttaccagtaatctagtcagtgcaaatattttttataaaatgttttacattgtacaaggaaaattaaatgatatagggtgaacatttagccagtgtttactgtggtctaaatagtttgctaacttgttctaatatatggtcttatttcttctgtaaataattctgtggaatacatgctattttagtttcatttacaaatgagatagttgagggccaagggtttggatatttgcctgacattaaacagaagtgatttatgtggaattggcatttggacactggcccttagaattcagggtgctattgtctcactactccaagagttgttgtctcagacctggggttcatccggtaaatgtcaacagtctaatgcagggtttcttaaacctgatgatgtagacattttaggtcagataattctttgctgtgagggctgtcctgtgcattgtaggatggttagcagcatccctggcctccatcccctagggtggaggtggagtactaggtgccagtagcatcccccagttgtaaccaccagaactgtgtccagacattgccaaatgttctcttctgtggggggcaaaatttcctcaggtttagaatcactgtaattaccaggtaaattaggattacatcctgtggtatactgagaaggaaggaaattatgattaactctgtttagggtagatacaagaaatgttgctgagatagtgacatctgaggtttcatccctacatggaattatccaaactgcaaaattagagggcccagtctccaagactgtctttacttttcacactgactgcaagtgtgaggtttccccaaaacaccctcagtttcaacagtttgctaaaaggacccacaaaactcactgagtgctcatgattactattacattacagggaaaagatatgaaatcagatcagtcaaagaaagaggagacaactaagttggagtttaggaggattctgtacaccaggtttctgtgtcctctccatatggagtcaggatgcattaccctcctgtcgttaatgtgtaactgtatgtacagagtattgccagccagggaagctcacccgagcctcagtgtccagagtttttattgagagcttcactatataggcatgatcaattgcctgattgcccatgtggttgatttcagcctctgtgttccccactgtaaaacacatgattgatctttctgtcatgcccagcccctaacctaagactattggctgtagctggccccaccttaattgttctttcccaagactaacatattcccatagggatgacatgggttgcctcctagaagttgaggacaaaagccagaccaccctttgggcaaggccagattttctactacacagtccctgacaaaaggaacaaatgtgcatttgtagatgaagtagtgtggtacgttgccacaggactggcaattcagggagaatgtaaatggcaggcatattagtcagctagggctgccataacaaaatgctacccactgggtggtttaaataacagaagtttatttttcatagttctgaaagctagaagtccaagatcaaggtattgattccattctgaggcctttcttcttgacttgcagatgattacctccttgctgtgtcctcttacggcctttcttctgggcactcctgtccctgatgtctctcccacttcttataaggacatcatcatcgtattggattaggtcccttcctaatggctttattttaaattaatctcctctttaaagaccctgtctctaaatatggttacactctgaggtactgggggttgagaattcaatacgtgaatttagggaggtttacaaacagcccatagcattctgccttctgcatgccccctcccatccctgatttgtttcctcttgcatgtaaaatacattcaccctatcccaacagcccccaaaatcttaacccatctagcatcagctctaagttgaaaatctcatctaaatcagccatggatgagactctaggtgtgatacatcttgaagcagaattcttctcaagctgtgaatttgtgaaaccagacaagttatctgcttcccaaataggcgaacaggcatacaataaacattctagtcctaaagggacaaattagaaggaagaaaggaatcctggggcccaagcaagtccaaaacctagcaggacaaagtccattgtattttaaggcttgagaataattctctttgtttccatgatgctctgcctctgggcccactgaggccaaagtccagccttctgggtccacttgggcagcagccatgccccggtggctctgagtgatagccccgcccctaagagtccaggtgagagtaaatatgatcagatctgtgtataagaaaaagaaatattgaatcctacttgatcaatcttcatttgcttggaggttacagtctacttggggagacaggcatctgggcaaatagttgtaacaaactaagaaatagtaaactctatgagtgctagaaagattatgtcctaagaatttagcatttttaatctggaatatcctcagggatattttgagatttttgttggccatgtatcttgcaggaaattactgagttaatgaatcatgaaatgagagaattaatgcattagctttggtaagcttgataatttcaggattccagttaggataggggtggggatcataactgaaaagctcaacggtacaatcatcgttcctaaatatgtttctaatacagtttcaactataacaatcttaactctgacttaggaattgaaaactgaaaaagtggaaactccatatagctctaaatttgttcttagagctttcactctttattttattttattttattttttttgagacggagtctcgctctgtcgcccaggctggagtgcagtggcgcgatctcggctcactgcaagctccgcctcccgggttcacgccattctcctgcctcagcctccccagtagctgggactacaggcgcccgctaccacgcccggctaattttttgtatttttagtagagatggggcttcaccgtgttagccaggatggtctcgatctcctgacctcgtgatccgcccgcctcggcctcccaaagtgctgggattacaggcgtgagccaccgcgcccggctcactctttattttttaaaagcttgctgctctaggaagaatgagggaaggtaattttaatgatttgaagtttgtgttcagaaaatacttatgctttcttttaaaaagatgccacttaagttttctttaagaccaggatggaaaacattcattttctcacgttttctctctcatttatctctttctgtgttgctgtggaatctcagacttacataggatcaaagaatcatattactttttagtcttttatttatttttatcccttccttactttgctactttaaaatctattcgatgctttcccttcagtgttgtagccagctgggtgtctccacttggcccaaaaccatgcccctcagtctgtttcatttgatggatcattttggattctccttattctcttgtcttttgtgtcacatgaatacccttttcttcagtacatttaagcccaacgatgaatgtttcttaaattgtaaccagttcagtgactctaataccacagttcttttgctgtcctggtctctctcacacacacaacagaagtcactgaagactggtcaccacgatgcccttgttcttacattttggtggaatttaatttgtgcagccattcttaagagagctgatcagtgcgtatctttttcttttgctgaggcggctaacagcgttgtcatcatcatcttttctccctctctgtctgtttttagagtcaagtacaattgaattaactttgtaaaatgatagcttcagaaaacattttcacaagaataaaaagacagattttctttgtatataaataaagaagacagtttatgctgggaaatgaatcttttaataaaacattgtccctcttccactttggctcaactggggaaaaatcaattttagggtcttcgaatgtgaaaaaagaacaaaaggaaatgaagtttttctgtataagtgggaataaagaaggacttgaatatagtggttgccaaaaaagttttcagattaccattttcctttagtctttaaattcctgacataggaggctgggcaaggtagcttatgcctataatcccagcactttgggaaactgaggtggcaggatcgcttgaggccaggagtttgagaccagcctggacaaaacgttaaaacgaaaaaaactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcacttaaaaaaaaaaaaatcctgatataggaagtatagttctgccatattaaaatgcagcattactttatatttaaaagtatttttaagtttccattgatatttttcctcctcccaccttttttttttcttttgagacaggctcttactctgtcacccaggttgagtgcagtggcgcgatcttggcgcactacaacttctgcctcccaggctcaagcaatcctcccagcttagccttccgagtagctgggaccacaggcacacaccaccatgggcagctaatttttttgtgttttggtagggatgggttttgccatgttgccaggctagtcttgaattcctgagctcaagtgatgcacctgccttggcctcccaaagtgctgggattacaggcgtgtgccaccatgcccagtctttcttgccttttaaaggaggttagacatactgcaattatgaggcataaaaacataggatggaaggaatctataattataaaggaaactattaatctttaatgtcctaggtaattgtatcttttaaatttcttaaaagtgtaatttattcaccacagagagaaacatagtggttcatctttacttctggtatatgcgtttttcatgaataagatataatttaaaattgtaagaaaagtgaatcattggaagatagtagaggaattgttactttgcaaaatccaccataaagccggttaagaaattatgttttttactttagaagaaaagcatgcattattttcagaatttttataaataatacatgatcatagttgaaaaagttgaaactcctttaagttatttttctgtgtggagatacatatgtatatgtgactattttcatatagatttatttcacaaaattttgattatactttatacagttgtattcagctttttttaacattaacatggtatatgagattttttccatattttaaaatatcccccccaaatgtaattctaatgattatactaaagtctctcatttgatgaattaaaacgtacttaaccattttcttcctgtaaagtttttaggatgattttaccactgcaaatttgcaacctgagaagtaaaaatataactttgtgaggtcaaagacagactagaatgttcaccgtattcggaaaatcagtaagatcacagaaaggctcatcagctgcctgatgcttgagtagctcactcaagtgcttgtcgttgaatgcaaaatcttgtcttaagtggacaggtgtgtgaatccttccaccgctatactctccttgcctgattgagtcaaggttgttactgtggtccctggaacagagtgtgcctcagtaaatcaaatataacaaaaggaaggaatgattttcagataggatagacagctaagatgaacaagacttttagaacatttccaatttgagcagtgaatctgccttgtggaagctcaaaatgtactttaagtgacagctgccgtgtagtgttcaattcaccctttttcaccaatgcatttagtagaccattgtggagaggctccaaggtgctaggcgctagtgagagtgctagggatacgttgtgaatgagacattgttcctgcacctgaggagctcacaggttatggaggatgacaaattactcttgtacaatatgataaacatcacagtggaaatttggataaattattgtggcaaccagagagtttacaaactttagctagagagtcagaaatgcttctcaggggcagtggcatatctcatgctgttggcaatgaagggtatttgtttatatgccaatgttacacagtttgtacttaagccagtggccaatgaaataggttagtttttaattttttaaaagtatggcatatttgtattttaatagctaatattgggttatacagttggggtaagactgaaataataaaataactacttttcacatagatatttccaaggcaccctgtagtgctacagtacattgatttaaaagaagactatattgtatttagtagagtttttattactaactctatataaatcaggaactatatagagtatatgtgactaaatcaaatagtttatgaaattatttgtgtggaatgacctttctcccctagacataatcctagtgaaatcaaggaacctgttttatttgcttccttatactcagcacctagtgcagtgaccagcacgtagcacatatttaatgtgtttccctgtcaaaatactatttaagttaagacttgattgagtctgttaggtaccagagtcactcactcattactttaatttcaaatgctacagtttgaaaacttaatgtatgcttggttgttaaaaaaaaaaaagcagtgggaagaatagaagttgtgttagaatacaaggtacattttattttcaccagaaaggaaaaatattgttctaagattataaatagcacgaaaggcttattttaattattttaaaaatatgatacctttccactgcagtacctggatttcaagctctgactcaggggtgtccagtcttttggcttccttgggccatagtggaagaagaattgtcttgggccacatataaaacacactaacaatagatagctcatgaactaaaaagaaaaaagtgcaaaaaaatctcataatgttttaagaaagttttcaaatttgtattgggccacatttaaagctgtcctgagctgcatgtggcctgtgggccacagattggacaagcttgctaactgttttgtatagaatctgaaacacagatgattaagacagggatgcatagtacctgcaggagaggattttatttagtaactcatgtccattttggtgaatgtagagtttatacctgtggcgttttgtttctaactagtttcactaatacagtttgccatgctgacatatttccttctctgttttggtagattactttgcaggttgctgaaagtctaagtcaaggtaaagtgtgaggtaaagatcagagtgagtactattaatagcgaggggaggggggaaagctagtgagccctgtagatcagctcaacaaagtgtatatgctggaatccagtactttggagataatcttccaagtggaatgcagtccaaaaaatggacactattacttcctgtgctggcagccgctctgtttacagaaggaaagagtatgttcgattggtcaaattacattgctgttgcagatacacttgatttttctagtaggaaaaattataatattcttaatgtttttctctttttatccctctccctctattctttcacagatatcacttaattggcaaaagagagcttcagggacaactagtacttcttttctttttcttttttctttttttttttttttttttgagacagagtctcactctgttgtccaggctggagtgcagcagcgagatctccgctcactgcaagctcgcctctcgggttcacgccattctcctgcctcagcctcctgagtagctgggactacgggcacctgccatcactcccagctaattttttttgtatttttagtaaagacggggtttcaccgtgttaaccaggatggtctcgatctcctgaccttgtgatctgcccgccttggcctcccaaagtgctgggattacagacatgagccaccgcgcccggccaactagtagtacttcttttctagcatatgctaaagttcagttgcaggctccttaagaagttaagtgagccccattcagcctaaaagggagcatattgtacattgtgttctgtactttgccattttttcactgaacaatattttagaggtcagtgtatagggaacagcttcattcttttcaaacgcttcatggtgttctagtttatggacgtatcatatttacttacacatcctcactgtctcatttttctcactattcctgttaaaggctaaatgtgttattctgagctagttgaggacttgaaacttagggaatgaggaacaatagagcattttacacatgacgggccttgttcaaagtcagaacaagaggcttggaactccttaagagaccatactgtttttcactgttcacagcagttagaatcccaaaactaattttctaatatagcgatttctggctctggttttgggagtacccaaggtattttccagtcagattctgtggtattgggacattttcagagaatacattaaaaaatgtatgtattatatattatgtatatatgtattatatattaaaattataaataaactataatagaaataattaaaataataaatagaatgtaaatcgtacacattataattcctaagctatatcaaacatataattactttattaatttaatcattaaaatgaaaaatgtgtaaattatatagttttccattttagaaattacggtattaaaagatatagataattttttatatgtgtacatacatacacagttcactaaggtttgcaagactttttagccttaataaggataatactaatagcagtaatagtagggactaccacctactgagcatttaactatgtgccagatgttgtattgaggcaatttataaaaatcaagtcatttaaattcttcagtgtcattatgaggtgaccagagtggttgtcttcttacagacaaggaaattagtgttgaaaaagtgtatgcaacttgccatacacttgaccattaaccatcgtgctgcatctttattacataaaattgggggaatgttttgccaaataaaatctaaattggaggccgggcgcagtggctcacgcctgtgatcccagcactttgggaggctgcggcaggtggatcatttgaggccaggagttcgagaccagcctggccaacatggcgaaaccctgtctctactaaaaatacaaaatttagctgggcatggtggcctgtgcctgtaatcccagctacttgggaagctgaggcaggagaatcacttgaacctgggaagtggaggttgcaatgagccgagatggcactgctgcactccagccttggtgacagagcaagactctgtctcaaaaaaaaaaacaaacaaaaaaactgaattggagaacttgggcttttagggtatatttaaagtgcaaacatgaaggaatgccactatgactgaagattacacaaggaagagtttacagtgagaatgtttgtgctctactggactctaccctaagggaaggggggatgaatggtcaattgatgtctttaagtatttacagtagtcgttcatcctctcactgacctgttcccatttcccccatcaaaaatgcagaagggagtaggggcaggggtgtaggaagaggggccaaaaccttgctggaaaccaaaggcttcatggataagtgactgataagtagaggaggaaccttttcaaatgatgtattgagcttttaaaaccctacagtgtaatagcaaactagcaatacacaagatttatttgtaagaactctgcatgtaagtgtgtgtcatgtgtgcatttgtctgccttttgaactggtatgtacaggaataaagaatcctaggatactcatgataatgacagctatttaatttcctttgaattttgattatgcaccactgaaaagtgaaactgcaagaatttctttagtcatttttatggaagggatgggaatagagtaggggggcaaaaagaaagacaaaccaagagggaatggttgattgaatgttgaagggggacttgtttggcctaacatatttttctaaatatttatttttgctggaatatgaagatacacttaatcttccagctcattttttgttggaacggttatttagcaaagcaagtagggggctgctgttgctaagctttttgttattattttgccacacaagaggatattttttaaatagttgttgggaactttaagacttgctgagcaggaaatgccacatgtaaggatgtcttaatgttggcagtgtttttaatgcaagaaagcaaaagatgttaaagacccacttcattttcttggtgctcatctgtgtccaccagcatgagagtaaataaatgtggtatttaatgttcattaaccctttactacaaaaagataataggcacagtgcttgctacagtagttctgaccagtgcagtttgtaggagtcactaaaacaaggtgcaagcagcccctgggaataagataaagctaatataatactaaatgactgagaggattgtgttgttcttaccttaaggaagaaaatgttagccatcaaagaggatttttttgtgttcttttagcatcttgtggagtcagaagcctagcattctagatgagcaaagtacacaattgcgttagtattaacttgctgagtttgtgtttgttatgctggttttatattcattttgtgagtgtgggtgaggagggaaggaaaaaaatggagttgggaggggagcttatctgttttaattgatcactgacacctaaggcatctcaaggctaggcagaaactcccacgtcttgctgtttcctaacctgaaggagggggagagtttgtggttccagggatatgaaaaggaagacctggtgtgatgttctgtgtgtgaaggagttacttggaggaggcactagaaaagcagatgaggttctcccacactcccaaaggctgagtttactcctggggttgggggcatagtgaagagaaccatttaggtatcctacacttacctagacaccaagacttgtacattgtacctcaccggctttgtgtattaataattgaacccccaccacaatgctgtgaggaggctttacttaccttcctggttgagagaggacatctagcttagagacatctcttgcatagctagtggttggcagactcagggcttgaacccagatctcacgttctttacctaacatggctatatttatttcctagggctgccatagcaaagtagcacaaactgggtgacctgaacaacagaaattgattgtttcatggttctggaggttagaagtccctgctcaaggtggtggcagggttggcccttctgaggctgtgaagcagagtctcccaaatttctcattttttaaaagatactattgtattggattatggcctaccctaatgatgccattttagctaactgcatcttcaacaactcaatctccaaataagatcacattctcagtttctggggattaggacttcaacaactgaattttcagaggtcctgagacacagttcaactcctaacatggacttagagtttttcttccttgtagccattatatagatatattttaaagatttaattttttagagaagttttaggttcataacaaaattgagaggaaggtacagagttcccatatacccctcccccgacaactgcacagcctcccccaataccaacatcccccaccagcatggtacattcattacgattgatgaacctacattgacacatcatcaggccaagttcataatttacattagggtttactcttggtgttgtacattctatgggtttggacaaatgtctaattatatatatttgtccttatagcattatacagagtagttttattgccctgaaaattctctgtgaaaaattctctgccattataatttttattggtaaaaattttgatgtcagtttcacaaagtttcacctctgataattttatttttttctttacagtaaacatatagatggtagtctggctctgtcctcaccaatatttcatcttgcattgaaatccgaattggagtcccctccctgtatggagggaggaatttggtgggaggtgattggatcatggcggtggtttcccctatgctgttctcatgatggtgagtgagttctcacaagatctgatggttttaaagtgtggcacttccttgtgctatctctctctcctgctaccttgtgaagaaggtatttgcttctccttcaccttctgccatgattgtaagtttcctgagacctccccagccatgcggaacagtgagtcagttaaacctctttcctttataaattacccagtctcaggtagtatatttatagcattgtgaaaacagactaatacaggtagttttcttactcgttcatactacaatcgaaaaagacctctgacctcttactctaccttctcatggttccttctgccacccttgtgcacgtatgttagctgtagaagggatttgtcataaaataaaaaataatgagatttagtcatgttttcagcaacgtagttaaggtattctttagagtaaatctattaatacattgtgatattatttgctcccacataaaaacttgatagttttaagagttgaaacctatatgaaagactaataaaatcaaggatttttattttttgtcacactgcttatcttgaatagggtcttgatatgtttcattttttattttttaacctcccagctgatgattttaataaaatagggcccttgggaattaacaaaattataccatatggtaagggtaaaaggatcattgatctggttaacaaaccagcctgagtttccaggggagcgaccctttctccagccctcctcagccttggacagttacattattgcttaacaatcatcatctgcttttagtggaactgcttatttttctccttggcttgggcagattgccccagtgtttcagatactgccttttggaaacggatcagtaggaaatttctattaccggaaatcatctgtttctgaaggagacaaactattcttttcaactcaactcactcttgtgaaacagaaagcccagcactttctcacagctgctctaagacagtccagcagggtaagaacagtgaggaatcaaatgtactacaagccaggtgggaccatagtccaccacggccaagcaagaaactggaatatccatgccacaaatgtggaaagtggggcatcttctttctagagagctaccgaggctgttcaaatttcaattttctctgtggcatgtaaaccgtatttttttttttttttttggtgtcaaagaatagaaaattagttttaattgtttcttatgaggcaccatatggctactctataattttggctttccatggagctgcatgtgcatatggaaaatgaaattaattggaaatcacaccctgaaatctattattaagttaatatagctaacagcttgtggggtgtcctcacactcagcatgatgtaattgcacataataataagtaactataaactcatataggagacaagccggaataaacagaggtcaaagggacaggctttggaagggaagagcattaataatggatggtgcagcaaacgtttcagttcctcaccattcacaaacccagggtagagggaagcagtttaatcatattcaaatgaattaatcagcagtcttgtgaatttcacagccaagggactgattgttattttgcaaactagtgttctgcaagcctaaggtcactcttggtagaatcagtgacagtgatttttcaggggtgcccaaacttgcctgtgcatcaaaaccctctgtggaactcttagaaacactgaactctgaatctaattcctgggattttgattcatttgctttggatttctcaattattaagatgcactacaagtgattctgatgccgctcagccatggaccatggaaaccactgatttcagtgatatatcatacagctctatatatttaaatgataaagactacagctagtttgtgttcagtttccctaatgtggttcctaaccttataacagaataaagtaagttcaaataaaaacatgaggtctgcaacttcatttggtaagcccagaaatagtgaacaaataatttgatgtcatctgtgctttttatgaaatttgttagtttatgggtctgtctccttgggctcagtgagggcactggctgttttattcaccttggtggtcaggacgtggtaggaattcaataaatgtttatggaatataaatttgaatatgaaaaggagcaaaaaggttattctcttcattagaaacatcagaacgatctctgttcatctcaaattgatgctaagagccatgttacgtctatgtaatatgtgatattagtatttcttaaaatgtcacctgagtattgtagaggtagagttgcatgcatttgatactaggaaggagattcttcctatcctttattcctcttccagtgagggagaagtctgcaaacattaagttatacttaaaagaaacatgtctagaattctagttgggagattcattgaccagacttttggaataaacactagtcatcatgctagcgacaggtggtcttgtgcatggtagaaaggcagtccaagcctatgtctctgaaacctgctctcatttctgttttctactttacgatttatgttatctcatactccccatgttgcctgttctccagtttttttacttgtgttatttccattcttctattcctgctcaatttctgcctcagggcagaattgtgtccaacagctcttaaatgcagcgcagaaactgtgatgttaaaaacatcttgttatccggccccaaaacatgttgtccttggtaactcttactggtttgtacataaagcaggttgggatctcattgatgggctagtgggaaggagataatggtgttatagcaaaaaactgcagcagagacaatgggaagaaggtctgtgactttagagctgaacaaagccaagaaatatatgcagatacagtaggatgttttgtggcttgaccagcagacaccactagctgtctctcagggctcccgctcttcctgaataatagagccttgatattttaaaaatttaattctctattttgaaataaattcaagcttagggaaaaattccaagtacaatatagacatctcccatatcattttcatcctgattcctcaaccgttagcatttgagaggaagctacaaacgtgatactgcatttctgctaaacattgtgggtatgtatttcctaaatagtgaaaacactctcctacaccatcagcattcagccctccaagtcaggaaacagtgttgatgcactgctgccccccaggacacaaagcccactgaaaggtcaccagctatcccagtggcgattgtccttcttttctgacccaggatttcagtcaggaacacatgtcacatttagttatcatgtctattggatctcttctactctggaacatttctttgatctttccctgtctttctagtctttgatagttttaaaaaaaagtcaggtctttttctgtttagaacgtctctcaacctggatccatccagtgtctccacatggccagaatcaggtcccccactcggggaaaatgccatagaaatgatagtcaagtgtttatatatgtcccatcagaaggcacatggcctgtcccactctgttcacattggtacatgccaggtttctccaccttagatttgacatttttcctttgtaagtgatttgaattttgtggggagatgttctgagattatgccaatatcatggtccttgtctaccttccacccaccagtcttggctttcatggggttgtcaattggtattctcatttccatcatttgctggttggtattttagtataaggaagagcctgttcttctaccttatttatatcatcaaagacttacgaattcttgttttattcagtggattgtctttcatttctaagcctttttgacatggcttcatcatttctttaaccacttccttactttatggcacaagatatctcaatgtcaacttatcccttttttgtcccagccctggtatcagccatttctctaagaaaccctggttgtttttgggaaagattgtatttagaaactaagatctgggcacttgtttgtgatcattactgttgaggcattactgcttttaggccatctcaggaggtagtatgtgtgtatagacatacacaaacacacatatatgtatatgtaagtatacacacaaatatatatgagtataaaatatacacattcattttaccctccctatgtacatttacatacataaacatgcatctgcaaccatttatttgtctacctgtgttaccaaaaatattgggtttatattgatacttccaatttcattcctaaatctcagggttctttctagcctcctacctttccatatttggaagttcctccaacagcaagaaacttgctctcatcctctatatattatttccttaatttactgttattaatcagtgtgatcagtttcccagctgttctgtctcttctgcccacaacccccgtgctctccaacatcttcagttttggggtgctgtcagatatgctactaccgtgtctttgtgaggaagctccccaacatccctcagtgcctgggtacttgatctccagtatgcatgctgccagtatcttcacaacacttcttctacccctcagcacttgtcctcacgtactaggggacctgtcactttttcactgaatatatggctacctggaataaattatttcccaacctcccttgtaactagttgtgggcgtgtgattttattatggctactggtagccagtatgaccatgaagtggaagccatatgttgacgaactgtgatcattatgaaattgcaactccagccctataactcaccttgggacttcatgtgagagaaacagaaacttctctctcttatgtaaagttttcaacgtattattttaattttttggtcccttaacagccaaaccgaattataactaatattgccccttctagacaagaaggaaatgaaaataattctgaattcagtcaggcagtaaagaaattcataaaggagtgtagcaccaaatttattgaggttacagtgaggggtttgaatttaaatctccctaaatcaagtgacacaatttatagaagtttgtaagaattacagctgagtgtaaagaattctattgcatgacatcaaggttctcaggcaattagaaagcaactgaaattcctaacaacaacaacaacactccaacaaaacaacattcacatggttaagtaaatgtaatagctttagccttacagagggtagctgacttctctctgccaaaatcagacagaatttggtaaaaacatgtagtagcacatcctgagggaaccccgggatgccatctttgagatcactctgtatggggcttcccatttgtcttggcaactggtaaagatagctccaacctggctatcaagagcatgcaaaaaatcacacctaccccgaccgagagggctaccccagctccttagagttgtgaccttgtctatgacatgggattcaaaagtatttagttactggttatgttacttttaacccaaggaaggtttagaatttagtaaacatgataaaatttctgaaacccatgataattaatgcttatcaattattagtaatctgcgtacattttttagttgatgtgtttctactgtttaagataactcggaatattaaagtaactgacaaagtagatattgattctactttctatgtttagttgagtagttaccattactcttgtaatttttatgttgaaagataaagtttttgacaaagattataaacaatattgcaatgcttttaaagtatatggaatcttttattttaatttgttagggagttactggtgcaatttaatacttagtagattttgctttccaggtcagaaattgaagtactttaagaaaagaaaatgggtataatgagtttgtaaatgcagtttaaaatgtttaagaaaaattaaaaattaaattaaatttgtaaatgatactgattacttaagggagtttagtgtatctaacttgaattatttaagtccaaaagcccccttgaaagtgaattacattttaaacttataattttcagcttataagtagaatgataagatttgcaagttgaactcaaaggctacaaaaaagatgaagttttaaacatttgtcactttattaaagcaaatatttaactgaagaccacaagtggaccctttgtggcaaagccaccatggacaaagggaacaattccctgctgcagtggccatgatggaagatctgtggtggacaagagtgctgtcttcacaggggctggatgccacattggatgccaaagctaatttctagtgtcattgtctgggctaagatggcaagattagggattgtcagccttcagtacctgatctcgatgccctgggcagcaagataacattcatatccacttcttggttgggatgggagatgtcatagaaaaagcatgggctgtcttactgtctgttgaattctggtgtttttaacaattaattgatgacaataatttctaaattatgtgattagtgggtggattagaagtaatacacatacaaagcattcagtatatttcttatcacctaacaggtgttcagacaacagttgcattttttaaagaaagatgatgagactgctgaaatagcttacaaatgatttggggccaaatcagataatttaaggtataaaacacacagtagtttacatttatcagtcacttgaaatgttgccagacattgtgcaaagtctttacatagattgcatccttgaattctcccaataaaccatgagatatttattgttatactctgttttgcagatgaagaaactgaggtttatggaggttaagtgacttatccagttttacacagctaagtagaaagagttgaactggaatggcaatccacaaaatctaatgctagactactgaactcaaatccacgttctcgtattcctatgttatagacatccatgtctgcagtaacagtgttgcagagaagttaagaccagccagtattgcctttactttgcagaattgctctctgacttttgtacctcatcaattcagactactgtctttttttacatgcataataaaagtactacatgaatacaccaatagagtgggccttgttttattataatttggtatattaagtcacaaaaatgtttggttaaatagacagtaaaaggaattgtccttgaagccattaatacatgtgagatacgtgatgggcacagcctttcatatagcttgaaaggaaaggtttttgttttgctattattgggtcattgtgttttccccattttttcttttttcttttttttttttttttttttgagatggagttttgctctgttgcccaggctggagtgcaagtgttttctccattttaattgacagtcagtttccccagaagccatcatcaggagttctggtcatatttgatactgggtggcgtggcttcttgctgaccactgtcacatcatgttcccaccaacttcttatattcacctgagcttgaataggtgagagttgtgggtggcctcttagcaccatactaaggtggtgtggataaggtttcagctctggctggatcttgtgctctggagttgacagctgtgtgatattgggcaagtgactttatttcttaagtttcctcatgtagaggactgctgtgaagataaacgaggtgaggtttgtaatgtcctttgaatagctcctggtgcatagccagtggtgagtatgtggtctccttaagacacagaacaacagtcccaaccattatagtaacaataatggcaacatcagtaatggcactgaaggacagatagctgtgtatgctcactctgctccacaaaacgccagccaagcttcagtgtctggttgcttcccagctcattttccctccctcccaggctgccacagggctggatcagtccctgcatcgatgttgggggagggatgtgctgtgctgatataagcctcagcctgctaatgaggcccaaagttgagcagctccagacggaatcaagtgttgtgttctctgccagaaaatgtggtggatttccaaggccaccagcactagcggcagccatggatatcaaaagggagactatcgaaaagcaagacaagacacaggccttgggtcaaaacaaactatcaaaacataaataaaaacatggtgtgcatttgtagcaggcgaatcctatcaaggatccagaggtactcattttacacataaaagcattagtccatcagaaggtggcagggcagtactaaatgtctttagaatttgggcagcttttgaaggcatctaaccctttttaactttgtactgtctcatcaaccatctcatcaaccatgagcacattttacttatttctgaatacttgcaaaaaatacaagacgtgagtgttttatatattcttaacacttggcaaaagtcagtaatagattacttattacaaaaattattttgcccaataggcaacatatttatcattatcatctaccatttacttgatatgtataagtataagccagtatacaccaagtattgtgttaagtattttccatgcatttctgccgccgcccctgcccccaccccccgtttaatactcatagtaactcttaaacgtaagcacttttattatcagcttcattttgtagataagaaaatcaaggctctattcacttggccaaagccgctcagacccctagaaggggacaaagcgtgagttctaatccaaggccatctggcctgcagctcatgaacttatccactgcacctaattatctctggtaaggtatcttctttaggagaaatttaagacagatggtaaacttggtaagacagatgtacacagaaaggagacggtttggctgggtgtgatggctgacacctataaccccagcacttgggaggcttaagtccaggagtttgaggccagcctggaccacatggcaaaaccccatctctataaaaaacaaaaaaaatttccaggcatggtggtgtgcacttgtgttctcagctactcccagttacttgggaggctgagggaggatcacttgaacccgggagttcgaggctgcagtgagccatgatcatttcactgtaccccagcctgggtgatagagtgagaccctgtctcaaggaaaaaagaaaaaacaaaaaaaaggaagatgtgttaacaatcctgtttatagatcttagatgttggtgttgggggacacctcaagagagtgcatcacccctttctgcttcacgaaaggagtcaatgacttgagatgcagtaatgtggcctgagtctcacagagaccaatcatgttacccgcatggagcaggtcagctaattctggcaagtgcagatgtatgtgccccaggcccagggaagaatacggctggtgttcaatcagaggattagcagctgaattcagaagtgtcaattttgcccgttactttattttgagtcactcctcccatgaaatgaagaagtggtttaagcccagtagagctgaatggtgtctgtgtacacatctcaggcagctgatttaatctaatacgtaataagcttatttaaaaataactgtcattttccccatttgcagatacaatatacgttccttgtagcaaatttgcagtttaaaaaaaaaagaaaaaatttatccattacaacctttctctaccagtaatcagagttaatatcttggcatatttcattccagatttatcctcagttatagatttgtatatgtacatatatttagtggtatatattttgcactatgctaagcttttccccctcataacaatgtactgttactcctcttaccaggtcaaagaaacatcttttatttaaatttgaaaatagtttttctctcattataaatagtcattgtaaagaacgcagattataacaaaactataaagaaggaggtaaagatcaacccctattccctatagataaccactgttgatgtgggctttatattaatatcatttcagactttgtttagacatttgtgtctatattttctaaagtttgcaaaaagtaatgtactctagtttgtaccacagatatgttttggcttttatcttctaagtactttctggtggtttcctttcaaaaatcctgcaggcttatcaaaagtctggagtcccatgatgttaagcttcaggcaggtgacagtgacattgatagcgtagaaaagcttttggttaaagatagtcgttttcgtcacttcattgcttaagtatcagtcttaagctccaggtatcatcctggcttttctggaggttgcaagtatttccaggaaaattcaatcccttgttgaaaatggaagagccacacagaaatacttgggcaagcgtggtgcaaggaaacttgtggatgcagctatttttgataatttccactgagcttacacaacatcattactataaaaaacttatatataaataatgaattgtttctatttctaaagagttactatgttcatggcttaaaaaaaattcccatttgaactcagtattttgcatataattgactgtgactgatttaggagtgtttcaagcagtattctgatttggaagtggtaatgggggaagctgattccttttttatacgcctttggatagtctcatacctgttgggtgcctcttgtaggccaggcattggacattgcgctttgtgctaaggtgtataaattaaatattttgttatgcttagtctcagtaagtatttaggaagagacttgtgatccctattgtcaatattttcgctcatttgtcctaaggatactcttgtaatatgttctcagaaacaataatagatttattgatttgggaattgagtcatacaagtatatgcatttgttaaaacttattgattggtacacatgagatttgggtatttcactgaaattaaattttacctcttccccaaaggaactgtaccttatttggttcttaatgtttattataaattaatatttttaaactctaatatttttaaactctaataactgatatggatactgaagagtttaactgtactgatgcacggaacttactctgaattgcatgaaaaaataagatgggttgtgctggattgagagatgtgacaaagcacatgtacaaaatgtgaacagttgtagatctaggttatatgtggatatttactagtcatttgacatttctatgtgattggaaattttaataatagaacattggggaaaaatcagtaataaggctctatgtgaggaagttaaagcacagtctctcaaataatctttctggcttaaaaatctcaactctgtttcttcctagctgtatgactccaggaaactcccttaacttcaattgggtcatttgctaaatagaaatagtgaatacgctcagcacaaatcttatttttcagtaagctcctagcaaacactgtgattatgatttcatagagtaaaggaagtgatgattgtgaatgaatgaccgtatgctgagggcctgctatgtgcctggtactggtcattttcaggagaatgaggcgattttgttttgcatcatgctgtgtcgtccttcggtagaaactttcatactggaggcggtgtaaggggtgtgattagcaaaactggagagtggcttcattaggtttgacagaatctctccctggcttcatggatcccccttgctgtagcatctcctttgaactccaagggccttcagaggagaggtggcatctgctttgttagacttggtagcattcccaagtcagtgttaatttagttgattcgtgaaaattgttccctttgcataaggctaggacatcttcttttctggagttattctgtttttagctttttggacaggtatcctgggaaattcttctagggtagcaagatctgccccctccccacagtcaaatcatgtttatgcattatgacagactgttccacctcctgctgggaggcaatgagaaagggtcaggaacctggaagaggctgcagctggatttaagggcaccagtgcttgaggacgaaggagagtatttcaggtaattctatagatgtattgtttacttctggatgtccatgttgctgaaaactaaagtagaaaatagagtaaaacactatgtgttcagggagtatcttagttcattctggctgccgtaaggaaataccagagactgggtggcctataaacaacagaaatttgtttctcatagctttaggggctgggaagtctaagaccaaggctgatgcagtgtctgaggcgagcctgctttctccttaacacatattgccttctagctgtgtcctcacgtggtagaagggatgagggaactctctggggtcccatttagaagggcactaatcccatgcaggaggtctctgcccccacctcccagtactatcacctgggggttaggatatcaacttatgaattttggggtacaagagacccaaacattcagaccatagcagagaatgtgggggtatagaaaaaacattagccatattagcaagctgtgtgtggataggaggaatagacttatatgctagctttccagctgtgatgatgcaatatgaatcttttttgtttgtttattttttgggatggagtctcactctgtaacccaggctggagtgcagtggtacaatctcagctcgctgcaacctctgcctccccggttccagcaattctcctgcctcagcctcccaagtagctgggattacaggcacctgccaccatgctcagctaattttgtttgtttgttttgagacagagtcttactctgtggcccaggctggagtgcagtggcacaatctcggctcgctgcaacctccacctccccggttccagctattcttctgcctcagtctcccgagtagctgggattataggcgtgtgctaccacgcccggctaatttttgtatttttagtagagacggggtttcaccatgttggccaggctggtctcgaactcctggcctcaagtgatccacctgccttggcctcccaaagtgctgggattacaggtgtgagccaccctgcccggcctgaaatatgaatcattagtgcaaatttcttgtaatgattggaatttcaaagggtatcctcctgtaggactgcttggttcatatgaaacaggacttgatttctgtgccacactaataccattggagaactacttaaaagctgccaaattttatttcagttttaccagatatggatgctagctcttaagtattttcctgtgctgtcttgggtggtataattccaaactcaagtcaaaaaattttgtattcttttactccaagaagtaaaatttataccagcttgttaattccctcatttcccatttataacacttggcctgacttcccccagtatgaattctagctcaagccaggcattgaaaaataagatgcagaaagtgccagaagagatttgaatgctcacatataatcagaaatgtcgttttgaaaacagtccaagaaagtaggttcaggttttatggcttctgtggttaggtgtagcacattgataatgagtgttccaattcacagggatttaagtggatacattcttatttgggagtggttctgtgggagagtgtaatggagggtagaatttgaagtaaatgtggatctctctggctgctggaactgaaattagttatctgagatatagtcaaacatgcaaattaaataacttggaagtattgcagggaagcaggtgggaaaaggaagaatgaaaaggagagaggaaaggagggaggagggagaaaggaagaaagcatgaggcagggaaggagagaaggaggaaaccaaagaaagtggcataaagagaaaaggaaatagctatttctcaggccttcacaacccttgaaagccaaatataaactcttccaagttcattgatactgctcagtttcatcctccaggatgtaatctaaagtcccctctgtgtttaacattcgagcaatagacttagatttcaaaaacaatgaatgcatcaagacaggcaataaaagagcaagacattgcaatttaaaactcagtgcaatttgaaagcagcataacagttatgctggacctcagtagatgtgtgtatcatgggaaagtggttctgagatctttcatctctcttggggtaggtcattcctggcttctgcttaactccagcatgtcattgaccactttacaaactttaaaattgaagacaaatgcctcctggattcctttttatggcaacaacatcaagctgttgtctggaattctgtatctctagcatttggaattatagcagatttaaagtatggaatatgtgtttctttgcaggatgggaggaggggagcgtatactttattattgttgctactaaataatgcttagtatgaatctcactgaccccttgaggaacttttataggagagttagcttacctggctgggggctgttttatctgagagttagcttacctggttgggagctgttttgagactggcatgataaaattattagagctcttaaaagtatttggggtaaaatatctaaatttaacaaagatgatcaatgtattttctatttatatgctgttcttgaacatagggaaataaactttaatctgtagaagttttctgaatatctgaaatagcaaatttgaatgatttatagtgcaggatcctggcatgatttgctgctttatttgaagtggtgctatagtgatttctagtttaaacagcaaaccatgaaagccaaacagaaataaatagaaaagcaaagtagcctttttttagttgtttttcactccatgtccttgctctccagtcccatcttcctagaagtctcacagctcttcctcatgacgttggccaagtactcttctctttatagctgtattggtccattctcacactgcttccctgagactagtaatttataaaggaaagaggtttaattgactcacagttccgcgtggctggggaggcctcaggaaacttacaatcatggtggaaggcgaaggggaagcaagcactttcttcacaagctgggaggagagaaagagagtgaagtggggagtgccacttttaaaccatcatatcttgtaagaacttacccactatcatgagaacagcatggaggaaatcatccccatgatccaatcacctcccactaggtccctcccttcacaacaggggattacaatttgagatgacatttgggtggggacacagagccaaaccatatcaatagttcttccgtcctttttccttctcagctttacttgacaccatttccccttcctaatttgcttcttaatgcttattataaattaaaaattttcagtaatttgtttgtgtctatttcttccagtcaattttaagtttacaaaaggcaatgaccatgacatttaaaaaaattttttgaattcccatagaataagtaagtgctcactaatattttaaaagggcaaaacattttcctgccactcccagttttcttgcgtgactctttaggaggtcatgttataaggtattcagccatgtgtccttaagatatcttctagaggcttcctcaaatataaacaccccgaccccatgtggtaaaatggtaaaggctgatacagaaatgagtatttaaatattcaagacaaactactatgaattaactgcccacatttaattcacagcttttaaactctttttatttttctgacacataattgcaaaataattaagtcaacatagaaaagatataatgttgtacccataatactactccctagccacttaaggtaacctcagttaatagtttggttgttgctcatttatttatttgtttttgagacagggtctcactcttttgcccacactagagtgcagtgacataatcatggctcactgcagccgcaacctcctgggctcaagggatcctcccacctcagcctcctgagtagcttggactacaggtatgccactatgccaggctaatttttgtactttttgtagagacagggtttcaccatgttgcccaggcttgtctcgaactcctgggctcaagcaacccacctgtctcagcctcccaaatcaacccacctgcctcggcctcacaaagtggcttacaggcatgagccaccacacccaaccttggttatttagattttattacgactatgtaactgtttacaggtgtattttttaaaaaatgctagtcattaaggtcagcttaaagcttagtttgtgcatgggcattttctgacatttacacttaaaaatatacttaatttatccagtagtcattccggagcaggttgttgaatttccatgtagttgtgtgattttgagtgagtttcttactcctgagttctaatttgattgcactgtggtctgagacactgttatgatttccattcttttgcatttgctgaggaatgttttacttccaattatgtggtcagttttggaataagtacaatgtggtggtgagaagaatgtatattctgttgattgggggtggagagttctgtagatgtctattaggtctgcttggtccaaagctgagttcaagtcctgaatatccttgttaattttctgtctcattgacctaatattgacagtgggatgttaaagtctcccactattattgtgtgggagtccaagtgtctttgtaggtctctaagcatttgctttatgcatctgggtgctcttgttttgggtgcatatatattgaggatggttagctcttcttgttgcattggtccctttatcattatgtaatgcccttctttgtctcttttgatctttgttagtttaaagtctgttttaccccagactaggattacaacccctgcttttgtttgctttccatttgcttggtaaatattcctccatccctttattttgagcctatttgcacgtgagacgggtctcctgaatacagcacactgatgggtcttgactctttatccagtgtgccagcctgtgtcttttaattggggcatttacctcatttacatttaaggttaatattgttttgtgtgaatttgatcctgttgttatgatgctagctggttattttgcccgttagttgatgcagtttcttcatagtgttgatggtctttacaatttggtatgtttttgcagtggctgttccgggtttttgctttccatatttagtgcttccttcaggagctcttgtaaggcaggcctggtggtaacaaaatctctcagcatttacttctctgtaaaggattttatttctccttcgtttatgaaacttagtttggctggatatgaaattctgggttgaaaattcttttctttaagaatgttgagggccgggcatggtggctcacgcctgtaatcccagcactttgggaggctgaggtgggtggatcacctgaggttgggagtttgagaccaacctgacctacatggagaaaccccgtctctactaaaaaatacaaaattagccaggtgtggtggtgcatgcctgtaatcccagctcagctacttgggaggctgaggcaggagaactgcttgaacccaggaggaggaggttgcagcgagccaagattgtaccattgcactccagcctgggcaacaagagcaaaactccgtctcaaaaaaaaaaaaagaaaaagaatgttgaatattggcctctctgttctagcttacagggtttctgcagagagatccactgttagtctgatgggcttctctttgtgggtaacccgacttttctctctggctgcccttaacattttttccttcatttcaaccttggtgaatctgacaattatgtgtcttggggttgctcttctcaaggagtatctttgtggtgttctctgtatttcttgaatttgaattttggcctgccttgctaggttggggaagtattcctggataacatcctgaagagtgttttccaacttggttccattctccctgtcagtttcaggtacaccaatcaaacgtaggtttggtctttttacgtagtcccatattttttggaggctttgtttgttgcttttcactcttttttctgtaatcttcattgagttgatcttcaatctctgatatcctttcttccacttgatcgatctagctattgatacttgtgtatccttcagctccattaggtcatttatgttcttctcaaaactggttattctagttagcaattcatctaaccttttctcaaggttcttagcttctttgcactgggttataacgtgcttctttagttcagaggagtttgttaatacccaccttctgaaacctacttctgtcaattcatcaaactcattcttcatccagtttttttcccttggtggcaaggagttgtgatcctttgaaggaaaagaggtgttctggtttttggaattttcagcctttttgtactggttcttccttatcttcgtggatttatctaactttggtctttgatgttggtcacctttggatgggatttctgagtggatgtccctgttgttgatgtttatactattcctttctgtttgttagtttttcttctaacagtcagtcccctctgctacagtctacatttctgctggaatttgctggcggtccactacagaacctgtttgcctgagtatcactagtggaggatgcagaacagcaaagactgctgtgtgttccttcctctggaagctttgtcccagaggggcaccccccagatgccagccggagctctcctgtatgaggtgtctgtcgacccctgctggaggtgtctcccagtaagggggcacagggatcagggacccactagaggaggcagtctgtcccttagcacagctccagcagtgtgctgggagatccactgctctattcagagccgggaggcaggaacttttaagtttgctgaagctgtgcccacagccgccccttctggcaggtgctctatcccagggagatgggagtttgatctataagtccctgactggggctgctgccttgctttcagagatgccctgcccagagaggaggaatctagacaggcagtctggctacagtgactttgccacgctgcggtgggctctgcccagtcagaacttccaagcagctttgtttatactactaggggaaaaccacctactcaagcctcagtaatggcagatgcccctcctcccaccaagcaccccaggtggacttcagactgatgtgctggcggtgtgaatttcaagccagtggataaataagttctttgaaaccaatgagaacaaagacacaacgtaccagaatttctgggacacagctaaggcagtgagtgtttagagagaaatttatagcactaaatgcccacaggagaaagcaagaaagagctaaaatcgacaccctaacatcacaattaaaagaactagagaagcaacagcaaacaaattcaaaagcaagcagaagacaagaaataactaagatcagagcagaactgaaggagatggagacacgaaaagcccttaaaaaaatcaatgaatccgggagctgttttttttgaaaaggctaacaaaatagatagtctgctagccagactaataaaaaaagagagaagaatcaaatagacacaataaaaaatgataaaggggatatcaccactgatcccacagaaatacaaactaaagtcagagaatactataaacacctctgtgcaaataaactagaaagtctggaagaaatggatgaattcctggtcacatacaccttcccatgactaaaccaggaagaacttgaatccctgaatataccaataacaagttctgaaattgaggcagtaattaatagcctaccaaccaaaaaaagcctaggacaagatggattcacagctgacttctgccgtaggtacaaagaggagctggtaccattccttctgaaactattccaaacaatagaaaaggagggactcgtccctaactcattttatgatgccagcatcatcctgataccaaaacctggcagagacacaacaaaaaaagaaaatttcaggccaacatccctgatgaacatcgatgctaaaatcctcaataaaatactggcaaaccgaattcagcagcacaacaaaaagcttatccaccacgatgaagtaggcttcatccctgggatgccaagctggttcaacatacacaaatcaattaacataatccatcacataaacagaaccaaagacaaaaaccacatgattatctcaatagatgcagaaaaggcctttgataaaaatcaacaccggttcgtgctaaaaactctcaataaactaggtattgatggaacatatctcaaaataataagatctgtttatgaaaaacccacagccaatatcatattgaatgggcaaaagcaggaagcatttcctttgaaaattggcacaagacaaggatgccctctctcaccactcctattcaacatagtattagaagatgtggccaggacaatcaggcaagggaaggaaataaaaggtattcaaataggaagagaggaagtcagattgtctctgtttgcagatgacatgattgtatatttagaaaaccccatcgtctctgcccaaaattcccttaagctgataaggaacttcagcgaagtctcaggatacaaagtcaatgtgcaaaaatcacaagcattcctatacaccattaatagacaaacaaagagccaaatcatgagtgaactcacattcacaattgctacaaagggaataaaatacctagatatacaactacaaggtttgtgaaggacctcttcaaggaggactacaaaccactgctcaaggaaataagagaggatacaaacaaatggaaaaacattccatgcttatggataggaagaatcaatattgtgaaaatggccatactgcccaaagtaatttatagattgaatgctatccccatgaagctaccattgactttcttcagagaattagtaaaaactactttaactttcatatggaaccaggaaagggcccctaaaacaaagacaatcctaagcaaaaagaacaaagctgaaggcatcactctacctgacttcaaactgcactacaaggctacaggaaccaaaacagcatggtactggtacgaaaacagagatatagaccaacagaggcctccgaaataacaccacacatctacaaccatctgatttttgacaaacctgacaaatacaaacaatggggaaagaattccctcttcctaaagggtgttgggaaaattggtaagccatatgcagaaaactgaaactggaccccttccttacgccttacacaaaaattaactcaagatggagtaaagacttaaacataagacctaaaacgatcaaaaccctacaagaaagcctaggcaataccattcaggacataggcatgggcagagacttcatgactaaaacgccaaagcaatagcaacaaaagccaaaattgaaaaatgggctctaattaaactaaagagcttctgtacagcaaaagaaactaccatccgagtgaacaggcagcctacagagtgggagaacattttttgcagtctatccatctgacaaagggctaatatccagaatctgcaaggaacttaaacaaatttacaagaaagaagaaaacaaacccatcaaaaagtgggtgaaggatatgaacagacacttctcaaaagaagatgtttatgtggccaacaaacatgaaaaaaagcttatcatcactggtctttagagaaatgcaaatcaaaaccacaatgagatatcatctcacgccagttagaatggcaaccattaaaaagtcaggaaataatagatgctggagaggatgtggagaaataggaacacttctacactgttgatgggagtgtaaattagttcaaccattgtagaagagagtgtggcgattcctcaaggatctagaactagaaattgccatttgaccaagcaatcccattactgggcgtatacccaaaggattataaatcattctactatatagacacatgcacacgtatgtttatttcggcactgtgcacaatagcaaagacttggaaccaacccaaatgcccatcagtgataggctgaataaagaaaatgtggcacatataaattatggaatactatgcagccataaaaaaggatgagttcatgtccttttcagggacatggatgaagctggaaacaatcattctcagcaaagtaacacaggaacagtaaaccacacagtgcatgtactcactcataagtgggagttgagcaatgagaacacatggacacagggaggggaacatcacacactggggcctgtcggtgggttgggggtaggggagggtctgagaggggaacggatttaaataacagaaaattaggagaaatatctaaggtagatgactggttgatgggtgcagcaaaccaccattgctcatgtatacctatgtaacaaaccagcaggctctgcatatatatcccagaacctaaagtataattttaaaaagtatacttaattattgttaatgactgtacatatggtgttttattgtttcattatttggatacataaaatttattttcccaatagtgtccaaatgttggtggacatttggattatttctagttttttcactattataactacattgcaatgaaaatctttagttctcttgtcaattttcatggaagtaggattgcgctatcaaaggattttctgtgagccctaagcagatggccctcctaattgccttcaaagattccaggtactttttaactgttgtgcatttttcagctgtatgaaataagttgcccagcctgaatccttgatttgtactgggctcaggagtctgtgagagggagtttgatttcagtctgcattggctgtctggagaatgagttcctctaaagagcagaacaggttggagaggtgaagggttcctgatggatgatgtgtctaaatgagaagaagacgactgggcagcagggcttggtgatttgcaggcacagaggtctcaggtttagtgtgaaaactggcaggagtatggtccagagaccataggcagtgaatgatggcagtgaacagacagcagggcaaagattctggacagtagttgtgattgcctgtgagggcgcctatcaccaatggaggagggtctgagagaggaacagatttaaataacagaaaataaggaaaatacaagatttctattcaagaaggtagatgatctctgaaattagtaatattgctgtaaaagtgaaacgaacatctttaaatataggtgcagccagacagtgtatatattgcatacattttaaatttcatggtcattccaattggctctgaaaatgaaaccttcatgagtttatgttccaccagcaggatatgagtgtgtgcacaccaagagctgttctggctgttgccaccttttgttcttcccttcctcatcactggttatggtcgacgagagaatccccttaatgtcaagtagccttcaataatatgcaactaaaggagaggtggattctcaagcaactcagaaacgtttcagagctgttcattttcaacccgcaacacttgtgggctctgctgtcagatgttatagctatcaggtgtgatgacttgtactgtgtcaccttgtttagctggaactgcgttttccagaatccccttccctgtgtagttttgggtttgagttgactaaaagaggagtttgcacagaatttgtgattactccctgcagttcattgtgattaggtagtgacagacagatgtggagatgttagcaagaggctccagccttttcttgctcttctctgcattgtgtccagctgtttgtcccaagtgctgatcctgctgagccatatggacccaggcccatcctgagatgcttggtgtcttagtctatttagtgttgctgtaaaagagtacctgaggatgggtaattcatttatttatttatttttaaatttaattttcttttaagttccaggtaatctattcataagggatcgtctcccgtgacccaagcacctcccattaggcctgtcctccaacactggaggtcagatttcaacgagagattttgtggggacaagcatccaaactgtagcacttggcagcaagtcccaagtccttttccccagctcctcctttgccatccacttctccatctggaggtgctgattcctctgcttggctggctggggactcctaggaccctccaacctcacttttagacgtgccttttctcagctcctcttgtaagtgtgcaagcttcgattcctataataaatcccttgtctataagtcatagtagttctgcctccttaattgaaccctggctgactcacatctttcgtttgaaaatcagggggagacatgatttttttatagctagttttccttaacttcctttaaatacatacacataatacagtagaaatacttttggctttcataaatgcttttcatcttccatgactgtttccagcacctcttgaaattacaagtgttacacaggtatttttactgtcaatgtatatcataataggattgctttgtcctgtaattaatcagtagagatttcttctggaagtttgttcttttgaagaaacttgtatttttctgaaaaactgtcatttcttcaagtggcttcatttgcaaaagatttgtttaatgtcctgtggtttcattcttacaatgttagaaattctttaattagttacaggtgttgaatgatgtcacatgggcattttttttttttttttttttttttttttttgccatcagtgttagggagttctgtcctaaggcttttttgtagaaatatatcttttaatataattgacacaatgtaagattggcttactagtattaaactacatgaaaagagcaagattgtatcttttactgagaatagtaagatgttacaactgaattgggtttttctagagataatttttatttacctttaaaaattttatcaccaacaaaatgtgtattaacggttatgaaagcagtaagtaagattagtgacaagatcagaggagtagcctaatttatattacagattttaatgtggcccataatatagtaataaatatacaatatttttaagcatatggcaaatatgaaaaaactgtgatttaataaactttaatttaggaatttttatagggactaaaattaaaattattccgtcgaaagcataaatacattttttgttaagatattatcatttttaaataatcaaactcttcaaaatggctttatcatgcccccacagtatccaaagaaaggattttttttcataatagggaatcatattcaaagggaagttttagatttaaaacttacatgaaagccttatcagtcaagaatttcttgatttgaaataatatctccctggataacttcctatttgtatcataaaatccttgtcctggagatggttctatttctgtcttgtacttatacttgaaagtggctgttttagacatacacgattcaaatctctgatgggcagcagtctactggagagccatgtatctccagtctcattcagtcaaatgatgtgaccaatggtgaaatggtttattctaatgtgctgtgtgtttgaaactctctgtcccaaatttgaaaagtccatgtcagacatgttgaaagctgaaataattatttcagtctcaaagatgccttttgacatatggagaattattacagtatcatcttattcccattgacccagttacaacttgaggaaatatgtgtcattctataggtgatatcatagtaatgattgaagattggtaactctctatttttatgtttgggttctgaagtcgtaacgcaaacatagaagtgagctcatttcctttgagaaattggcaccaaggcctctaacttatctctatataattgtatattctttattaaagttcatctttacacaataccttttgactcttctcttgccttccactttgccttctccttgccttctggtaataggtaaatctgaaattctgaaatacaatttaactttctcaattaggaattctatcaactctcagggaaggtgattgccatgctacatattacacgatgcagttgtgctgagaactggatattccaattttgctccagtcagtgaaccacagaaatcagtttctgcaagtccaatattattgactccaaatagatgatcattgtagtagtcatctcattgcagtatcagtgatacatttagcatttaggaaagtattataatttagaaaagagcaatgctgaataaaaaccagctcagtaacacaaatagttgactcatcactgaactgtttttaaaaaatagttgaaaataacttacttttgtcaatatatttgattaacatttcagacatttactatgattcctattatggctctgaaatatgtcttgtgagcattactttgtgtaaatatgttttcagaaagccatctctaagaaaattaagtgaaccacattttacaaagcttgcttaattaaaaatgtgtattctatttagattatgcttttcttaatgatttgatttttttccctttagacctactgcttccaagaatgtttattatctagcatgtgactattggggatctataaaaattgctataaaactgcattataattagaataacacttgtggtaaagaatgaaaagaaaatatttgtaaaagcattgttataattcagctgatagactaaaaaaagaccacagagtaaggttttgcttagactttttaaatcgctctaaatattgttctcttaagtgatactgtgtttgagagtcttacatatttataagtttgtcagatatgtcttacagtgttttctactaaaatatatgtaaattctaataaactggttcctattaaactgagtgaaaacctaaccatgagtactggttattttcagaaactcactaagaaaggaacaaaatttagtgaagacgttgcatacttaggctactgcgtataaaaatagcaattaagagcaaagactttggagttatccagacccaagttataccaactcagagtccaataatataattatcaatgtctaggttgttgtctacttctatataaaatctattttatgcctgtaatcctagcactttgggaggctgaggtgggcagattgcctgagctcaggagtttgagaccagctggagcaacatgggaaacctcatctctgctaaaaatacaaaaaattagctgggcatggtggcatgtgcctgtaaccccagctactcagaaggctgaggcaggagaaccgcttgaacccgggaggcagaggttgcagtgggccaagatcacaccactgcactccagcctgggtgacaaagtgagactctgtctaaaacaaaaaacaaaaataaaaccccaactcatattagagttaattttttcctctgtccttttagcttgtttttctaaaggatggttaagtcgtcttattcagacaaaaattgcatttcatatatgggatttttttttcttttctaataccgttcaggattggggcaagaggcaatgttaaataaaaacagaaatttgagttttgggagagatcagatctttaaataaatagaaacagtgacatttagtacatgtgaatcaatttggtaaatactgaatgaagagacgagttactgttgagtgggatttgtcatcttaattttcagcaccttgagtaaataagccttgaattaaattacttcatgagagtttttctcaagatgagaaaaacttgctttactttgggctgctgacttgctgacttactatattgatttagcacttgagatgtaatcagaagagatgattttagtgaactcatttttggcctggggtgtatgttgcagatgtgcgtaggttgttgtctttttctatttgtcctgatctctggtttcatagtctctgaactggttgcttgttctaccaacactgttttgcatggaatactttgactggaggtcaaatggcgacacgtttaattgacaacacttcattgaggatacaactctttctgtgtcttgatggttagtgactaaagctgatctaatcaagcctatgtagtgccaattaacaatgcccaattaggtattctctctggctttcaagttttgctgctggaaagctcagagaggaaagcatctcttcaggatgacaaggatatgaaaaatgataatggcaatggaatgccagttatgtaaagaatttgaagtgatcacaattaaaaatttgagtagacagcaaaaagtattttttccacttgatgtcttccaaagaaaaacaggaaatgtcttcctgtgtgccattttttcttaattgctgaaaattattataatgttgatagctatcatattttgactttaaaaaaatgtgccaggcactttactgtatttcatttattcttcacatcatccttacactgtagacttctttaatatgactactttacagaagggcatgctacttttacctttctgaatctcagttgtttcttctctacaaagaaagtgataggtagagttggagattttaaccaggtctgtttaactccaatatccttgctcttactactgttcttgcagtaagctaaatatgcaatgtattcattttacttggttgctttccttgtgagtttctgacaattaatttgtcttctactcagcttgatggaaaccagtttattataagacagggcttgaccaatgttgtgatggttcgtatccagggcagaaattattgccagagggtacacaggacagccttctaagaaaaaactgtgtttgcttctgagaagaaggtgggcttcagctttctgagtgtaagcaaatataggagacaagaagactaaccaatgaaggcagtgaaggagcctcaatggtgtgacatcagctggctgaatgccttctgtaaaatacttctgtagctccccattgccttgatgataaaaccttccacagctctttccgtttgaacctttacctgcttgcctgtgggtaacaatgatgatgacagtgacagtaatagctgaaataaccaaacttaatggagcgcttgttagttttttggtttagccatctctgtaatgattcctttcattctttacaatatacaaaggtaataaatgaactaactggtcgaggcaatagtttttaattaatcacaagttttcaggctctgggataaagcattcatgtgtgttcatttaatttttaaaacaacccttgtcatcatttcacagttgaataaaccgagtttcagagacattaagtaacttgcctaatgtcacacagctgggtgagggatgaaggccagattgaaacctgggtttgcagattctaaatctggtatactgaaccagaatactctcatggccttataggggatcagctgggttctgtgattttaaataaagatgactcacaaacagaggatatcagctgtggtctgcagttgtgtgctatttggtttattaaacatatttgatttggaggcagttttttgtttgttgttgttttgttttgttttggtggttggggaggggagctaccctgtttgctaaaggccccatttgtcactgggctacttcatgcacccaacttccctgcaagggaagatatttgtgttaataactctcgtctaaaaagtcaagattagagagttctttcattcgtggagtgtgatgagaaacaaagattccacaaccactttcccccaggatattttgttaccttgccaatgattttaaaatattgcttgcttttagttttaatccatttcctcctccctttcccaaccctatcagtatatagaacaactgctcagaaaactgttggtttccaataatgcagttattaactatgacctttgtgtcttgtctttaaaccttcccccgcataatccagtcttccctttgacatctctgatggttagctcctcttactggccaactggtgcctctgccacatgggagtgccattacacagtaaaattaatacctccttccaggatttatttagcttcttctgacacactcaaaagagcaagggaacacatgtcttgctttcccttgggaaggtcaagtattagatgattaaactggtaggaagcatttgaatatcctcagtaaacaagctttgtatttaggctcatagatgtttttttgaagttcttcattgcatttattttcaaagttagtttgagagagcttttaccagttacttggaagttatgtgccattattgctttccttattgcttaaaaaacaaaaaaagaatttaaaatcagctaccaactctggatttttctttttcagatgcaaaagaaattgttttaaaagcccagatcttagctggaggaagaggaaaaggtgtcttcaatagtggtttgaaaggaggtgttcatttaacaaaagagtaagtctggaggttgttattccttgtcttttggccaagcagttatggaagatcttgctcaagattgaaaggcacactgaggttggttgtggtggggttggagcgggccaaagcaactagaagaaactgaaatcataggtagagggctctggcagtgccctagttttccttctgcccccacaaaatgatttttcttactaattggtgaaaacttgacagtccttctgtcctaaacaatcaatgattcatcataaatgttggaaatgataccacttccaactgaaatgctacttccataatgtcactcctctattcaaggacctgaagggactccccattaccagtggcatctggggtacctcccctctgatagtccaagccttcctttatttgagcctgtcttttcaacttcatctcctgcatctcctagcactgaacactttcctctcctccctgttcctgtcacacacctttttactatttactttgatctttaccctcttcctttccctctcattgttcaatatctccccagttttccactgtcggatcttcagtcaacccttatctgaatctggtgtgcatttcagcattctctctttactatgactgtaacttttttgggtgaagaggtcacaaagcatcttttgtttcatttattcattcatgaactcacttttattttgctctcagtgagcctctagtacagtgctaaacacgcagcacataagcagaaagactcatggattttgtgagggtgaaggtgaaccctttgcagtgtagacatgaggctctgtgtaaggactctcatttaaatgattttcaacaaacattcattttctgcttgttttctctttctcttagccctaatgttgtgggacagctggctaaacagatgattgggtacaatctagcgacaaaacaaactccaaaagaaggtgtgaaagttaacaaggtaatatggatactttgggtcattttctatatatgtgttaaaaaatagaaaagaaaaccatccttcagtttttgacagaatctaatgaagtactgctctttggcagtgtgccattttattttttaaagctcatctaatctgtttagtaagtagtatgtcttggaggagaaataaaaagggctctatgatagtaatattatttattatcattagcatttagcaaaaagtgggtgagggtgagtgaccgagcaatggctttccctctgagaacacagatgcattctatttagttgagaagcgcttgctgtgacagccttatactcagtgagggacattcgctgctcccacacagtggccctcaaccccaggcgtgtctgtcagaattacctattgtggttgtttttctaaatgccccattccttattttaggatgactgtaattttgagccatttttattgctgggggtatattgcattaggaaggtcagctgaagtacccaagtatgtatagcatgtggacacacacccctcatccacacatagaaaataaagcccagaggaaagtggcctgcctcagtcatgaaattgtgagtggtagagctgagaccagaacctaactctccctcctgccaatctacctttcaccatcccttttgtgtatccagacactagaactagctacctgggttgcagaatccagtgccaaataaaaaggcagggacccgtgttaaaatttcaagacagctatagctaaacattaaatccctttacaactacacagatcacatgtgtcagccctgaaaagcatccatggttagaagatcctgtcctaacagcgaattagggtcctgcattttggggtggcagctgtctgctctgttgacatagcgtcacagatcagtggtctctaccaatgcaccatgctgcaggacactgcagtggtgacatcctgtttttacttttcagggagagttttgtggaaaactcttaagttgttgtatttatcagtatttagttccattttcttttgttaatttttgtgggtacatagtaggtgtatatatttataaggtacatgagatgttttgatataggcatacaatgtgtaataatcccgttacagtcctttttcttgctatgtagcaatctatgatatggatgtacctaccacagtttgtttaaccatcatctgttgaaagacatctgggttggttcgtttttggctattacaaataaagccactctagacattcatgaacaggtttttggtataaatataaatcttcattttgggggataattgttgggttatgtggaagttgtataattagtttttttaagaaactgatgaatgttttccagcatggctgttccattttacattgccatcagcaatgtgtaagtggtcagggttctccacattctagcccgcatttggtggtggtggtattattttagccattcttatgggtgtgtagtgatatttcattgtgattttaatttgcatttccctaatggctaaagatgttgaacatcttttcatgtgcttatttgccatctgtagattgtggttggtgaattgtctgttcatggatgctatggtctgaatgctccctccaaaatgcatgttgaaatttaatccccattgtggtttgcattaagaggcagagccttttgggaagtgattagtcatgaaggctctgccctcatgaatggattagtgcaggcttgtccaacccacggcccacaggccacaggcatcccaggatggctttgaaagtggcccaagacaaatttgtaacctttctaaacattatgagattttttttgcaattttagtttcttagctcagctattgttagtgttagtgtattttatgtgcggcccaagacaatccttcttatgccattgtggcccagggaagccaaaatattggacatccctggtagtgctttataaaagggctgaagggaactagcttagacctgttttgcatttccactttctgccatgtgaggatgaagcaagaaaggccatatcactaaatggcggtgcactgatcttggacttcccagcctccagaactgtgaaacaatatatttttgtcctttataaatgaccaaatctcaggtattttgtaacagcagcatgaagagacaaagcaaatttcttttggccattttctaattagattatgtttttactattgagttttgagttattctaggtactagtccactgttggatatgtgctttgtaagtattatctgttacactatataacgtatatattcattttttcaacagggtcatttgcagggcaaaagtgtttaattttgatgaagtccaatacgtcaatatttcctttatggattatacctttttagtatcaggtctaagtcctctttacgttgccctacataataaaaattttctcatgtttttttctagatgttttatagttttatgttttatatttaggtttgtgatccattttgagttgacttttgaataagttgtgagacttaggtcaaggttattttttaaggggcaaaagggctatgatattcaattactcctgcaccattttttgaaaaggcttatcttttctccattgaattgcttttacatctttgtcaaaattcagctgggcatatttctttgggtctgttttggggttctctgttttgttccattgatctttgtggctgtcccgccaccaatatcacagagtcttaattactgtatttatataaattctgaaattgagtagaataactcttgtcactttattcttcttttccaaaacagttttacctgttctagttcctatacctttttatgtacaatctagaacaattttatctttacgaaaaaatcttgctaagattttgataggaatcttattaaacctgtatatgaatttggagggaattggttttttgttatgttaagccttgcaacccatgagtatgatatgtctctccttcttttaggtctcctttgatttatttcatcagcattgtattgttttcagcatatacgtttggtatatgttttgtcagtcttacacatacattgttctcttttaaagcaattacaagtggcattggattcttaatttcagtgtccaacatgctcattgttaattggtgttgatttctttttaaatgcttggtgaagttccctagtgaaaccatgtgagcctggagatttatttgtctgtgcctgttaatgtttttgggttgctggcttctctagcacccagcaccctgcctgagatttatgaggccaaagaaaacataggagactcactaccatacgcttccttggacctcaagctccctagctagtctcccttcttctctataactttcagagtcaccttaagttttatgtatatatatgtccaaggcttttatttgtacttagcgggaagaatagggaaaaacatgtctactccatcttctcaaaagtataagtccccagattatagaaccttttgattctaaatttatttcagaagctatttaaacacatacacacatttatacacatcagatatttgttttctaagtctgtgccaatgtgttatgtattcctggggctagtactagggcctgtgagacagtgctactcatcatgcggtccaggattcagtaccaatagtggttactgctctgtaatcaatttaaaattcgagaatgtacttttaatcttctctgttcatgggtgtgttacaaatagtttgtacgctagcactcatctcctgaccacaattccagtagcatgatatttttaaggaaacagattcagcagtagataggtcaaagaaagttaaaaagctttctatactggtggactccacaaagacgatgtgtcaacatattctttgtgtaactcacaggtgaagctcttttgaaatgtttctaatggagttgctccgggatgagtgtttgtggattccatttagatttctctgtaacacttcctaatatactctgtcatcctcggtcatttggaaggcatgacgatgtcaacaaactggtctttgttgtataaaatttcttgaattatctcttgataattatcattttcctggtgacattttcttaaagagtcatgcattattcctgtgaagcaagagctgtttcagacagtagctgggcttcacaaatagaaatttggtggaatacagagcacgtctgtcaacatttttgaagattaagaataggactcttgaatgacacttatcctaaaaagttataattttgtgttgcctctaagaataactactgaaagtcattaagtattattctctaaactaactctgcattagaaaatgaacagtattatgccagtagacctgaaagcatataccaaacacactcctcattttgtattttgtgccaatcaaatttcttaaaacagctttctcttctagagaaagttttagaagaaatgattatcttaatttcttaaaatgtttgtattaatgttgatgcttagaaaggcagactttatgttatttctataaacgacaagttgttactgtattttataaggaaagaatagggctaagtatttttgcttcaaatattgtcctacccctcaatcagaaattctgaaagaatttacggtttcaagcaacctgaagactgggagaattaggcactgactgatggtttgaccttcattgttggtgagaacaaccaacttgaaatcagaatggttctgtgctaattctaacaccatgtgctgagaaacagtttttatatacttatgaacttccatttctgataaatcaatatgaagacctatatattttatttttaactaatggtaaattcaacaaaagtttgaaaaagaggagttctatattcattccattatagctttttagatcattatatatttatcccatttcatgtgacctaaaacttaagtgtttttgtggtatctgagtagttaaaatctaatgctacttaatctgtaacttttttttgtggaacccatcactaaactacttgtaaaaaaagcaatgtggccgggtgcgttggctcacacttgtaatccgagcactttggaggcggaggtgggcgaatcacgaggtcaggagattgagaccatggtgaaaccccgtctctactaaaaatacaaaacaattaggccaggcacggtggctcatgcctgtaatcccagcactttgggaggccgaggcgggcggatcacgaggtcaggagattgagaccatctggctaacatggtgaaaccccgtctccactaaaaaatacaaaaaaattagccgggtgtggtggcgggcacctgtagtcccagctacttgggaggctgaggcaggagaatggcgtaaatctggtaggcagagcttgcagtgagccgagatcgcgccactgcactccagcctgggcgacagagcgagactctgtctcaacaaaaaaaaaaaaaaaaagaaagaaaagcaatgttagtgctttcattgttttcacatctattactgattatttatgggattgtttttatattctttaaacatccaagatatctttcactgttcttgttaggtgcgtaagttggaacaacctctctcaagcactttgacagtacttatcaacattttaaatattcacagtttaaaacctagacatttcacttttaggatacttatctacagggatactaaaagaaatgaacaaagatacatgtacaaaaatactcactaaagtagcattttaggaaaattgaagttcatgtaaatgtctgtcagcaggccaggcaccatgactcatgcctgtaatcccaacactttgggaatcttaggcgagtgtattgcttgagtccaggagtttgagatcagcctgggcaacatagcaagaccccatctctacaaaaaataaagcaaaaattaagtggctatggaggcacgtgcctgtagtttcagctactcaggagattcgtttgaacctgggaggtcaaggctgcagtgagccacgattgtgccattgcactccagcctgagagcaacacagcaagaccatctcaaaatgaataaacaaataaataaatagataaataaataaataaatgcaggaacatggttaaataaatattgtcatataaataccatgtaatcacaatgaagagagaagaccttagaaagatatttaagttgtagtattaagattttaaaaaagaggccaggcgtggtggcttacctctgtaatcccagcagtttggtaggctgaggcaggtagatacttgaagtcagcagttcaagaccagcctggccaacatggtgaatccccatctctactaaaaatacaaaaattagccaagcatggtggcaggcacctgtaagcccagctactcgggaggctgaagcatgagaattgcttgaacatgggaggcagaggttgcagggaggcagaggttgtagggagctgagatcgtgccactgcactacagcctcagtgacagagtgagactctgtctttttttaaaaaaaaaaaagattaaaaaaaagaaaggcatcctgttgtatataatgtgcttccacatgtaggattattccattactgcaatgcttgcagatacatagaaaaggactagaatgtcagcagtggtttttcctggtggggctgttacatgaaattcaagtcctacagagcaaaaggacacctggctgaggcagtgagtccccactcacttgtggaattgaatgacattcttccatcccacttgtcccctgtctagtcatggccctggcaaatgaccacatattcccagaggaaggggtgcctttttctagttatcacggaggttcctggtaggctcgtatctgccctgactcctggggcccgagggtttatttgaggtagagctgtgcagcaggaagctgctttcactttctcatttatatatttttggtatcgtttgcattatttttgaacaagcaaatattctttttataaattaaaaggaagtataaaatgaagtaaaatatagtgatcgaagagacagaaatacacaaacatatgaagcatcagacatactgtaaaagaatccgtctgtggcaatcatgcttggttttccaccagtgaaatctgagaaaagtcagtgtagtaatatatatgtgtactgttaatatctcaaattaaaataacagccacttctctagggtatttcttaagtgacacagtttcttgaggaaggacaaaaaagaagattaaagtgggaaggttccttgaggcaaacgaaatacctgtcactcgaacaagttaatgggatcaaaattaaggaggtgaaaatgggcattgtgtgcaccatgagagcagaactctcaaagctctgcaaactcactccctgggctgtaagagcctgaaaatgaagccatttgattcgtgtagcaagtttgtatagatttccaagtagaaatcagcttaatgctgaattaatttgactttcccactaatgtggtaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggtatgtttaaattccgggctacctgctattaattgattgttattgtagaagctgttaaatatttaatggggagtctaaggccaggagcactaaatctgtctctacaatttaaggtaagaagatgctgagccctttttctttctgggtatccagttgaaagttgggtggaatcaaggtattcagtgttcaaggactttttatctttgcttttcccacccttccttctttacttcttcctgccttttcttcctccctgattcctttccatccaatcttcctcaagaattaaccaatgggagaggactgctatattttcatttcttatggttaactctctttcatttaatattatatatgatccggaaattctctcctaggagatgaatgaattctcttttagcagatgtgaactagaaactgtcttgagttctctcagtactcttgatgtaaactagaatctttatgaagtctagattctatcagtttttttcaatccttgaaatcttgactcatttattgatattaagattagtttcaagtcagagatctgaggtcaaatttaatcagagcacaagtttctcaaagtctccaaacctcatttttaaatcagtaaaatgaacatggggtgatttctaccatgtgagattataaggattaaatgaggtgatgtgtataaagtgcttcttaacctacgtcagctatgaggagaaaaacataagttttcagaactaaaattgaagtttttaatctgggttcttggggtcaaaattacattacaattttccaccagaaacattcattatttcttttagaaaatgatttttttgtttccctttgagaaggggagattttatttcttaaatctctttgtctaaataatgtacaataaacacccacttagcatcctcaacaggttcttggaaactgcgacttgaatggaaacgatgtataaggaaaccaatgttaccatacataggctaattgatataaacaagagttaagttcctatagcatatttctgctcacagaacatcactcaactcctaaataaagaccagcacacttctaatgttacacattaaaataaataggagctatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttctcaaccttataacaaaacgaccttgaatgaagtaacgttatttgaagacctgctgtactcatactgcagtgattggttttaaaatattttcactaatattatataataagttaattaccttggaaactgaattgagactttatatgcagacttaccaacaacacctagctgttttcaaagttcacattatttaaagcaggccattccatttgttaagagaatgcatgaaataatgtatagtgacagtgctcggtgtctttgagacaatatcattttgtagagctaaggtaacagtaataattatcatcaatagagtgtttaaatcataaggtaatatttaacctatctatgacaggctttaaacttaactactagtaggcaggaaaaccttactttggaaaccttccaaaagatgtcaaaaaattaactgactaaatattcatcaatgccatctgtatagtaattaaaagtgaaaactggcatcagattttcttgtcagcatgccaccatgaagaattatatagtttttggaagggcttttttatagatggtctgctaattaaaacataccctacaggcatctgcggtagccctgctcagagatctctggatagatgccacactttaattactcatttgcaaataaatactaagcattttcttttgaggttgtaaatcttctcagttgactgtctgaattttgtttatttgatttatttttactaggagcaaattgacatttttgaaggaataaaggacagccaagctcagcggatggccgaaaatctaggcttcgttgggcctttgaaaagccaggtatataagccattgggggatggtgtgtctgacttgtttcagaaaacatttgggaacttgcttcattgcctctagtgtttgtgattaccaggaaacaggattatttattgttttataattttttcctccagctgtttatgatgaagaaaaatatttccctgatgttttaaaagaggatgtttatgatgtgtctttgaatgtgttttggtatgtgtgtgcatgtgtattgcatgtggacacatacacttcatgatagatggtaatctctattttttctgtagcattgctggtacttagccacctggcaggcatgtgatacagctcattcgaactttagtttcatcatctataaaatgggaatgatgacaactcccgagaggcttattgtggggattcagtagaataatgtgtaaaagtccttattgtactgctccataaaggtctgttcttaatggtattaatattaataatacatgttatttagctaattgctattctttcatagctaatgggcatttgaaatgaatattgatggcataaacttgatattttattgagaacagcttaaaatatgccaattttgtaataatatcccttggcttcaaagaccaaaacattggcctcagagctgttgagggacagaatctgtcttagtatcgtcccctgctctgcctttgttccagcccatggcacctgattatgtgtctagtggggcaagcttcctagtcccacagctaaatcagataaacttacttgttccttcctctgttactcagagaggccaccttaatggccctagattgtgtgtatgtgtgcatgtgtgtatgttctctggcctggggctttatgaaaaggttacagagtatgtcctttaatttggttgggcagcactattcccataagacagtacatgatgcactcttttctttctgtcttgtctttttcttttgattgactctctctggaagtttaatggcaacagtaggcaagtcaaagagggataaaacagaataaggttttaaaaaatatatatgcttaaatgaagggaaaccacttacttgaaaatgaataaaggctcactttgaaagcaaaagattgaagatggtagaatggaacagggtcatctggaactaaacctcaggatgagagagaaagggccaggattcgatggacagttagaggaactaattgccatttctgagactagcaaagagatgccaggaaagtgatctgttgaaaggaagatcctggaagattcctgaatatgtgctacagtggttggtttcacctcctgagaatgaggataccagctacattagccattcatttgatgtttattaaggggcttctcctgtagcagtggtggtcaccaagagcccgttttccatacagccactgtggtctagctgcactgtctggcagtcagctccagagttgcacagtgaccctgtctgcctcctccatatcactttggacatctgtatatttctcttatttatttgcagtcacctttgctagatcctaatctttaccacggcagggactttgtccatcctactcactgctgtgttgccagcagctggcaaagtgcttggcatctatttttattgcccaagaaacatttgtcatgtgcatgactaggtgaaacaacacttctaggtgtccactttgaagaagttcctagaggctcagcaataggtggcttttcatggcagataaataaatctggagtgggcaaaatctgctgaccacatatttaaaagctcaggaggtgaacataatagagagttctagagaagttaataacagtataatgtacatcacaagatactgccccctcactacatattatacgagaaaattaagagttatttacagctcttaaatggcttattcttgttttcctggtacctgaaacactctaggttttaaatgagttacctatggaaggaagacgaatatgtgagaactgagggataagtaagtggccatattgtcagtatacctttgaattaatttatcgaggaaaggaaataaaatgttttaatttgtttttttcttttttcactgctaactccatgaaaggctttaaatcttcattttctcagcagcttggaatgagcactgatagggtgctgctcagtctgctgtgccttggggaaaagagacaatgaaaaataaccattgttcctcaggggctcacagaccggtagatatctgcctgctggctgagaggatacaggaagagggacggataaaggaatgtgaaggagagagtgggggagggggcagcgggcagagggagagagaggttgatctcagctgtagacatgttggaagttgttcatctagggacacctgagtgtatttctacagtagaagggatatatggcttgggatcccagggaaagctgtgcattagagttgtaggcttgggaatctctgctttatggggcttgctcaagctgtggggattagtgaaatgctctagagggccagtgtacaatgagcagatgggacagtgtagaagggaaaacatttaaacaatcatcaatgatcttttcctaaggaaatagtatcttagaggtaccttaggttcaacgtgactttgaaagttaagttacttaattttcatctaggatgtggtttaggcatttggaggtacctcactcatggttgaatatcatataaaatgatagtcttataaaattattaatatctttcctgtgactcatgcctgttgtctctaaaatgtgatgaatattagacataacaaaaataaagatgatactttgctttacataaaaattaccagtgtttgttcccaaccaaagtctctttctgtgagaatttgttgaaaaacgttaagacataggaaagcttaatatagtagttcccccttatctgtggaggatacgtcccaagacttccagtggatgcctgaagcttacctactaccaaaccctatatatactctttttttctggatattctagatatttatacttaggataaattttgacttataaattaggtacagtaagatattaacaacagtatgaaatagaacaatagcaatatactgtaataaaagtgatgtgaatatggtctctttctcaaaatacctcattgtactgtactcacccttcttgcgatgatgtgagatgatgcaatgtctacatggtaagacgtggggtgagtgatgtgagcattgcgatgtagcattgggcttctcatgacctcctggcaatacttcgtgagggacatctactttggatgatcctggatcatcaaaccatgggtgtcaatggctggatgtcaggaacagatgatgtcaatggtcagggatcctggatagctgaaggtttttcaccacaaccttttagaagaacatcataattagaagtttgtctctttctttttaggtcatctaagtgtggctgtagaggttgtaatccgtcagtgactttagtgctgtgttccatccaaggatcttattccataattttgtcctttccatttaataacttggacctcagtagaccatgggtaactaaaaccacagaaagggaaactgaggataaagggtgactattgtatgactgaaacttacaagtttgtcaagtgtgtcttaattatcatctatactgttcatttctgaaaacatgagtgccacgaattgtcaacatgtgcctctaaggtttaggctgatgaaaagatcggatggtccaagtcagtgcaagatcactaacacctcttgaagtggtttgtacttctggctagatttgagaggcgtacgtgaatattgatgataatttctggaatgcaagaaaaatatttaaaattcttaacctgttgagatttttgtttgattaatagacgatttatttcagcaagaatacacatagtcatcattgccagacttaatatgagatgttaaatgtttgatccaattttccttcctggataagtttttctttcctattcctgtcagttttgaatacatcataccagaagaacaggtgcctaattccacacaaagctcccaagagtgagtttttaggggtgaaattaggatagacatttgctgatcttgcataggtccaacaaatcaaggcaggatcttcaatgagccgtcagcagttagggtcgttgtactgaagcaagtactgctgtttcagctgtgctcttatggccaaccgctcggcttgcgcctgctgggtttccagggatatgtcgtattccgctgggtagagggtcgagggtggagtggccaggcgcgatggagtatactttgggaatggcatcttggcgatgcagcgcacaactgtgcctgcacgattctgaggccattcctccttatgctccttttgagacatttttaaagatttttataaacttgtcagattttcatgtacgtatatttgattttacgaattttaatttttaaaaattacttaacagacaaaataacaattgatggcaaaagtgcagaaaaactttttgtacgcagtggttatgagctgagaaatagatggcagtagtaagcgactgactgcaagttgaccaggagaatgttttctttgacctgtgcttatttttaacttttgtagaaagtgggaatactaatctcaacttgccacatgccatgccattccctgttacacctggtcacacacattctgtctgcttagcccttataaccatttagtgaatagcctctggaataagacatcttacaagggtttgtcattgtgagatctacaagggagaaccagcttggtttggagatgtctccaagatcagattatgttttagtcttgctcaaaaaaattatggtctgcctttgtgcaacagtaaaaattaaaacagaaaatatccccaaaatgctgtgctaatgtataattacaatgggattaatgtgcagaaaatgcagccttgtactaagcaaaattggtgtaggcttaagaagttctgaaacaatttaagtgtgtatctgtggatgaatggataaacaaaatgtggtatatactataatggaactttactgaaccttgtaaaagaagattctgacacatgctgcagtatggatggggcttgaggacattatgctaagtgaaataagccagttacaaaaagacaaacactggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaatttacttacaattccacatggctggggaagcctcacaatcatggtggaagacgaaggaagagtgaagggacttcttacatggtggcaggcaagagagcttgtgcagaggaaccccccctttataaaaccaccagatctcgtgagacttactcactatcatgagaacagcatgggaaaatcccgtccccatgattcagttacctcccactgggtccctcctgcaacacgtgggaattattacaattcaaggtgagatttggatggggacacagagcccaaccataccagtgagataccctttttcacctaacacactgacaaagatacaaatggctaatgattgtgaattggaaaatagtgtctctgataattttcactttttaggagtggaaatcagggacagcttctatgaagaacaatttaggccgggcgcagtggctcatgcctgtaatcccagcacctttgggaggctgaggtgggcagattacgaggtcaggagattgagaccatcctggccaacgtggtgaaaacccgtctctactaaaatataaaaaattagccaggcttggtggcacacctgtagtcctagctactcgggaggctgaggcaggggaattgcttgaacccggcaggtggaggttgcagtgagctgagatcgcgccattgcactccaggctggcaacactgcaagtctcggtctcaaaaaaaaaaaaaaaaaaaagaacaatttaacagaaccttttgatgtttaaaatggctacattcctttttgcttcactctgggtaatttatcctacaaatgtttaatcacatgtatgttaaatatacagagataaataaggcagtgctgtaatgtcaacctattagaaacaatgcagttggtcattatttaagtgaaaggttaaaggaattatagcatatcaatacagtaagatattatttagtcaattaaaaagatatgattgatctacctgtgttgctgatgaagtgtctctaaaattctgttaagtaaagaggtattggaacaagtttgcttttttaagacagatgaaggaggaatgcgtactgtgttaggcatagactgtctctcatatgaaggctaaatttatgagttggctgccactgggggcctgtgtggttgagtggtacaatcagggaaaacccttaagttcttcgggaattttgtatcatatacatgtattatctacctatgcaaatatttaatattaaaaatatttaatcatactcattatgtgggttcgtttatatctactagccctcaaatttggatttaaaaatgtttgtaggtgtttataaaatacattaagatagcatgaattaaatctggagttcttcagtcaaatctggaaccacttgcaatatttacaccagtggggatttactttagggatgtgtttcataggcgctgcaagagctgagtactttaagagttgacagaaaggcaacctaaagcatatccaaccacatgctccaggaacaaaaatgaggcagtggtgttactggaccttgtatacagaagctagagccctggtgggcttctccagtgggagcaacagccagaggaggaggtgctgcccagatagaaagagaggagtggaagtaccctggctcttcccttcttcccacctccatctctcaccactgcttgccattggctgaccccagctggaaaccagctgacccaggaacctagaaaactcagcctgtaagagtcaccttctctgatatacagagtagagttggagaactgaaaacggatctgctgcaagtaatccgaggctggcacaatgagtgaaatgtggcagtgggaaaactttggcttggaaaatggagctgggaatgagactgatacctaattcttctccacgatccaccctcttgctctgtgcatcacatgctccttttgttattgccaggagctttccagggtaggggcatggctcattcatgctcttatttcaagcgccagctcacaagataccagcttgctgtgtcataggcagtggagaaatgttggttgaaaagaatgaatgaatgaatgagtgaatttcaagcagaggtgagaaaaatgaagtcagggcataacagggcaaccttggatattcttgccctttgtggttaatgcctttgggacaagctattttcagtttgaacttgtgctgttcagtaactacactattaagcactttcatcttcctgttttgcaacaattttcattagacactcagtaattgttgtttcacagattatgggttggattgatgaatataataactgttttatttcagcacaataaggaaaacctagtcattataaactctcaaaatcatgtttaccttttacttaaatggagcttgtttgtattaatgattgtaatttatattgcagcataactctgctaatagagacatgataatttacaaaaagattaacaacgttttaggccgtactgaaaatattttcttttcttgataatggtctcttctggtgtctagaggagagctgagcaattccttttaatgaatagcagtggaaattaaaataattatgcttttctgtttttcccttcagaaaacctaactgaaaataaagacataacttgctatttttaaggtttcattaatccagcaaaataaattttcttttactgctttggtgtaattctatttcacttgatcacatttaggctgcagatcaaattacgaagctgtataatctcttcctgaaaattgatgctactcaggtggaagtgaatccctttggtgaaactccagaaggacaaggtaaaaaaaaaaaagaattgagaaaacaaatgaatgtattataattatttatgcaaactataaattgcacaaaagactgtagcagcagctttgcataaatttctttcagtaatttaatttctgccatagtttgaaatgctcccatgatgcagttgaacatttcagcacttaggtttgtttgtagccaaatgccaagcctctaaggaagctactgcttgttttacttaaaaacattcaggcttggtgtggtggctcatgcctgtaatcccagcactttgggaggacaaggcgggaggatcacttgaggccaagactttgagactagcctgggtaacatattgagaccctgtctctacaaaaataataataataataataaataataaaaggaaagaaacattcgttcacctctttctctccaccttatttttttaggcccatcactgctgctactaaggtaaagatttgtgtagaaatgggagccacacacttgggtgtaatgaaggcatatgcctttatggaactggaacttttcgaacgtctttagtttgcctaaatctgtatataatttcaccttgtgttctgggctggatttatatcaccttggtaaagccccaagtcccccccagttgaactctttcaccttacttggagagcagtttctgcttcaggcaggaggaggtggcatttttgtggtgaaggtttctcctatccatcaggtagttgtagagtataaataacttttatatatcagtacctaccaccactgcactgtttcttgcatacagcaaatattccataagttcttattaatttgatagcaaaagcttgtaaatgtgtgtgtggtaaggggtaaagtggagttctacacacaaattcacaagcttttgctgtcaaaacagtggaatggcaggtggataggatagggataccagactgtaagcaccatgaaccttttcttttttagtacatttcacctccggtgtcttgcatgttgtctagcttgttacagtcagtaaatagtaatttgcattgaattgttaactggggtgaatcattatgtgtaaacacatcaacttttggaccaagacggatgagacaatattttctccttagcacatttcagagattctgtagctagactcagagaaactacactatcatttccttcgaacccagagaggcctaagtataaattctgtatctgccatgttttggctacggatctgggcaagttatttagcctgcctaagtttcaggtcttttttttttttttcaatcttttcaatcaaataagtggtagaaatgatgtctagctcatagagtgttgtgaaaataagatgaaatcatatatgagtatgcatgcagtgtcagatacaaaataggctagtccctaacattcataaaatgaaattcctcttctcaggtagtctcagagtagcccaggaatagtatagatttcagacgagaacaagcaaagattttatgtttaggaagccattgaagataatatatttcatgatttatacagatgaccatccgatagaaatctgtgcttgctcatttataaacaagctacctttattcataaatattttttttaaagttgctatggctatcaaattgtgtgtattttataaagctaagaaaggaaggggaagaagctgtttcttgagcttatatgccagacactgtgataagcttatacctatattctttcatattgtttaccacaaccctgaaaaattaggagttgttatccccattttatagaggattgagaaaccattgtgactgtcccaggggctagtcagaagttacaaaagctgggatttgaacccatgtccctctgagtccagcgtgcatattgattctgatactccagactcaactgcagctacctgccttttctactttctcccatttaaactacttatttgctttcacgtacatgacctagaagtagtctccagtttggcagggaataccagtcagaattcatgttgacaattaaatccaagaaatgaaggagaaggtttaacaaaagttcttaaaggtcatatattgctttttcaactagtatacacaagcagcctggttgctttgcatgaagaaaaatggaaatgtagctgtagctatggagtgggataaaaatggctgcaatacattttttattcaaccctttgggaagcagtcacgagctgtgttctcgcttcagggaacaggggtatgggaaccttttcttagactgtgtttataaaacgtcatgagtctgaagtttgatttttaattattaagagaatggaagagtcttgagatttttttttaagggaatcatcataaaacattatatacagttcattaaaacataagtcttatgtgatatttttaagagcaaaattatctttagttattaatttgttcattgtaccataaaagttcagcaattgaattataatcacaattaaatgagtatgttggtttataactctaatgagcagtagtcaaattaaacccaattaggaaatggtgattaatgaccaaatgtacaaattggatcttcatcattatcacagtcccctcaagctatcttttattttagaagctgtaaaagcagtcatttatattttagcaatattggataatcttaatatttataatctgagtatttgttagttctgtttagatcagtagtagcagaacatttcacggtaaaatttccacattgaaactttgatttaataattattctttaaatttaaaagtttaaggagctcagcatcacattgtaccagctcttttttgttgttgttgtttctttttctttttctttttcttttttatttttgagacagggtctcactctgtcgccaaggctggagtgcagtggtacagcctcagctcactgcagcctccacctcccgagttcaagtgattctcctacgtcagcctcccgagtatctgggattacaggcgcccaccaccgcgcccagctaatttttgtatttttagtagagacggggtttcaccacgttggccaggctggtctcgaactcctgacctcaggtgatccacccacctcggcctcccaaagtgctgggattacaggtgtgatccattgtgcctggcctgtacccacctctttgtaggaaactttttttgaccttccattggtcagtgagtgctatttttaataattcaggttattgttcatatatttgtacaacaagtgatgccgtgttgagtgaagaacaagggccttgataacatctatgctgctaagtcacccatagggaatttttgacacggagaaagaactgcagtccaagagctcttttttcctatgtgattaataatctgattcaaaaaatataatttgacactactaactgcaatgtagtttagtgactcttagctaggattataatggttgctaatgacagaaagttatattagctttgtttttgttaaaaagttatattcctgtaacagggaagtctaaggtgtggactggcttaaggcctgaagagaatcagggatttgctggttctccagccctgcttgcctccaaattggcttctttctcagccaggctctcagaagctggcagcaaagatggctcccagtgctccataactctccctcagcagccccataaatcccttcaaatgattctcattgaccctgcttgggtcacatgtctatgcccatgccagccactgagcaagaatcatatggtataggagacatacagtttcttaatggaagaagggacactgagtcaaaacatgcctaccagaaagatgcaaccttattgaaacaaaaataaactgttacttagtcaatagaaattaatcgttattttccttgtttgtccaaatgcagtgccaattcatttcattaattctgcagccaagcaagaagcaatgttttatcattatttatttatttatctacctgcgcattcatgtattcattcattcattttgctagccactgtgaaatttcatgtcatatttcttctcaccttcagccagctctatctgtacacagactcctttttctgatgtctttaaagcaagttgtactccatgggaagggtgggcattttgtcccccagggaacatttttagtcatcacaacttggaggctatgctactggcgtggataatgctaaactacaacgcacaggatggtccctgttcacagagaacgacctcacccaatctgtccatagtctagagattaagaattcttgctttggggcatcttcatcagttggaagctgaaatccattcactgggccaaaggaatgagatccaatttgaagcagtgactatctggctaagattccgtgagaattaaagctgggtgatccacagttaactggcacatcaaattcctttctttcttcggattgatttccctaaataaccaccccgttgcttcttgttagcaagtgcccatgttgttggtgggtgtttctctgtttctgtctttatacacaagactctattttcaagaacattttcggttctctacctcccccaacccccctacccaccccatacctattttctcttttcacagccactaaaaaaaagttctaaaaagtatacaactctcagaacatcaatatttaatgggaagtgggactaatttgaaagtatcagcattttaaggccattttggcaaggcgtgtttcaatagtacattatggttatttatcacaaatcaaacgcagtacgttgcttgaagacagattatttttcaaactaattatgatagtcttatttcctgctgttttatgttccttttatgtgtaagtttcccctctgaaatgtattcttcttttgtttaattctgtgacacattcttctgttaaaattctagggtcagaggcctctaactgccagtcatgttttctatcgagattgttgaattagcagctcacagaatctcacgccactaaacaaaacaacaaaacaccctatgcatataagtaccacagctttctttgatattcgttcagaaggaaaatacatttgtataatctatcaagcatgtaacaatgtgcttttgatggtgaaaattgttttataaatattaataggtatgtttctttcacccactttgtataaaaaatggcctttgttcaagatgaattttctttagaattgagtttcattaatgtgacgttgacaatcttaaggtccggaccaagctcagcacctctgaaaatgcattttgtattgtttgttgttttattaaatgagaaagctaagggtttaagcaggcaagtttattttatcgccctgctgttgacatagacatcaatccatttttaacacgtcaattcaagaagtgcatttagaagcgtcttacaggaggaaataagcatgtaagagtcagttagtattccaggattaatctactccttttgcgtagccacaggtttttatttattttctttgttattttactttttttttggttttcatgttaatggaatgcactttttctaagtttctccttcactataaaatatgacacctgtgtatctatcacttggttcacacaagtggatacaagtgtgagaactgtgacttagcagggattggcaaactttttctgtcaaggaccagttagtaaatatttgggggtttgcgggccatacagtctgtattgcaactactcacctctgcttttgtcttgggaaggcagccataggcaatatgaacgaggctatgttccaatctgttattcataaaaatagggctggcttgagggtcttagttgctaccctttgcttagatcttcatttggagctattctgtaccaatctttagccttggccttatgcacaggtgtgatgtgatttgagagtcaccaacagcctattttacccttatcttttagccaaaaatcttgttttctactatttatgatgcctaaaatgccaactattaatattcttcctttgggaaaattcttattcattcagaagatggctttttattgaaaaccatgggtaacctgtacatatgtaaactatgggagacatttgcttagatttgctctaaacagaaatctcagattataaaggaacagataatttttattgttaggaagagaggagagttctgtagcctgggctacaataatgggaagctcttaagtataaaaaagcatgtgcatattagagggtggtgtggtcgtctaacaacctgctagtacccactgtctaggaagctaagcgctttgcatacaatctctcctgccaccaacacctagagtagaacatactctgatccccattgtatagacaaggctcgggtttaagagaggttaatgtgcttaaggatagctggctaggaagtgccaggagttgtcatttataccctgatatttttgatgccagtctatattaagtggtcaggttcaaggaaaatcatttagatggcacaacattgtagatagtaagataggaaagcactttgtttgtttggtactatgtataatagggaaaaacaaacatttttctcctaccaaactctcaacacagaagaacacttcttggaccagatgtgtgagtttttccaacactgactaatctctgacactagctaggtatcctatgattcaattcaattcttttaccatctacctggaattagagtcagatcccataggttaaggggtcagtcttatcagactgactccactttggatgtcatttgtaagaccaagcctctggtacttctgatgaaccagctgtaaattgggggttcttaggactccctccttgtgccccatcatttactagaatggctctcagaacccagggaagcactttacttactactgctgatttattataaaggttattttattttttatcttatttttttataaaggatattttaaatgatacaaaggaatagccagatgaagaggtatatggggcagggtatgcatgaaggggtgacaagcttccctgtactccacaggtgagccaccctgtagcacctccctgtgtttggcaacctgtaagctctccagtcccctggagttgagaaatttttatggaggctttattacatagggatgatctgttattctttctggagcatggaggtggggctgaaatttccaagcttctaatcatagtttggtctttctggcgaccagccccatacagaagcctccaccaagacttaccttaatagaacaaaagactctcctatctcccagaaaatcccaagggattaggagctctgcatcaggaatcagggtcaaaggccaaatgttagaacacaagattctcctagcacccctattgcttaggaaatcacaagggttttagagctctatgctaggaattagggatgaagaccaaaataatatatttattataaatcacagtatcacagactacttttaaaatataaaacaggcgtaacaaatatgtgtctgaaagaatccctttacatccttaaagtttttcttcccttacccactaagtaaagactggggtcttgaaggtggcagttcaatttgaatcccctttcttaagtcctaagtcctctaaataaattacttcatatttaggtagtgtttttaacttcccaaaacacttagacatacatgcaatgatccaattaggttgtttagttttctctacaaattaacagtcggcacaggaccgttgtagatatacaccccttttatcccatagtcaccatcttgaagctctgggttaactgcaaagttctgtcaagattgttccctggagagaacgtcataccacagaaaaacatcctctgaaaatctagctttgcaggcatttagttgggattgccttttgaactttgaatacatacccattaattattctctctctgaagcagcttgtaactgtagtctttgtaaggagcaaaggtcagcttgaaactattttgatttacttgtttattgatctcaaccaagaattcctttatttgaaactcttcccttaggaagtcaatttgataaccttagcccattcattttgaaggtgtcagttataagtagtcttgccaatgagtaatggaggagctaaaattactaataaattaattagaatgcatttataaacctagtggaaagccatgtacgaagttgcttttttattgattattataccagtcattaactgctgagaaaattcccctgtagcaagcagagaacattggccaattcgtttggtaattgtaggattctgtcaataagctttcaatattttggaaagtaattactcattcactccaaccattcacaatgtgtggacaaagtggttgggcattttggggcaagactaaggatttaagcagacattaacttccatataagattctctcttgtcgctcagtgctactttaagtcatgtgcggtctatatatatacttataacaagtattcttagatgttaatatgctggtctacacagatttgtatcaaagtgcttgaatattgtggtagggaaacccttggagaaaaccctctacctggggtctctaacgccaagatgccatatacagccatgttttattttcataagaagcaagtataattaggagattatagccactgcttttcagtgagtgagaaatgttctgtggctgtttccctttcaagagtcaggtgcctgtcagcaatgctggaggagaataggtagtatctgtaaattattgttcaaagattcctggctatcaatatcccaagttaagtaaaagaacattggccaggtgcagtggctcacacctgtaatcccagcactttgggaggctgaggtgggcagatcacaaggtcaggagatcgagaccatcctggctaacacggtgaaaccccatctgtactaaaaatacaaaaaattacctgggcatggtggcacatgcctgtagtcccagctgcttgggagactgaggcaggagaatcgcttgaacctgggaggtggaggttatagtgagccgagattgcgccactgcactccagcctgggcagcagagtgagactctgtctccgaaataaataaataaataaataaataaacaaacaaacaaacattatgatgacatggcatcacagaacactaatttctacactaagagagataataaaaggggtcagatacccagataccaataatgccaccctctccactgcagtctctccctgattgtatgtataggagatctgtaaatcaaggaaagtgccctgtagtctgtctcctattatggaatgagttttgctgggtccaggagatttccaccagctccagaaactagagacaattgtgctaataatgcctggcatcctggctttgtgactgaccagtcttggtcttttcgtgtcttataacttgaatctgaagcaccataagatggtcctgcacgaatcaagggcatggcccttgttttaaggattgttattgccattttttccaattaaaaaaccaaggcccagagaagaactaggttattttatcaaggttacagagttagtaatgtatgctggaaattgctaaaagtatatattttaagtgctctcccacaccaaaaagaaaaaccaaaaactatatgagaagatggatgtgttaatttgcttcagtgtagtaatcatttcactgtgtttaattatttcactgtgttatatgtatatcaaaacatgatgttgtatgctttaaatacacagttgtccctcaatatatgcagggaatcggttccaggaatctcagatataccaaacttcgttcatattgcacaattcctgcagttggccttgcagaacccatgtatgtgaaaagtcgaccctctggggctttacatcttgagaataaaaatccagctataagtggaccctcacagttcaaacccatgttgttcaagactcaagtgtatacaatttttatttttaataaatgttacagagttagttaaggatcaaataaaaatcgagcgattctagtctggcattctttccactaaatacttttggaaatactagacaggatactgattcaataaaaatttcactttaccatatcaagaaaaggacaataggggacaaaataattaataatattgtctagtctctctttacatagaagagaaaggtgataattagtggttaaatactaaaaatatataataaaaataatgaatcaaagctgtatctatgaagctgtgccagtctgtaacttttaatggttgatggcaacttttggggttattctattgaaatgagaacaacaggtagaaattactatgttctttactagaacgtaagtcccttgacaacagggaccaaaccctaaaatttaaaggtcaagaaagccaaagcagcctctcctgcctgtaacatgtgaaaaaaaatgacagtacttaactttcccttcgcttgtgcctaccagcctgaagaacttaatttatagatcctcaagagatattcaagtatgattgttttcttctttatttagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttggtaagaagcagttatatcaaaagaatgctttgtggattcttatagaatttaggaaaccttgatttctgaaatgtcacttaccaagaagaagtaagcacataagtttttttgtagctgaaaagtcttaggaaagtatccaagtttcttctcaaagttgttttgattaatggtcactggtgtaaagcagaatttctcaactctggcactattgggagtttgggtgggataattctttactgtcctgtacatcataagatgtttagcatcctaacctctagatactactaacaacccccacttgtgaagacaaataaacccatgtaaatcaataaattaaaataaatgtcttcagacagttccaaatggctgtggtatgcaaaaatcaccccaactgagaaatattgacttaaaacatctcagttaaactttgcttagtaaaaaattagaacctttgctgctcaactcagtattaatatgcagaactcttctgaaatttaggtttaaaacaaaattcctttatcagaggaaatagaagaggacatacactttaatcacgttgctaaagtttcaggttctgtgataaccaaaggatgaaatgtttaatccattatgctagtttattaataaaacaattgattttatcacactcatctaaatttgtgaaaatggcttcttcagctgagataagaatgtctgtagaagcaatacagtttctattattgttcacagcttatagtgctcagatttatatgcttctgacttaattgcacaagactgtgtttctggtagaatcaattcattgtactggaaactgaggtcttaatcttaatggaattaaaataaaaatgatttgtagctcattaaaccagcaatatcattgtattcagaactgaagagacctcatccaagaggtggctgttcaatacaatagaaaatgacatccaattacaagtgataccaaaagctcttgctttgtattggagcaataactataatgtaccagatcactcacatcattctgatcctgataagctaatgcactctcaatatttgtaggcatttagaaaggggaaaggtatatgggtttaaaccaaattaaatacagattatttatagcctctgtaggaatgtgcatggtttgaccacatagcagcctcaaaatctatgatttacacatttcaaattgttttaagattctgtgtaaaccatttttattttagttactccaaatttaattagtcacagtcataggcttttctagggaattggagggtcagaaaaatgaaaggtactttaccttgtgagtttctgctgtgttctggagttttttttttctctctcaaggaaagtaatgttatataattaagcttaagaagcaaaataagtgcaattgatcaataaaacttagctctggaaaacaagacttttgatattaaaactctctacctactttcttaagaaaggctcctaagatgttggcacattttggttccagttttaacggttgggttgctggtgagcattgcttatattaatttgaaagaggaacaaggggataagaatattgtttttgtgcagtcatttgttcatttgtttctaagtttatccaggtaacattatgtaaacatgtatgactgtactaagtgtaaaaaagtataaaatcccactgaagttgggaagcctgtggttcaatcccacagatgccacattcaaaggaccatattctcagcaaacaaaacattgagaattccattctttactcctgtctcttaaagtatattaaaaagaatgtaattcataggtcctagcaacttccaatagcttgtttctctgcctcctgattctcttaagcttacactttgcagaacctaaaacttccttttttactactggcccaaatcggttacttacttaaacctttccttctttctgtttttcagattgatttaacttcccaatacatcctgttcctcattcctaagtcttttttgtttcattgtttgcatatacatgtcctgattctttatcctaaaagtctatgaactaatctggtttaatggaattccaaacaggatataaattggcctggcaatgacagagttctctcttggcaatatgggggagggaaaatgtttatggaccatttcatgttgctaaatgtagcctgtcttgtgtcccatttgcatttcacagtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggtaacctttctctttgtagggagattatatgccagttttaatttctcaccgtcaagagctcacttgttcttcctggtgagagttgataagtcaatatgtgtactctgcagccccagatgcaacttctatcttttttttttttttttgagacggagtcttactccgttgcccaggctggagtacagtggcgcgatcttggctcactgcaacctccgtctcctgggttcaagcgattcttcttcctcagcctcttgagtagctgggattacagtcacacgccacaacgcccagctaacttttgtatttttaatagagacagggtttctcatgttggccaggctggtctcaaactccctacctcgtggtctgcccgcctaggcctccaaaagtgctgaaattacaggcatgagccaccgcgcccagcccacaacttctgtcttatatcacattggaatacgtgatgatttaactcgttttgggtaaaaggcttgggatcttatttcagaggttgtgtgtacagtcctgagaggtggaaggaaataaaaaagatacagtgtgccagtcgaaacattggttggcatgaactttatttgggtaatttacacagaagtgactggtcctatgcttacatgatttagagggaagagtactatgattccttccataaagatgctgaaggtattaccatatattggaaaattttagggttatgggatcaaaaatcactgggaaataatggccccaccttcttttgtatgctttctaatttttatctctgaccattagtttgtaacatatgtactaagtagcaaataactgtacctggtttcatagttactattgctgcttcatgtgcatctttttaacttgagggtagctaactagaatgtagctaccacacccatgctaggggcagtgtgggcattcaattaatatttaatcagctagtttagtaaggaagttaaatatcagtatgctttgtttcacctgtagatactcagttgactataacatggtttaggtagatgcttgttatgtagaaagaccaaaatattttgaaagtctaatgtacacggttttcattcattcttttaacaggcctgtgaagtacgtatatgccacaacaatttgatataaaactttttctttaattttttgattatttttttttagagacagggtctcgttctgtcacccagaccggagtgctgtggtgttatcatagttcactgtagcctcaatctcctgggcccaaggtatcctcctcgcacagcctcttgagtagctaggactacaggtgcatgccaccatgcctggccaatttttttttattttttgtcttgctgtgttgctcaggctggtctcaaactcgtgacctcaagtgatcctcctacctcaggccctcagatcttggagattacaggcgtgagccatcacaattggcctaaacttttatttgagaatcattgtctcaatattgttagagtatctaatatattgagttggttactaaaatatctgaagatgtgggaaatctgaattgttactaagagaatgataaatgaaaataataccagattttttaaaaaagaaatgtggtctgaactaaatatggaagcttcccattaataaatatactggcaatagcctgttttgttttgcatgcataaaattttgtcttatattggtagtacacttgtctgttttcctcatgacttacatagttggtggccttatgtttttgcttgtcttttcttctgactcacaaaacagacggcaaggtattattagcacttatcttcagttctccagtgccgttcaggaatagccaagttattgaagttcaaaggcagccagccataaggaaggtattcgcaaaaagaacaatgtttccacttacataagcactttgttttcattggttaggtagaaacacctatcagtggctctctaatcatgtattaattcacttattctttcttcctactgctttctaagggaagaatcattttcctcccagagattcccaaaccaattgaaatctgtaaataccgagacacacagctccttaagctgcttgaaccacacagtacccagaggacagacgattgtaataaaatactgaacttttagcgtctactgaaactctgtgcaaaggataatagagagccactgagagatgaaatctaccaggacaatcattggatttcgttgaaatagcttttcttagtggctcacctcaaattttaattttgtaaaacctgtaggatggggagggatagtggaaaaattactgtcagagccatttttcttttaaaaaaaccactctcttccaaaattttgactttatggaacattttcaaatgcttggattatttcaactttttttgagattaactgtcatcttgggtagataaaggtatgtgggagttattttatttttctcatgctatatcaggaaaatgaatgcacagctcatctcacagtactttttccaaatcttgaaatttcaaaaccagttaaaaaacatagaaatgtaatgagtattttcaatcctggcttcgtttcacaaaatttagagaacagaacctaaaaaatagtatagatgagttgatgtgattttgcaagcaaactggctgtagttttggcagtaattatttcgtgtccacctgcccaaaagtagaggttcctgagagcccaaagctaattatttcaaaggtgtcaattgtcttgttagatgtaaggattagttagttgaatacacagaaagtcaaaattacagaacaccagtttttgttaaacttttatcaactgatatttacaactgcttatttgcagtgtgtctaagataattctgtttagtaaacacgtcattcaataaaattattacaggttgacatatatttccactcatgatgtcagtcatagagctgaaaattttagttattttgcttgactgttaacccaaatgctgattttcacttggacctaacacaagtatctctacaactaatacgtttcttattattttatcatatatatgaaatgaagttcctctaccaagctgaataaaacaagagtctttttcaagataaactcacttactgaactgaattcatataaagtatatcattaaatattttataattctcttattttccagctgagcttgagatgagagaaaagtaatagagtttgttctgctggtggtcttcatcattttgatttaaagaattctaagcattagtattctttaaatcataaagagcaaaaatgtataaaataggaaatagaagtagggttttgtggttttctgttaagaatttaaagacatttaaaagaaaagcactatatagaatgttaaccttgggtttttgttttccaaattatactctggtttgtattttaattctgaacttagaattccaaaggtgtagcaaatgtaacatctggaatatgttgtgttcacttacacaaaacacctagtgttcacttacacgaaacatcttgtgaagtgaatacaaggaaaggacacttggcacgaatctctccatgaccccaactctgttggccaaagataagcaaatcttttgctctctggaggcctagttttgaaaagcaaaagtacacgattggcattagtaaaggcacctcattggatttgattgtacttcctggtttagatccaactttgaatcatattttctaagcccttgaaatatctaggaagaaatgtgctacctaagcaccaaagacaagttgaagaatggaagggactcttagtgggattcttatgccagactgcctgggttccagtcttgtctttaccagttactggttgtgggaccttgggcatgctatttaacttctgtgtgccttggtatcctcgtttataaagtggtaataatagcagtacttacctcagagggttgttttattacacatattgagacacacacgcacacttttcatttagagggaaaataatttcatatgacagtatcatttaaaaaatttaataaacttattaaagtataatctccatacagaacagtatacaaattttaagtatacagcttgatgaattattacaaagtgaacatatcatctaacctccagccagatcaagaaatagaacatggctggatgcggtggctcatgcctgtaatctcagcactttgggaggccgaagtgggcagaaggtcgggatttcaagagcagcctggccaaaatggtaaaaccccgtctctacttaaaatgcaaaaattagccaggcgtggttgcaggcacctataattccagctacttgggaggctgaggcaggagaattgcttgaacgcaggaggcggaggttgcagtgagccgagattgtgccattgcactccagcctgggagacaagagcgagacttcgtctggaaaaaaaaaaaaaaaaaaagtaaaagaaaaagaaataaaacataacagggatcctggaagcctcctcctcatgcagtccccatcattttcctaccctgctttctctccacaggtaatttcttttcttttctctcttttttttttttttttcttctgacttagcctcctgagtagctgggactaaaggcgtctgccaccatgcccggctaatttttgtatttttagtagagatgggtttaccttgttgcgcaggctggtctcaaactcctgatctcaaggggtcctcccgcctgggcctcccaaagtgcttgggttacaggcagtagccactgtgttcggccctcaaaggtaatttctaatatcacagatttgttttacctatttttaaacttaatatcactggaatcatgtactgtatactcttttgcatttgttatcttttactttacttttgctactggttagtcttttcaattttagtcattcaggtaagtatgaggcattatctcattatggcctttctgtcatgactaatgaggttgagcaccttttcatgtatttattagccatttgaatatactctgtaaacttgtattacctcatctatagacatgaaaataataccttaaagcattgttttaagtaccaacttgcaaacctttctaaagcatagtgaaaactttggctttttatattttctgagtgtttcattccattatcacttccaaaacttagatttagaataaatgcacatctcagaaatgggaggtgtctgatacaggttcagtgataatcagtgttacttcatgtgttgttttgaaattgatggaaggtgtaagtgactcagcttacaatgattctctactcagacaaccaaggaaaacagttaataaagggaggattaaattcatgtttgaaagaagaacaaaatataatttgttataaatttgagaagaggccagctctttttgtgctctatggtatatgtttcagaaactttagaatgtgaagccagagaagtaaaactgcatgccatattttcagaatcaggtatatgcaaatgccttacgttttaatatattttaggattcacttgtgctgtctcatatttttaaattattgcacatttagagtttatttaagtacaaagaagaatatcctgttttctttcagatacatgcgtataactgaggcacagagctgtttaaacttaaactgaggtgccgtaaaattgtcaggagttgatttgaataaccagtgattcacggattgagcagctccaaaccaaaagtgcttccagggctccatcaaaagaatgtgaagggaagacttttatagggcaaacacgaaagtaaagcaaagaaaatactggattggttacagttatactgttgccttatttggtctatcctcctggaaagttctagttatgtaaccataagttagataactagaactttctgcttccaattggttagccttaagtttcatttttctgtaacataggcatttacaagaaatagctcaagttttgtttatgtctgcaaatcaagcagagttaagatcacttatgaggcctaactggctttgtctgctcagagattcttcaggtctggtgtccattttaatttattgtaacaaagcaaaacccatttcattacacaccacatgtgtttgctgaaataccttatctgcaagcgactgttttctttgtagggaagtagaactcttgtaggaatttattttcgaatatagtgctcaatactttatacaacacaagcattatttttgaaatgactaccctgcatttctattcttgcaggtttgcttgaaaatatgtatttttttcatatagagtggaaaagattaaaattccaggcagccattctttctagtggtagtcgacctgatagtctagtctgtggagaatgattaattttgtgttgatcagctggtcatttagtctccacttccacttagaatagctctttatttagggaagtcactctgcataagctagaggatggaaaaccatctaccactctgggcccttttcttttttcccccggcagtagttttcccagtgtgaggaattcataaatgttgatttttgcatatcttttcctgatgtctagttaattaaaatttccaagaatatctggccctccttgcccacctcacatttgttccattttacctgccaatacttctcagtaataagtgggtcctggtgactgcatttggttttgtgtcttccacatgatcggtgtatctgctagctaccacattttcaaaccatccctaatagaacactcaaaatctatttacatgctcctcactgacataccctcagaaacaagccaaaaataagatttttactctttactctgtcttcaaaatccaggttttaatgcaacctactttgttttatggtaagtgacttgaataatttaacagatttggggcttagtaaattttgtcgttagtcccagcaagctccggaattgattacgagtcctctgtgtagatgcctttgtagagtgttaaagagaaatggaccatgaatcaaagtataatgccatatagtttggaaaaatatataattattagaagagttagggttgttgttttccttaatgttattgcatagagaaaatgaagcattgaatgcaacaattagaaaacagtgcatttctcagcaagacaatcaataatggtcgggaataatgtcaagaatctctgcatcttaagaataatcttatgtggcagggcatctgaaagttgtactattagtatttttgagatgttactttaaaattcagataaagcctggtaaaggcatcattagatgtgggtagtgaacttaggaaaatcattcagaagaacaaggctgaaatcctttggactgattcctttcctgtatagcagaggtgagatgtagtctggtgggatgtgccccatggattcaggagattgcagatactgtgaatcctttttttcctctttccatgctgccccacccactgtcagagaattaggaattaggaaagatggtctcattcctaaacgagcaacatgtccatatgggcttgcctaagaaattggctcgacttagtagtttgctaaatagtcttttgtccttattttaggttattttataaatagtagtcccttttcctaattattaaaataaggacaaacaaaagagaaaattataaaatagattacacagatatatttatatatacctttttaaaaaatatatatatatacacacactagttttgacaaaactagacttatatcatataattgacaatattatatagtctgctttctttcttttttttatgtgttttgcctgtcctagtacagttctctataacattttcagtggcggaatggtatttacttgtatggatatacaagtttacttaacctagtgctctgttatttgatattcagggtgttacaaatttaaaataatgccatgaacctccttgttctcataactttacataaagctgggattattcatataagataaattcctagaagtgtaagggtcaaaatgtatgcacattttaaggttttcacatgcattgctgaattacctcagtaatagttgaaggacttgtagagggctaacatcagtgagttgactgcccatttattttcccatgtcttggctatcattgctgtaattctttaccaacaggagaggtagcatttttaaattctttttcttctattcagcatttgtaatgcctctttatgacttgccttttctttttttttgtctagttttccattattacataattctcacagtgatttagaacacaggactctgtgtgtgtgtttgtgtgtgtgtgtgtgtgtatatgtgtgtttgagatcaagggaatgggcagttttatttatgtcatcagtcatgttttcccacatcttgactcttgtctttaaatttgtttatataaattttgatgtctcactataataaagtatgtacacttgaaatactattgtgtagagtatattgagatcacctcatgcatgttagtgtcttttactatgatttacttagtttcccatgaaacttgtttttagagttttaaaatttgtgatttcatgaatcaacataccatggtacaatttcaagtcaaaaatggtattccccccacccctcccacaaaggaaacagttctcctggtctgtttaaagcaagatgaatattaggatcagaagtggcatgttcctctagttattaataagattctttttatttccaaggaatgcttttagagtgttggaggaatttcactgtaatctaatctacattgttttctcttagtattcttggtatagttgatcattatttgcttgttctgtatttggaaattcgcctgtgtgctaaaattaatttgtactccaaaagtcatttgtaattccacagcactttcaaggtcattcaaggcaatgtgcagagtggtgaaaaattttagtcacccaatgcacatgttcccaaatgagatcaaaaaggcaatcctctgccttcttgtttcagctttcatactgtaaaacgtgtccttttgcagtctatttatggccatgttttttgcatttttgtccttttttgtgtgtatgatttcactgttggcccccaagcatagtattgaatgctttctagcattcctaagtgtcagaagcctgggatgtaccctacagagagcatacaggtgctagataagcttcattcggcatgagttaataatgctgttggccatgagaagcaacaatatatattaaataaggtgtctttaaacagaagcatacttaaaacaaagttaggaattgatctgctgatgaaaatattgtgactagaggctcataaaaatgtaactgtgtttttccgctaagaacaatggttgagtatttgctaattcagtggttttagtgactgtatagaccataactactgtggataatgagaattgcctgggtagtgttttggataattatgagcagcttttcatagattatatgatagagacaccttttctttctctttctttccttcttctttctttttctttcttctttcttgactgtcttttctcacagggtctcattctgtcacccaggctggagtgtagtggtgtgatcacagctcactgcagcctcggcctcctgggctcaagagatcctcccacctcagcctcctgagttgctaggactacaggtgcatgacactgcacctggctaattgaattttgttttgtagagacagggtttgttgccctgcctggtctcaaactcctgggctcaagcgatctgcctcttagcctcccaaagtgctgggattacagacatgagccacaacgccaagctgagacacttttaaagaaaggacaatcagaaacccccagtctaaatgtaaagtaaaaaacttttcttatcatagtttacttgttcccctaaaggaaggatttgattatgagaacctttagaatatgccagtaatggctttttagacatactgcctttatagctatggaatgattaaagtttgaggaaattttagtttttcaacgtttcagttaagaatgctttccttacaaatttaggttattttcactttatgtttttggaagtttttaaatattaaataatgatcgctgtttcacctttacgaatttacatttcctactaaaagtgtgatattttaaaaaatttcctaattgtattcctgtaatacaaccactattatcattttaaaaaattttcttccagcattatgtgtcattgcctgatgaacatcttctcatgttgttagtcttcttgatcatcattttcctagcagtataatggaccttttaattttagatatttatttaaagaagcctaacatataaaatatctttcaaaaagcatgtggaactttgtaaaccagatttgcttaaagcagggaattatacagtcagaaatcaaatataatagtaacaagtatgaagagctttgtttcacagtaagccataagacttaggaaagaaaaagaaaagctttgggggtacataacagttttataacaataaaaaaggaaaattaacataattcaggaccaagctacatattttttatgtattttatacaattactacctctgtggacttctaatttgagttagttttaattatctcagaattaacggcaagtcatttattaatatttgacacagtccctctaagttgctgggatgctaaactacctaagaattccagaggtggctgaatgcaccttccgagtttttcagtttaatatcttcctgttcaatgtcttcctggtatattcaggtcagtgaggttaggaggcgtcaagaatgagacttggtactggtcagaaaatgaactcacctttatttttccattctctttcttgctagaatcctcaaatgatttattttaccaaaaacctcttaagattccactgatttctctgtgcattcccaccaaactttctgtctttgtaaaggagcaacatactccaggtgaacttctaaattaagcgtctttttaatctttataaccatcatcagatgtatccttggggataatttgtgcctatctcctttttctttttcatgtgatatttacaatttacagtcctcaccgctgaataatctctttatttattcacttctttttaaaaattctgtaaaattgctcagaaatattatagtttgtttgcccccttccccatccccacatttcttgttgctttttgctccatattctttaaaaatacccaaggtatagagctttcctgaattttctccccattcaaggtttttgttttatgcaactattgtatacttcattatctgtagcccctgtaatggtacatagaacatggtagatgccccaaaaatatctttttagaacaaactcatattgtcagcctatttttttatttccatataagtcatctagctgaatattctcagccaggaagaaaagcgtaataagtcaatgagttgcccttctgaaacgattcagtttccaggctagatgccaatgccatgtgtctggcaagactgtaatacaatggggcagtctggtgggggccatactctaggactagacttgttcaccagagtcaggcaagcattggaaggaaggactctttgcagagagtgggatgaggttccatccagcagccagaggcaatgcgtacaggaaatggttggttgtacaggaaggattgtggcagtagggaggggccttacctgaaagcagcatgttagaagatagccagagcacacacagagggaggcaattcccaaacaacatataggtaattcttttaacaaatagccagtaccaccaatcccacactagtgcaagggccaaactccattcatggcaagcctcctgtaagccaaagcttggttctagggagactcaagtaccaggcagataactaagccaggaactcagccataggtacaagtcagggtgtcaaccatgagctcaagattcattccacagcaagaatgacttgagtaggtaggggggtgttctccagcatgtcagggggcagctctgcaaagacccctttgtgaaatcagttactagttcctcagaccacagaatgactaaactggattaaaagccatttagaaacatcagccaaacaagaatatattaagtgtcatccctgccaggcattcttataggcactgaggataaagcagtgagtgaaatacatctcgtcttgttcactggaggtgccattttaaagaggatagaaaatcgtttacactggtgagtaactagtaaaagaaaattatgcaatatatctgctggtgctgtctgctagtttgaaatataaaaatgaaagggggcttgaaaatgccaggtgtttgttatttctgatagatttgtccaagcagacctctctgatagttgaccttagagaaagaaatgtcatcgccgttccatgatttggagttggagtttgtgggtaatgacatgaatgctatcaatgaaagaatctgcccctcggagttgtcctcctttctcttgtcttgacctaccaaagtgttctgagcaatgttgcttgctttattacagattttttttttttaagttttgtccacttaaatagtttacgcagcaactttaccctaatttgggtggcaactctctcgcaattagaggtcctttctgaatatcaatggatatttcatctgcatacccaggaacctctcctgagaatgcttcatttccacctttgaggtcttctgaaatggagcactgcaaacacacatattagcattcccaagggccatctggtacaaatccgagttaattatttttcttccagcttatctgtgggttttttcattaattgttatctctaagtattctggacacatccttttttctcaattagaactcaatagaaagtttttgagcaaacgtttaggtgtctgctctaatactgaaaggcctgaagatcgtaaacagcaagcagaaaatccatttggagctttaacccttgaccttctaggtttcacttgctcgttaatcccaagtagcacatttctctgagagggagacaaaagtgacttagaatcttccgtgtgtcattatgatccaagagtcttggcatttgggtagcaggtgtgagagaaaacaccaaaatcacctcatatttagatgatttctgatattttctgtgttttataacctgtgatcagtagttgcatttcatgagtggagccttcttctccattaagctgaacgaccaaatagttaatccaaatgctgacagtgctgaccaaattccaaagaatagatatttggtattcaaataagaagggtgaatgaagctaaagtaaaaaaatacaaaagtatagaaacatgaagagaacttatactgaaagaacaaattctttgattcagtttttctatacaggtacttccttaaaggcactgccaattgaaagttgcaccaatttatcctacagtgtgaaataccttaaataaggtataggacggaaagtgaagccccatcagcatactatatttctcttctagtggttacagcttggtatttctgcatccagcctgcaatcaacaattctttcttccttccctccctccctctcttccttccttccttccttccttccttcttattgagatagtctcactctgtcactcaggctggagtgcagtggcatgatcttggctcactgcaacctccacctcccaggttcgagggattctcctgcctcagccttctgagtagctgggactacaggagagtgccaccatgcccagctaatttttgtattttttagtagacacagggcttcgccttgttggccaggctggtctcaaactcctgacctcaggtggtccgcccgcctcggcctcacaaagtgctgggattacaggcgtgagccaccacgccctgccaacaattatttcttgagcacctactatgtgtcaagttaggagctaatcgagaaagtaggaaaccatccgatatttgatgctattggttccaatggggctttccttatcaatttttttctgattgtaataatctctttaaagcagagaaaggtaggtacctgaatgacagatgtagtcttttctgcagtctttttaaggctcaataaaaacccagtatagagcaatattatacttaaggtcacataccagtctctaggtttactgagatttgtctgtgaaggcttactaatcagaatgtcagccatggactgtcagtgttgacaacaatttttaagctgttagaaatgcacagtctgtgttttcatgggatctccaggtgattgctgtgcacgttagagtttgaaaagccctggtctaaagtagggacagacaaactacagtccatggccaagtcctggccaatgcctgtttttgtaaataaagttgtaccggaatacagctgtgctcattcactttcttaaggagttaagaagttgtgaccaagaagtcctggtccacgtggtctagagcagtaatgctcgaaagtgtgtggttggacccatgccagtttatgtaccagtgcctgtttgtgagctgttttaggtttgtgataagtacagatactgagaataagcatttagaaacttgtattgctaattacccttgccatgacatgcaagaggaatatcaattttttagtaatttgcattattacattttataataatacaagtcaatgagttagggaattatttttaaaaattcattcatcatcacagattatgtaagaagcagcactctatgagtgtagatgatatgtttgtaaaaaaaacagtgtcataagtgaatgtgattgtacatcttgatgccaaagtgaacttccttatgggctgcggtaatcacattgtcctattctttgctcaccctgcttttccatgaatcttcctcttgtctctttggggatacttccttgaccttggtgatgctgtaaaatgtgatgccttctttctctctgtatgtcttcacttggatcctgtcttccctagctactgctcacagagtaagctttcgcccaggccaggccaattgctttactgcatccctgccattgtaggttactttcagggatggtctctggccacaagtccctcaagctagttagaaccttccccaggggttttctgtggaagctcatgaaagaggccacctacctctgggatcatgaaagaaaataatgtggcccaggaggctacattccctagtagctggtgaaagcctgtgtaagctccaggagcaaagctcctgccatgctatgatggaggctcctgccatcatagggcttagttcctctagcctaggtttccatgactccatggttttcaaaagtgtggttggactagcagcatcagcatcatctggtaatctgtgagaaatgcagattcttgggctccaccccagaccttcagagtcagaaactctgggatgaggccccggaatctgagttttaacaagccttctagatgattctcgtgtttgcttgcatttgagaatgtctactacagctctatagctcctccttatttctgtgagttactttagcatccttcccaggtgtaagccaactggttccctttaaccccttaaattagagttgattttcggtcactgacaacacagaaagtcctgtttcacataccatgagtactattcttaaccaaaccgagaatatgcctcagcacactcttgcgtcctatggtggcccagagctcacctctgttaacacttatttttatttccttccccatacgctttataaccccttatatttgaagatttttattctcttctatttctgtttcaaaatctgtccctgaaatgcagaggactgtatccattctaaagtgactttgttacccagatgagaattaaggataatcttccagataataggtagagttcatcaatgtggtttgtaaatgcatttttctaaagatcaactccctcatggaggacttttattttccttctctccaaaagtagactacatcaagttgtgtaatttttaagtgactttctataaactttatgaaattacctcatcttgagctcagtcatcgaggtagatctaattcatttttgtccccgttaagttaccatcaactgcttcttttcacaagagatttctttcctattactgctcttcgtgcatttaatcactcttagcgctttctttccgcctcttgatttataagtgttttgctgtgattcagtctcctgtctattcttgctacagagtacaaccttcatttgttatctgtgttccttgtgctgtctggggaaaaggacagtggtcagatctttcagtatttgacaaacatcgtgataatagagtgtttcaagatggagatgttgaatcaactttgatgtttggtcaagaaaattgattcataatgatatgtgacataaggtctttgctgagtttttcctcggtatgtatgaggaatgaaaaaaccactgctttttttaaaaatagaatttaatgttttcttttgttgttttttttttttactttgatggctctttgtacaagctccttttacagattactctgtggtcagagaatcagcatgtgactttttctagatattggataaatagtctttatgtcaactaccatttgggaattgagatttgaatgcttttcttttatttcatacgttcactatcaagatgagacttcattgctgtttcttccacctctgaggttatatcatgttattggatgttcatgtctgtcttagagagtgggccagagaagacatgacttgagctacttttaattcccatttgtagatcctgggcatctctagctctgtgtagccactgcacagtggtgttacaccctatatgagggtgaaggtctaaagacagttcttaaggcacaacatatttactatcatcattaactttgaaaattctttaagtgacccatacattttagtgcctttaagcacaagagtcccagtagtatggtgagacgctgacccgatgagggtatgtagagctcattctcttccttctgtctcaggaactcgtgtactttgaatggaatagcagttgcaacctcccactagattttattcgttaattttggttctttcccactcacttacttgttctgtctctgtgcctgaatagttggatttacataaattaaatgtgtatgtgatgcaactttgacgtatgatactacataacatgttaatgaaagtacggagagaacagtgaaaacaaccagggatcaaggaattgttgaagggtattcttgtcatgcatattagttttccatttttaggatttttcatttgtttgtttaatattcaattatccaaccgaaagggtcattatatatgttgattgagagcttgcacttcaatgacagacagaggtctgttcagttccttctcagccagtttctggctttttgaccttgggcaagttgatcagaatctcttcacctcgcttgtttggtctgtacgatgcagttaatccattattagaggaaataacacgtgaagtgctcagcagtgtctggtactttgttgtcattccataaaattgtggtcgtggtggccgtcttcagggctatgggtattgtggtcatttatatggaaggggcggttaagtggcctctcccaccggccaggcattgttgagctagctgataagagaagggattctagagccaggttgcctaagtttgaatcctggtggctctgccactaactgcttggccttgggcaacttaatctatgtgtgccttagtttcttcatctataaagtagacatgataatagtacctatcgtaggtttgttgtgattaatagatgtgttaatatttgtaaagctgttaaaacagtttctggcaaacagtgtctgtgtaagtgctagctgctgttatttttatttttattttttcactgtagatcagttaatttcttttattccacaaaataagtattcattctgtaccatatttctgctgctctttgaggaatggggatgtggtgaacaaaagagagataattcctaattgtatggagcatacagtgtcgtgggtcagacagacttagtaaaacctccactagttttctttcttttttgagacagagtcttgctctgtcacccaggctggagtgcagtggcttgatctcagatcactgcaacctctgcctctcgggttcaagtgattctcctgcctcagcctcccaagtagctgggattacaggcacctgccaccatggccagctaatttttgtatttttaatagagacggggttttgccatgttggccaccctggccttgaactcctgacctccagttatctgcctgcctcggcctcccaaagtgctgggattacaggcatgagcaaccacacccagcctctcaccagttttctaattacagactgattgtgagaagtactgtgaagaggacactgagaatcaggagatgactaagatctagagtttgcctttaggggaaaaaaaagtcagccaaatggtggagcttgtacacattagaagcatctgaggggagttttcagcactccacatacccagaccttactccagagcaattaaatcaacttcttgggatgggggaggtagtgaggcatcgggacttttgaagctgttcaggtgatgccacagtgcggccactttgagaaggagtgatacagagggtgataaccctgagcatatgggaggcaggtacagatagatacaagcagaatttacatatatttgtagattcaagaatcatgacagttgttcagggggtaatagataacggttattctggctccagagacctcctcaaggttatcacaagaaaattttcatggcgtctccacaagaccagaatcagagttggaatcagctatccctggttttgctaagtatggaatcatgtagacgccattgatttaaaatatccaccagtttccattttttcctgttatcttccactgctgcagtctctggaattattaactcatgccacctgaagtttttggaattaatgaattgcctagcctggtagctacattgttaggagaatattatgagacaaatccagttcttatcttacattattagttcccaaccattttggtaccagggactggtttcatggaagacagtttttctactgagtgagggtccaagggtgcagggttgcgggggaagaggtggtgatttggggatgattcaagtgcattacatttattgtgcactttgtttctgttattattaattgtaatatgtaatgaaataattatacagctcaccataatgtagaatcagtgggcactttgagcttgttttcctactagatcgtcccatctggtagtgatgggagagaatgacagatcatcaggcattagattctcataaggagcgcacaaccttgatccctcacatgcacagttcacaatagggatcatgctcatgggaatctaatcccgccactgatcggacaggaggcagaattcaggtggtaatgcgagccatggggagcagctgtacatacagatgaagcttcgtttgcttgcccactgctcacctcctgctgtgcggcccagttcctaacaggccatggaccagtactggtccatggcttggggattagggacagctgtataacatgaatgtgcacctgactcttggtttctcagaatcaacatataaaacattaaaggttaacattgtgtttataaattagttacacataaattgaatcccattgaaattttattaaattgataggcaaaattagcttgtgagagagagagagagagagagagagggagaaggaaagggaaggaatactcaaattctgtggttttaaattggcctttctatatcatacttcaatgatgttatccttccaggcagtatttcaggtttataactgtacacacttgcaaaagggaaacatttttgttgggcatggtggctgatgactgtaatcccagcactttgggaggccgaggtgggaggatcatttgagaccaggagtttgagacaagcctgggcagtgtagcaaaactccatctcgctctcaaaaaaaaaaaaggaggggaaggaaaatcaattatggggcagcggaagcgaggtgaacacataaaagaaaatgcctatgtaaagtcggtatgtcatagtgggtgatagcacctgaatgcttcatgctcagcaaatcatttgatttaaaggtttggaccacaagacatgtcttttgattgaaaacttataataggacatttcattgggctggcaagttacaggatctctttggaaatgtttaatttctgcatgtcccttagaggctgtccccttgagtgcctgcctctttggggatgtgctctcagaattgtgacagattcgcctttaatcagaacttccaaccagcacagcttttcttaggtggagtagaaactcaaagtttccttgccatttttgcaatgaagagaaatcactcagttttcttacaaatgaaaaacattttctttggtgagcccttaatgtcttgtttcagttaggtagggtttaatatcgttttcattctttctgttttgctaataggcagttgacttaactacattctcctacagtgtcaggagttgccaactcatgatttgggaactctgagttgtatgtagggtaatattttgttgatcacttatgccattcacttatgtgacactaatacaaaagatatgacattaagactacaatgcttgcatttttattcatttctgggaagcatgatttttcctctctttttttttttttagaccaggaaaggaaataagggttggagctggacactcacaccttgttggcatcatgagtgagcaattctgagggttgggaaagtagagcctacttatgttggtgttgtagggaccactatctccagagctagaaagagatgaaggcacaacccatacgcctgtggaaagctgggaatagggcttccctaagagaaatctctggagtttaaaagacttgtaagaattgtgaatgccctggacatgtgtatgggcattttttaaaactgcaaataaccaggacaaaattcagtaaagataaattaaaggaaggttgcattcagccagtaaagtgtgtgtttaaatttaaagtgaagcttcttaaaaaactattttaaaactttatatgtaacagtattttagaattacatgagcccttctaaatgtgaaagaaagcaatatcataatgcaagttaaatttgagcaaatataggaagacttggcatattcttctgaaagggggccaagtcatttatagtcaccaatcaaatcacgtcttgtctcatctctgtcagctacttggtatagccacagaaatctatagaatgagaccggcgaaaaagtagcaaataagcttcatttgggggcattattttgcggcattttatcacagtaatattcatctcttcaatatatagaaattaagctctagaaaatgttagtctgttagtgtattctttttctttctttctttcttttttttttgagatggagtctccctctgtcacccagtctggagtgcagtggcgcaatctcggctcactgcaagctccacctcccaggttcacgccattctcctgcctcagcctcctgagtatctgggactacaggcgcctgccaccatgcccggataattttgtttttgtatttttagtaaagacgggtttcaccgtgttagcaaggatggtcttgatctcctgacctcgtgatcatcctgccttggcctcccaaagtgctgggattacagtcgtgagccaccatgcctgacctgttagtgtattctttaaactcagtgaccacaagaagatgatgttgaccttgtacccgttttccatcactaaggataacagcagtagcctccttcagagaagagctgagctggcatgataagagaagttgggaggtgatgtgaatgataaactcttactccatttacttaaagcaagtggttttaattaaacacagtttatacctttatcgctgcacttggcaagttttgggaagttaaagactggtggtactgctactcggaagttatctgtagaaaacagccttaagtcttttccaaacaaaatatcattttaaaatgaagttgggtcaaaattcaaataaaactccctctaaaatgaagtgtgcaatatccactcttaatgtgtgttgtatcgtgtagtcaaaagactcttaatgattgcctgggaggttggtacagaagggatttttatttttaacagtctctaaaacacaccttttaatactcattctttttggaattctaagttaatttctattcttcatcactggtgcttttaaaaaaaaaatcacaaatttcagaattaagtgtctgagggatttatttcctaaataattgagctccataatgtaatcctttacaatagtcattacaaaggatttggaatacagaaaagtacacaaataaagtcatcaagctaggtgggagaaacaccttagtccgggaggtcaaggctgtagtgggctgagatcacaccagtgtactccagcctgggcaactggagtaagaccctgtctcaaaaaaaataaataaaaataaagtcatccataattccttagctcagaaataacaactattaaaatttgacttatctacttccagtattttcttttcatttctgtataaatgcatatttttaaaaattaaagtctagatcatactgttttttccacttaataacatactgaagtcattttatgacatcattaaatatttttctgaaacaagatttttagtggccattttattttccattatatgattacacccttatacttttagtcatttccccatgtttaagatacttagctgccttcctgtctttttgctgtcaccatcatcttagatacgtttagtagtatacatttataaatggaatttgaagtatatcattatccccactccagcccgccttggagacatgggactacattgaatgtttgtttttttaaccctacacctacaagttggaagaattttattttttgctatccttccctaaaatagtcctctggtgaccatttagttaattaagattgattggcttctgtcatctgctgaacaatgcattttgctaaatgatcccaaatattaaataaaaacctattaacaagtataatagatatttagacattaacagatggcttcagagggtctgcatataattaaagtaaataaatctaagtgtaatagtgacagttgggtaaaaataaattattttcatcaagaatatttcattataagataacccagaaaacagccattgtgataaaatgtaaaaattatagagtaaaatccagtatatcatgtaatatgtctatgattaccagattcctaatctagatctaacacatgacactttgtggttgctacagacttcattcacatccagcatgaaaggaaacatggtcttgttttttaaaaaaatattttttaatgtacaagtcagtagtaaaatatggacatgtgaattttttagacatcaccttttccatgtatagaataaatgaacatcactgtgttaacaatgcctcaaattagagtccaagaaagaagttgtttgcttgttcctattggactcattttatatgtcttcatggatggacaaagtaggaaatcaagatgaaactagatttgatttttttttcagtgattttatccatttataatgtaacatcaaattatttttagtaattttatgaaaataattgtcttaaaacaaggtcattaaggactctaaacataggaaggtgtatgcatatatctaatatgttttctttaatcacattgtggcctctggaggaaacagttctttgtgtctacttgttttctcacctctcacgaaactactacaaggatgaggagagttatggatgtggtttgctccatgaaagcatatttagttggccttggtgagtggagctgctgggtttggttaagagatccagagcccagccatgttgtccgttctctgctaccctcaggacctggctgaggggtaacacagaccaaggttctcccctaaaactggccaaattaatttgccgccttcttcttcttcatcatcatcatttctctcccacacctttttgtattctcccccagagaaggctaggtcagcctagaccagaccagttttagccgtttctggagagttctctgtctttctctctggctactttccctgtaactgtagaagaatgaagttttctggtttcaatagagtggtaagttaaggagcttgaatttagaggggctgcagttgggtcatggaagttgaaaaggcaagtgtgatgtcctaatgtcattaacttaactgggtaaagaagccctcaacccagttattctgtcttacaaagatttggatgctctcacctcagctgataatagaggtcatattgcctagcctcactttgcttgtacatttatttccctcatcacccttgtgtggcagcctcataatcacggctgaagccttcagacttcccagggttctctggccaaatgccatttgaataccatctcaattcaccagtaatgtgatttaaataatcatttctccaataactctttcttatctagaggatacacaaaaggaaacaaaattgaaatgaacaccactctgatcccaacagtgttagcaatattttctatcttctccaagtttttctctttgcagtgctcctgtgggttcttgctctagtgtccctttttgcgtaacccatcaccctcccagttaacaggcataacagaagaacggggtatttcaggtctgtaacagctgtgcttaaaaagcagcagctcccccatttcacctgtttggtttgtagggcaaggatagaaaggatggcagtgggtatctttctatctaagtggtggcaactgagaactctgaggcatttatcttaactcattttctgcggctataacaaaatagcacagactgtgtagtttataaagaaaagagacttatgtggcttacagttctagaggctgggaggtccaggagcatgatgctagcacctgctcaaccatctggttagggcctacttgttacattatcccatggcagaaagtgaaaaggcaagagagtgtatgagacagagagaaaatgggggctgaacttatctttttatcaggagcccactccagctaaccaacttttgcaataaagacattcatccatttgaggatggctatgccctcatgacctaatcactttttaaaggttctgcctcttaacactgttacaatggcaattaaatttaaacatgagtttgggaggagacattcaaaccattgcatcattgtagagaaaagcatgtaaataagaaaatgcagttacagactcagcagtctgaagtatacgagagaaataagcagaggaataaagcagaggctgaagtataagaagctcattatgtgcacatttttggctaacttgggcctgagaataccacatgaaatgtgaaaagttgatttaagtttctcatttgaactgtgtcattcttttttacattttttttagtttattaaagttagttacattctattccctgaattagatcagatttatgtatagaccatacaattaaactcattgtatgagatgtaaagtttgaattgagaaagttaattccttggacaacatttttttttttttttttttgatatggagtttcactcttgttgcccatgctggagtgcaatggcgtgatcttggcactttgcaacctccacctcctgggttcaagtgattcccctgcctcagcctcctgagtagctgggattacaggcatgcaccaccacacccagctaattatgtatctttagtagagatggggtttcaccatgttggtcaggctggtctcgaactcctgacctcaggtgatagggctgcctcagcctcccaaagtgctgggattataggcgtgagccaccgtgcccgggccataatcttttttaaaaaattattattattagtttgagacggagtctcattctgtcacccaggctggagtgcagtggtacagtctcgtctcactgcaacctccgcctcctgggttcaagtgattttcccacctcagcctcccgagtacctgggactacaggcacatgccaccacacccagctaatttttgtattttttagtagagacggggtttcaccatgttggccaggctggtctcgaactcctgacctcgtgatccacctgcctcagcctcccaaagtgctataattacaggcgtgagccaccgcacccagccaaaaaaaattattttaaaataaagtatagctaagaacttcctagtcatgtgaggcctagggtaaaggttgagtttcccttcagggtatcctctccttgatctttaagaacttatgtccagttaggttccccactgatttctcctgaatctctcatgacagtcacagtggccacaaatctttcttccatccctttgtttagctcccgctgcttttgggatacagctcaaaatgcttaccacagcttataactctgtatgagctagcccatgcccaactcgccagcctacctcatgcccattttatacatctgctttaatttggttactaatcttttctcccttcctagaatgtatgagggcatctccatcttcaagacttcgactgagctgttctttctgctccagactttcccttctcatgtttttctttcttcagcttactcttcaggtcttagctgaatgtaattatgcagagagccttgtacgcactccttacacctgattgaaggcaggggcatgttcctcgttaggatttctcaaattatactctttcttgtttgattatgtagtcatacaggtaattttgtattcagctctgtttccgttatccattgcttccttaataaaccaccccgaagcttagtggcttaaaaacagcagtttatcactacctctcatgcttcagtgggttcacatgactaatctgagtggcccctgcttggagtctgctatgcagctgcagtcattggtggatggagcccgagccgtgtgatgactcaattgggctggacacacaagatggcttcctcatatgcctggcatctcattgctccttggcccatctctttttctttctcttcacattccatctgatctctctgtgtagtttggccttttcatagcatggtggtctcagagtgatcatatatagtgaatggctcccaagaggcaggaaatggaaacttccaggccaggactgacagtgtgccatttctgccatcttctgttagagcagttacaggtcctgcccaggttcaaggagctggatggattagagaaacagaccccatctcttaatgtgagaatggcaaagttgcactgcagaagagtgtgaagcagaaaatattacaggaccatctttgaaagctgccctactttttctgctagactgtgcccttcatgaagacagggtccatgtctatactatattggcacctaataggtgctgataattttttggcaaattcctaactccagggaaaagtcttagacaaattgaagattcgctcagaaaacaagtttgagtgagttcgatttttttgcctcctcagaggccagactccctgctctacctcctcaacccacacatcatacagaatttgacaccacccggcctgcttttatttcacacttttgcccctcttgtagcactcatttgggcatctgtattatggctcttttctctcctattcattttcacaatagcatttctcgacagcatgcattatattattcagggtgcttagtttggtgttagaccatgtagttaaaaacatgagtaagccttgattggaattcccgctctgtttcctcttacatctgtgactttcccaagtgagttaactcctctaagtctcattttttttttcctgcctgtgaaatgggtatattaatagaaacaactcagcagggttgctatgagtattaaatgacaggataaaacatatacgtctcctaccatattacatatttaattattattcatttccattaactcttggttatggtgttatactgatctggtagtcatttattagatatttgttgaatgaataaatattttatagttttcaaataatctctttaaaggatatcctatcctatacttgttcaaggtaaaattgcagtttaagtttccaaagacatcattcttttactaaaaccctatttgaaaagtctgtcattgcaggcctttacatttcatcttttttccacgtgaaggcagtggagcagcttttttctcgcttcacctgtcaaagttgttctctctagagattaagcaggtatgacgtgtgctttgaccaaaccctttgagcttaagaaaattgtgagaaactgaataacttcctattcctcaatatttcaggtgagaaaaatatactagagctgctgttttgatgtatgagagattgtagctagtatagtaaaagatttcggaggatagttattgtgtatctaggtgtgtttatattatcaatctcaagaggtaagagaaaacacaaagttgtagagaacatttagaaattctcctgaagactttataggccagaggtcattaattagtaaggaaggtcttggtttctgtattcatatcatagtggaagttccgattctcaattcttaattcaaaacaaattaaatattcctacttgtcagaatcctgacttgtatctaaatgttctattggactagatgtaatatacttttcccctccagggaaagatagtcaaggatttatgtgagaaagcaaacttcctaatggctgcctccctttgtaagcagtaaagcatgttatatctttgtatcttggatgttcagctggtaatatttcataccttactgtccatacgtttcctgatagtaatcaatccattttgtcgttatcacacttgcttgcactgtggctgggcagccactgtctaccaaaacagtagcatttcctcctggagatgagagtacttgatcgaaagggagaaaagggagaacaagacccaggttttgccatataaaaatcgatagcgacaaacttcagtgtcatctcatcttgccggatgccatcttgatagcatgactgcttttccatgttagtaatagcacaacatcagattaagcttccctcacaagacaggggatacactaagtttatttttactgcctaaaaagctacaaagccagttagatagatggaggcagtcagccttgatcaaaccagtgttctacaaattccttcagtttacctagtatgttaatgcccattttattaaatccatctttttaaatggatgtaaaaatatgaccagcataaattcttttttttgagacaaagtctcactctcacctaggctggagtgcaatggcactatctcagctcactgcaacctctacctcccaggttcaagcaattatcttgcctcagcctcctgagtagcagggattacaggcatatgccaccatgcctggctaacttttgtattttcgatagagacggagtttcaccatgttggccaggctggtctcgaactcctgacctcaggtgatccacctgcctcagcctcccaaagtgctgagattacaggagtgagccaccatgcctggccaattttttaaagcagggtatttaagcagatacaacgtaagggctgtgtgtgtcattaaaagagtactgcttggtgagaaatgaatgggaattcttacagctgggtcctgattcttgctctgactataattaaccatataataataggtcattgtttctcaaacttgagcatgtcccagaactgcctgaagggcatggaaaatgctgattgctgggtgccacactagataattttctgtggtactaagaagatagtaaaacaggatgataataaatatgctagggtcccagatgccatcaagacaagattaaatgtgcaaggattttatcagcagaaatccctttgaaagaaaatgagaaagcagccaggagaggctggcctggccatcagactatgatgcaggtctgactctgagtgaaggagagagggaaggaagattggatgcccctactcggctgggagcagcccaggggaagcatagccttgcccccagtgcagccagtcatgctgcctgcagttcagagtgtgaggtgcattctcaggaccttagcagtgagacagcaattgctgtagatggggtggccagagagggattctctgaggaggtgacatttgagtggagacccgaatgatgtaaatgagtgaaccttgttgatttggggcaaagtgaaaagagcagcggaaaagcaaaggcaggagagagctctgagtgtttcagagcagagtgagcgagaaggactgaggaggcgctgagagtgaagctgggcccagctctgaaaggacttgcaggccaaatcaggaagtttgaattcattctggataaaattgtaagcctctgaaaggctttaagcaccagaacaatgaaatcttagacaaagataggagtacgcattgtggaaaaggaagagaaaacagagactagttggagactaatggtattagtctaggtgtctccaaattgcctccatttgaattacctactttttctccatgcctctgggatcttgaagatacagtggctatcttcttatatcagggacataaccacaggtgccctgctttcttttgccctgtaatgtatttcaggcaatcgattgtcaagcccctcttccgattcgtcctggcagctctcactcatcatataacccatgtcactatgccatgccctctttgagttttagcaccatgctggcagctttcatagacttttaccatcaccttcaaaccagttgaagactgatccaccaatctcatttctacttctatatattgtctcagagattacaagcaactgatttctaaaagacaaagtaaagtagggcatctgttaatatatggaggtcacttttagagaaaaacaaataaatggaatttgcctaaatgtgattaataagaatattttctcgttgtgacagttcctatgcttccttttgcccacatttttctctcagaagagtagcatgtaagaaagtggaattataagttttgacttggagttgaaggagtgtagacatctgcttcttttctgaccactctggtctgccttgattgagggagatctttgagactggctttttgctgtgcattttgattgagttttcagcagcacagtgagtatgtaaaatcatagccatgatggttgaaatttggaattggggatgtcccatttgaaagaaatgccagatcaaaaagcgctattcccaggaaggatgcatacacacgcttgtaaaattgcacacccatgagggcttcttactttcttagagctgtgaatttttctgtttttgggcatgtgaggtgctcttgctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccccagtcaactggattagggcaatattttccaggctaacagtatctaaattaaatataagtggggtaccaacaggaactcttgagagagaacaggaaaagcatggccccataaacaaattaattcaagaaaacattttatttagatactcttctccttatttattaagaaagtataaattaggtaagcatttataacaaaatatataaagataaatgtttctgttattctacatcctttgtcatagtttcctttttaaaagataaatttctgaaagaaaatgattctctgtgtctgcacatctgtatgtatgtacagatattattaacacttccaaggcaccagggttccttgggccatactgagaaatgctgacatcagccatcagtgccccaccctgctttaagacagccagcaacaagaatggtaataataaggaattaacattggtgagggtactctgtgtgtcaggcaatgtgcagaatattttctctgtgtcagtgtatttctgttttaaaatccagaaaattttcaatgacattcagccaccttgttaagaagacagtctcagagagggcctgtaattacttcatcccctatttttctttaattaaagcaatcaaatggcagcagcacacggtcacactcaactcataggacttgctttttgtgcattttactgcagtttctgcccacaaacttgatccctgaatggaagaacacaaactgtattttctctattttcacaccacaatagtcaacacagaagacttctgtgatcaaatgtgtggggggttttccccaccagtaagcaagcaatcaattctgcagcagacactagctgggcatcctctatctaaattcagttctgacactccacctggagataatctcagatcccacaggttgagggctcagtcccacaaaaccacgcctcacttccgatgctgattgcaagctccaggttgttttacctgtgtttctcaccaaccggctataaattgggtttcccatgacctcttccttgggttcaattcatttgctggggtggcacacaaaactcaggtaaatactaacttatgcttactggtttattataaaggatgttacagaagatacagataaagaaatgaatagggtgtggtatgggaaggggctcagagcctctagcccgttcctgggcatgccgccctacagaaacctccatgcattcagccgtccagaagctcctgaacgccatcctcttggaccttttatggagagtccattggatgggcatgattgacagccattttgaaatgtgactagacaaaaagggtatgatctaatgctagtagactgagtgggaacacccagaaaggcctgtctatacagatgcttcttggcctctctgtgcagcattccttcttctgaggtatgacacaggaccccttcggaaatgagggtctaatgacccataatcagaaaagtggggggagattagagtatatttttagtttctaaagcctgctgtgggaagaaaaaggagcaggtgaaaggaaggcaggagaatttcagagagagagagagagagattgttttttgaggtttgcttctgagacctaaagtgccccaacattataacaaaaggctgtaacaggagctgtgggagttatgagctaggaactgtggacaaaaacatacatatatatatgtaaaataataccacaatccccatttcctgcaaactaaattctgaatttctgagtcagagattcagaagcttgtatcatccggccccgcatgaccttacctccccttgctggcatgatctctaccatctgttccagagacccttctcccagaatgttcttcctctccctcctcactttgcctgcctgttatccctttctccttggaaatcttcccaggttctgtgaactggggcgggatggaccagatcagctgttctcagctgggggccatgctacctcccaggggacatttggcaatgtctagagacatttattattgtcattttggagtgggtatgctactagcatctggcaggaagaggtcagggatgctgttcaacagcacacaaacagctcaccataacaaggcattttccagcctaaaatgacactagtttccaggttggggacccctagatactagatgaaaattctagtactagtactagtactagatggaaggtcctccttttctgattgatctctgttttcccagtacctgatacataatatatgattccgaaaatattaaatgcacaaaccccttccccctcagaatgccatctttgtgcttcttccaataccgttatatggaattcgaattacattttatgtttttacttgccagaatacaagaatcacttaaatatataatctatactttcaagacttcaagcagatttatggagttggcaacagaaaatgagaaatgagttggcttcaatgcactgttaatgttgagaaccctgagtatcgtttggagcgttaaactcatgcatgctgtgggtaaattgttaatggtcgtatttcagttttctttatctcagagcttggaagagaaattttaaaaggcattttcttaaaaactcataaaaagaaagagcagtcccttgtcatagagttttaaatcctgcatgtaattggaatgtctttcagcaggaaaggtacgactcatgaatgtcttgggtcagagagtacactgggcacttgggcagtgaacctgagtgctggctctgtagtgcagagacgttagacaaattatggaacctctgtctctccacttcccctccccttctttatatcttatcagataaaccccagagaatgctcactagaatgtttgcattgcctatattttctccaactggtagtgttgggaatgattttttactctcttctttactgtatagttttaatttttccttcccagtgggcctgtattgtttttactatcagatcaaaatcagtattaaagtatagagcgaggatgagaagctagatttcctaagtccttttctggccctgttaggatttttataataaaagtcctaccattgattcaatattacagtgaattaaagcactccgataatttggacctcagtttcctcagctgtaaaatgtgatattaatgacctcatcaggggaatgattaacaccagtgtgatcaagagggctttgatggaattgcagttctgtttccctcctgaagtgtatgaccttagaaaagtcacttcccatctctgaagtccatgtcttcataaaatggagttaatgaaaacctcacaaagttgatgtgaagattgatgagaataaggtattatagcactcagcacagaatttggtgtttaataaatgacagatactgctgttaatttctgctatcattattattgtcacttttattgtactatcatgtgattattgtgtgaaccagattgtaacttttacatagaagtttttcagatttaaggtgttattaccactgttattattcttagctacacttctactactggaaataataagacttcaatcagtagtgatttactaccaagaaattaattggtataaggcagggcctactgagatatccaatatcaatttttttttcttccttaatagtagaatctcaacaaaatgtcaattctatgatattgttccacctccctttcagctgggtggaatcacgtcactgctttctggccagtgatatgtaaacaaaagtgtaatgtgggacctctggcaaggctgtgtttaagaagctgaagcagctgggaagggagcccttttccctgctcctcactgttgcttggaatgactttacaatggcaggggctccagcagccctcttagactgagaaataaccttagaacggtaccattgcatggtagaggagacaaaccaaaggcatctgagttcctgatggactcctggtagcatcctaccatcccaggcctatctaccaccagtgttcctttatgtaagagaataaatccttgtatgtttaagtccttatatttatttctttgttcctagcatccaaatacaattctcaactaatttatttagtcttggtgcgaagagctttggcatactttctctcatttaccatggagtacttccaatagttctgttcttccctggtaaatttctttttcattatatcacaaataaacaaactgacccaaatttaaacttgacccttgagcaaatcaccaagcaaaagccttcataaaaagagtaaagaaagacacatggatgtttttcttgacatgcattttaggcttgttttgaagatggaatagttttagggaatggggtaattggcctgggaagtagatttgctgcctgcctggtgttttccttccaacagttggtgatagcatgaatcttgtgggttttctgtgtacattgactccagaaaggtcatagagaatgttgttatttcagaatacaaagagaactaagtgtgtttccctctacttaaatgtgcttcgtcaagcaggccacgttagcttaaatagttgagaatgaggaaaacgtaaaactgtgataacgaattcatattaaaacacacacacacaaaacagctgccctttgaatggttcactggtcaccaagatcagaggcaggttgaattaagagcatttggataattgaccttccatgtgaatgaattagaatagattagatttgattgaccacataacaatttaaatcataaaaaagccccttttctctttccaggctactttgttatattgggtctcaaaggtgattaaccatgtgtttttcttgttggaagactttcctgaacacaaattagcagactgaaaaagagatggtaatatttacatttgccatttcttttttaattgaaaaactcaaaggaccatatgacagactgagttgtttaacgatattccagaagggcagcatacttggagtgttttaatatgcattcagccgtctcttcctgactggtggggtggttcctgttactcagatggcctgggcagttgggatgggatgttctcaaggtgcttttttcccctccgacctttgctagtgtgtgtgatgtgatgtgttgaaaaccactgtataaacaataagcaccggctactcatttagagtcatggaatttcagagctgaaaagaatcttagacgttcagtgagttattgactctctttactttagagatgatgagacacagtcagtaataggaaatgccccaccctcagatgagaaatggaactgctgtgtgtttgataatatacagaattgttctcatgcagtaaagccctaccccctcgacttattataggaggcgttattcaaattggataaatgcttctgtagaaggatgatattattagtgcctatttcttagggttgttgtgagattaaaatgagtcaaatgtctataaagcactgttttggttattatttctgcatagcaaaccaccccaaaacttgatagaaccattttcttatgatttagcaatctggcctggggttaggtaggccattcttccactgttcttgtcagtgttcattcgtgtgactgcattcagctggcaggttctgggaaggcgggcctcttccctcatccccagttgttgaaggcccctctgtctccatgtgatatctccaaagggccccttcagcaaagtaaccagcctccctatgtggcccttaagcatctgagagggcaaaggcagagactcccaagccttctcaaggcattggcctgaaactggttcagcatctctgctgccacattttcaggactaaagcaagtcacagactcagccaggatccaaagggaagggactatgcaagggcatttataaacgttgacaaggttcattatagaacaccattgtaatggactatcccaagcatgtaccactgtgtctcatgcatggtaaaggtcccataaatgttattgctctcttgcagtatagtagtaatagtagtggtagctgttttaggagtaaaaacagctaaaaaaaaaaaaaaaaaaaaaaaaagctgcttttgttcttttgttgttataagtagatatagatggaaaacaatttatatagttttaaaaaatgaaataattttatttctgtatctcttagtttaaataacaccactatccacagttttcctcgggcatcttctgtaagtaggagggtagaataaattcctttaatcagtaattccccaataagttccccaattccccaattcaagcaggtctgagttagggacagagattctgtacttctaataattgtaacattgagaatcataaaattgatattattcaagttataaagttaatttctgcacatgtttcccaccaaaattgttttacatttccatgtatcactttagagcatgacatttttaggagaaggaaattgaaaatctgttcttttcttttgaactgattccttacctgtttccggatacatttaatgctgaagatctggagaaccatactagagtctacaaactcagaggcacaggtcttaaccattagcagcacccaaaaatggagattggagagaggaaggaccattctttcattaagagcaagtcattagattgtcttatggaggatatttggggtttgcttgtgatgagccttccatgtctaatgttcatacaatgttattatatgatgacttgaatgtttttctttttgctaaagctctttatctgtctaattacaaaaattatgcattcataatttaaaattttcaaaaactacataaaggtataaagaagaaaaggaaaataacctggagttgtttatgtccacattcatattttggtgtgtatcatcccagacttcattttaatattttccccctaaacatgtttttctctctggcaaatatgtgcatttgcttttaaatattcagagctgaatatcctcaagaaagtttcaagtttagctgttttgcttgagagagataccgtgatgtatttttgctaatatgttttaaaccttgcattatttatagtttctccttagaagcttgaaattaaaatttcttttctaactgattttgattctttcctgtctggcttacaattgatttcacctcgctgtgtttctaatgaagcctgaaattaccatacccttgtttgagttgaatgtgtttttccctatgccctcacataccatggatcacagggcaactctgttcctattatcagctacatcttcctttactatctatattcaattcagtgtgttccagtaaatcttccaatgagggcttataccgggattgaatagacaaacatgtttttcagttacatttgaggagcattgattttctccatagagggacctattttttcctttcgctttgctgatattccctaagacctgcctatgttatagcccttgcatataatgggccatatatttttgacccaattaattttttatttgattggtaataaaggaagagagtcctatgcagtataatttaagatattcatgtatcaagggaggaggaaggccaggctgaatcccggaagtcccacctcactacccagacagcaatcacatgattccaggttgaaagggatgctgaaaaatattataaaattgacattctgttgagatactgccactaatgaaagaagaattaacacttggtatcccaatagtctctgccttatactgatcaatatcatgggagtgaatcacccctgattgaggtcttactacttccagtggtagaattaaatataataacagtggtaataatacgttaaatttgaagagccttgggcacaacagtgccccttaccccacatatccttagggcagggtgatggaggtaaagacctggaatattgtggtgttcttgccgggattgaaacactgggtagtagaacaaaatggaaaggcctaccctttcagatacccatatttgaaaatctttattcctcatgctttttcactttctctgccatattccctaagaagatctttgtcccatcagtgttttttttttcctccacccagtacctagagcacagtacagtgaattttgattatagtgtttgtgctaacattgagaattacaaaattgaaattgtttaagttagaaagttaatttctgcattctctccccatcaaaactattttacattgccagtatatatcactttcaagcattccatttttaggagcaggaagaaatttaaaatctcctcttttcctccagtctgattctggaaagtaggctccctttttagtcatgggatttaaactgagttggttaggcaaacatgaaagatgcttatggtgatttatgccccacatcacaagtgtatgtcaagagtgaaataacgcctgatgtgcaggaggatggaccagaagaccctcacttactcaaagtgtgaggaggatgggccagaggcatctacaatgtcctttttgccttaatccacaaagctcagtttcaagttatggatttgaaaatacttgctacaattcagggacaaatggactaaaatatatatagaaatagaaaacttgaaataagtaaatctaaaacactgaatatgtgaaatagaccctaagaactacatgcaatgtgtgaactttgaatggatactgctttgggtatgtgtgtctataaaacattcttgggataactgggaatatttcactgcaggctgcatattagatgacaataggggaattgttcattttcttttttttttttttttttttgagacggagtctcactctgtcgcccaggctggagtgcagtggcgccatctctgctcactacaagctccacctcccaggttcacgccattctcctgcctcagtctctcaagtagctgcgactataggtgcccactaccatgcccggctaattttttgtatttttagtagagatggggtttcactttgttagccaggatggtctcgatctcctgaccttgtgatccacccgccttggcctcccaaagtgttgggattacaggcatgagccaccacgcccggcccattttcttacatgttgtagtgtgattaggacaatgttcctatttttaggagatgcatttgggagtgaagtgtcatgatgtaggccactcagtatgaaatgcttcaacaactatccatctatctatatatgtatagctacatatatctctatagagatagatatagagaggaagagagggagaaagcaaatatggcaaatcgttaaatactactaaaggtaggtagaggatacatgggtaggctgtataattatttcaccttctctctattttttttttatatatttgatgtttttcttagtttgaaaggtaaaaaagtattgccttgtaaccaccagtgcgaccacaaccctatcctttactctgttcctggatctcaaaccaatttttcatattatttattcaacaattactctatataccagctactgttccaaatcctggagatatataaatgggtaagatgtcgtccctcgtccctgtacttaaagagctcatgatttagaatgtttcttttgcaatttttgtgcagctctgtcaacttcttatccaacattgggaatgaacataaaaatttacatccacttaggcctaagaatattttaagcaatttatattgatataaggctgtcatcagtcagcctattaacttctaattttcttgaaaagttttatgtaagaacaataggcagtaatggaatatttaagccatttgcacacacatacacacacacaaaatgcacgacaacgacaaccttgggggtttgcccaagtacatcgtggcattctggttatatctagatatatttctggcatacacagctagaattatgtttcaactggatggtcacatttgtaactgatacacatgtgaccagtgaacacagtagttttcaagaggcattgccttcttgggagccaaaggcttgatgtggcccctctattaaggaatatcaagagtttcccactacttgaaaataactgcattggaagattgttttcttacttcctgatttgtagcctggtaaccagtaaggcaatacatatatatattcatgctaaataattttgttgtgttctgaatgtttgtgcccctctccccaccattcgtaagttgaaatcctaaccctcaaggtgatgatattaggaagtggggcctttagcagttgattagctcatgagggtgggctctcatgaatgtgattagtgtccttatgaaataggcccaagggagctccttcattccttctgccatgtgaggacacagcaagaaggtggcaccacctgtaatccaggaaacaggccctcaccagacatcaaatctgttggtgcctggattgtgatctttcagactccagaactgtgagaaataaatttctgttgtttataaactatccagttaatggtgttttgttttagactatcaataagaattaaaagaaaatactcataaaaaaaaaagaagtctgaatgtactgaggtaattttcttcatattattcctgtgaaaaggaaaatgctcatataactcaaaaatcataatatttgatattcagtgttgtagtccttgctaatcagctgcagggtaaagaagagaaatatgctgaagatgttgggcacgcaaaagagatgcatttcagggttataattaaagaacttaaaggagttcagaaagagaatgggaaggtctactttagaccttcatctatgattacattgaaaagaaaataataccagaggctcctttaaaacgtgcgagattatgcagtttcaaaatgcagtgcaatggctagaagattcttatatgtgttaccaagatctgcaaaattaaaatggtattcatgacttgtaaacaaagctactaattgaactataatttagaaatgcggtcctgaatacaatttcagtcacagaatgacaattagaggaatttattagatgttatctctgatgcaggggagtgtcttgggttggatttagtaatctacttgctagatgctcaataaatatttgagagggaagggcggaaaggaggaagagtgggaagggaggaagagctaaattggatgtggattgtttagtaaatttgacaaggaatttgtggtaacttgagctactaactgaaacttacctgttttctacatattagaaagggtttaataaagaaactaatagaagtaaaagtattcttagtctgttaaaagtattaatcattactggctcattaagcacctcaaaagcactcattcacataaaatcaatgcactaattacaaaccagtctcgtctttgtaaaagcaggcccaaatttttagaaaatatttcaataggcataattcatggccacacatggaaaatacttgaaacttacaacctttaaaaatattatgataacttatgctttttattaatgtatgttttattcattccccaagttaatataaagggatgagattttcttactaggcaacataaaattggggaaaagaattatgggagttctggaacttagatattttagaagcacatagagagtttttgttttttatttgtatttgtatttctggagaggagttaatcaccagaagttatttttttattactctggtgtgaggcttggcaaagtatctttccacaattcctagatgattctagggagttgacaatgaatagattacatggagtcagttaacctggcttctaatgcagatgctcacacatttttctgttaccttcaacaactctttcagttatcctggtcctcagaatactcatgctttcattgacggggttgggctatggaaattggcaaacactacacatcaggttcttccccagcccccctcttcccttgtaccactacatcatagattatattatctttaaagtccattcaaactttaaggctgtataaatcagtgatcccttatttcaaaagtaattatattacagacattctgagatatttaccatcttttaaaattaactccaactataattgccgccccacccccaccagaagtaaaaagtataagaaaggggatgaaaatttgtatctatgaaaatagtcattgtggtagaatatccttccattgatgattgagctgaagaactcaagacaccagaaaagagataactgctaggacaacaaaatgtgaatttgcctatacctagcctaaacatggtggtgtacctcccttgaggattatttaacatctggttgatttttgttttgtcactcttttctgacaactgtacgtgagaaatagtctcattttggttgtcttaagacttacttacgaaaacgaagacctaatatttcagttagtttatcaaatgtacattttgaccttgcaaatatcgattcatttatttaattcttaaaatacttgagcatgtctcatggaggaggtggcatttgagttaggtctaaacagatgagtaaagtttggatgaaggaagtgtaggaaatgtattcaagcagccaaaactacagatttagaattgtgaaaggtgttagaagaaatgtacatgggctgagtggaggccactgcaaaaattggacagtgtgttgagttgttcagttataagacactgctatcacttggtcacctataaattgggaataataggaaggaagaccttcctcatagaactgttttaagggttttatgagaaaagcaagtgaaattcctaggacaaggcctagcacagagtaagccctcaataaacgctacctgatggacataccatgaggccaaagaagtgaattagggccaggttgtgaatggcattttatggcaagcagagttagtttagttttgcacttatgtgttagggactagagataaggaagaaagatagccatgggccagatacagtagcaagccttctgggatgggccaaggcctgggaaatgatgttgttatcttttacaatagtctttccaaaattgtggattgggacctggtgattcttgagagaactccctctaggtagttaaataacaatattaaattaaatagccttgatttctccatagaggaatggatagaaagatgatgtctgaaaaaggaaatacagcaaatgccagatgatagtatctagatgatgggcatataggtgttcactgttcaatttttttcaacttctctgtatacttgaaaattttcacaatacagtattggggaaaattgagaaagtgtattccctctttagttctttttcaattccagaaaatctcaagaaagtctcttggtgccaatatggcttaaacactttgctttggctcagagccactggcagcctgtatctagttacaatttaataaaactattgtacattttcccaggtttggtagcttgagcctgtaatttcagccactcaggaggctgaggtgacaggatcgcttcagcccaggtgttcgagatcagcctgggaatcatagcaaaacctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagatcagcctggccaacatggcaaaaccacatctctactaaaaatacacaaattagctgggcatggtggcacacacctgtagtcccagctactcagggggctgagcgtgaggattgcttgaacctgggaggtagaagctccagtgagcgaggtcacgccactgcaccccagcctgggcaacagaagtgagactatgactcaaaattaaaataaaataaaaataaaatattcagcaaatagcaaacagatagtgtgcactgttgtggtaaaaaaaaaaaaaaaggcagaggtattatgtacatgtctgatgactgctataggaaaaggaggattattgaagaatttgaagtaaaggactggactaattgttttggaagttaaattattcaccctctgctctttgtatgactgcagaatgaatatagagttttgggcttttatagttcctctagtcactgttaaacttcaatatgtgacagtgactgcctgtctgcatgttcagattttcttcacaagcctatgaaagcaaagatcccagataaagctcataggctttctagtgcttaagatgtggcactctttacttgcttttggaaaacattcacatatttcctaaaggggcaagagatatatattcttgaaataaaatagagccacttaatcagagtggtttgccaaaggggactgcctgtggattggattttaatctgtctgtcacagtcaccttttctttttagaatgttcttaatagaatttagaaaacaccataaaatacctcacttatataaagtaaatgtaaaataatgtgtttctgtgaaagcaaaaaagcaagaaatattcaaattcaacagtgtttttatattacttccatctgtctattgttacaattctgtgttcattactatctcaatggaattcaaaagttttttttcactaccagaatcaacagtaataatgataagcagtcagaataactagactttacccactaaaagaaaagaaaaaaaaaccttttttacacttgattcagaaatagtgttttttcatgcagtttaaacattgtaaaagtgtattgtttcctagtaccagctatatgtccttatgaactttcatatttctgataaattgttagaagtaaaactgctaaagcaacatattaatattttaattgttatctactttttgaaacaaaaagtagctggtatctcaggtactcctgaggtcgggaatttgagaccagcctggccaacatggcaaaaccctgtctctactaaaaatacaaaaattagctgggtatggtggcacatgtctgtaatcccagctactcaggaggctgaggcatgagaatcacttgaacccgggagcagaggttgcagtgagctgagattgcaccattgcactccagcctgggctacagagtcagaatttaagtgtgactcttctctgttccccttctgatatgtttacatgtctcctaatttgttctttaaataaatggacccatcatatatgtattctgtgacttacatttttacctaataggtcttagatttttatgttaatacaaatgaaactatttcattcatttttatgattgcattccataaaatgaatgataatgtattaccaagtcccatcttgatggctattaagttattcatagttttttggggatttttttcatccagtgaatatcatctatatatccttatgaacttttgtatttctgataaattgttagaagtaaaacggctaaagcaacatattaatattttaattgttatctactttttgaaacagattttctcagccgggtgcggtgggtcatgcttgtaatcccagcactttgggaggcctaggcaggcggatcacctgaggtcaggagtttgagaccagcctggccaacatggcaaaaccctgtctctactaaaaatacaaaaattagccggccatggtggcacatgtctataatcccagctactcaggaggctgagacatgagaatcacttgaacccgggagcagaggttgcagtgagctgagattgcaccactgcactccatcctgggctacagagcaagactccgtctcaataaataaatgcattaataattgtctcaataaataaataaaatgggacaaattttttcaagtttttatgaactttcttttccattggcaaatatgttgatttggaatatagttcattaattacccaatacttctgttgtgggagtcaaagcttcctcctgaagtatcttgttcctgttttctgtatccattcagtgtattgtattctgcatttctcctgccctccatgacacacatttttccatttctgtacccccagattgtgggcataatcaaatcagagttgtactgatttttgtagctacctgcatctatcccaatgcctgccatgtaataactgctcaatgaatattgaaaagatggtaggaaaaaaactcattcctacacttataaaatcatattttctatatttaaacagtcactttttggtaatgacttgataagacattccctctcattgttggggttcaactttatagtcaattttgtatttaattatagtattttatggtacttctagtattattacagttgagaaatgaggtagaaatcctagatgttagtaggtaaaatgattttttagaattaactcagttttattgaccttgaattttagcatgtttttcagtaggtgattcctgttaacatctgcattttgacaacacacttaaataaaactagtgaaccagagaacaatgaattttcatcagctaattactagtgatgattttaacctgtttcaaaaaactaatggtaaccttttttgatttttaaccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttaaaataaagtgaatagtgattatagtgaataaagtgtgtagttatatatttttctaaaagtgaaatacccttttaatgaccaacattctttgagtgcctggcattgttttgcctaaaaagacctgcacatggctgggtgcaatagcttacgcctgtaatccaggcactttgggaggccgaggcgggcacatcacaacatcaggagttcaagaccagcctggccaatatggtgaaatcccatctctactaaaaaaaaaaaaagaaattagccaggcgtgatggcaggcgcctgtagtcccagctactcgggagggtgaggcaggagaatccctgaacccgggaggtggaggttgcagttagcggagatcatacaactgcattccagcctaagtgacagagcgagactctatctcaaaaaaaaaaaaaaaaaaaaaaaaaactgtacatatgtacatatttagataccggagagatctaatttcattagttcctcaatatccttggggaattggttccagactcccttgcagataccaaaatcagcacatgctcaagtccctgatataacatgatacaatatatgcatataacctagacacatcctcctttatagtttaagtcatctccagattacttgtaatacctcatacaatgtacttgctatgtaagtagttgttatactgtattgtttatggagtatgaccaaagaaagtctgtacatgttaagcacaggcaaaaccgtccttttttttgtttctgaatatttttataccatgattagttgaatccatggatgtagaacccatggatagggagagctgattgtattatttatgtgtgtgactcttacaattgtgaaggggatgcacatttcaggagtgcatttttattttgtctgaattcagtctgggaaatgattaattacagggcaatatttcttgtcaagttgtgaataaatatgtttagcattagtatagatgtttacaaacaagaaaactcatactgcttgccaagcagttgattaaaaaatgcattcaattcaccacaaagtctctgtaggaaaaatctttacatttgtatgggttggcatttagtaattaaatctctaaatattttgattaggctgaaggccacccaaagtctttggtcatatctgaaaaacactttcagccatcagtaggaacaaagctctaggacagccactgtcattttcacaggagtcttaaatctagagcagtgtgcataagaatcccctggaaagccctttagaacacagattcttcagccccacctttagagattccaatttagtagcccggggtggggacgcaaaatgtgcagttgtcactagcttcaggccaatactgatgccgctgttccaggtaccatagtttgagaaccactgttctggggatttcagttgtgatttgaaagtagacagcccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagacttcgtctcaaaaaaaaaaaaaaaagaaagaaagtagacagccagattgatgaaatcaaccctttttaaaaaggcttttgcttgacaggtattttatatatttcagaacaagatactgatgggaaagaaagatggcaaagtgttttctgtaagatttgggaggaggagcagatgggaagccagtatgtttgcccttttatttctcttttcattaacagcactggggaaatattctgagttatttttcttggttcctttcatgccctctccttctttcctaacagcaagtatgttggaagtggcttgaactctgccacttctagcaatgtcatcttgggtagattactgtatatgttagttatctatattactttgtaacaaaagatcctaaagttgagcaacttagaacaacatctattatcactcccagtttttgagggttggaaatacaggagcagcttagctgggttgttctggccaggggtctcccatgaggttacaaactgttggttagggatgcagtctcagaagtatttggagtatgttttcaagctcacacgcagacatatttgcaggaggcttcaattccttcccatgagtctccatagggctacacatgacaagacaggagactcaacacaacactgaagccacagtcttttttttttttttaagttctgagatacatgtgcagaatgtgcacgtttgttacatagttatacacatgccatggtggtttgctgcacccatcaacctgtcatctacattaggtatttgtcctaatgctatccctctcctagccccccagcccctgacaggccccagtgtgtgatgttcccctccctgtgtccatgtgttctcattgttcaactcctacttatgagtgagaacatgcagtgtttagttttctgttcctgtgttagtttgctgagaatgatggtttccagcttcatccatgtcctgcagaggacatgaactcatcctttttatggctgcatagtattccatggtgtatgtgtgccacattttctttatccagtctatcattgatgggcatttggattggttccaagtctttgctattgtaaacagtgctgcagtaaacataagtgtgcatgtgtctttatagtaaaatgatttgtaatcctttgtgtatatacccagtaatgggattgcttggtcaaatggtatttctagttctagatccttgaggaattaccacactgtcttccacaatggttgaactaatttacactcctaccaacagtgtaaaagcattcctgtttctccacatcctctccagtatctgttgtttcctgactttttaatgatcgccattctgaatggcattagatggtatttcattgtggttttgatttgcatttctctaatgactggtggtgatgagctttttttcatatgtttgttgctgcataaatgtcttcttttgagaagtgtctgttcatatccttcacccactttttgatggggttgtttgtttttttcctgtaaatttaagttctttgtagattctggatattacgccctttgtcatatgggtagattgcaaaaattttctcccattctgtaggttgcctgttcactcttgtgataatttctttttctgtgcagaaagctctttagtttgattagatcccatttgtcaattttggcttttgttgccattgcttttggtgttttagtcaggaagtctttgcccgtgcctatgtcgtgaatggtattgcctaggttttcttctaaggtttttatggttttaggtcttacatttaagactttaattcatcttgagttagtttttgcataaagtgtaaggaaggagtccagcttcagttttctgcatatggctagccagttttccaaacaccatttattaaatagggaatcttttccccattgcttgtttttgtcaggtttgtcaaagatcagatggctgttgatgtgtggcgttatttctgagggctttgttctattccatcggtctatatatctgttttggtactaataccatgctgttttcgttactgtagccttgtagcatagcttgaattcaggtagtatgatgcctccagctttgttctttttgcttaggattgtcttggctgtatgggctgttcctgggttccacatgaaatttaaagtagatttttctaattctgtgaagaaagtcagtggtagcttgatggggatagcattgaatctgtaaattccttttggcagtatggccattttgacgatattgattcttcctattcatgagcatggaatgtttttccatttgtttgtgtcccctcttatttccttgaagagtggtttgtaactctccttgaagaggtccttcacatcccttttaagttgtattcctaggtattttattcccttagtagcaattgtgaatgggagttcactcatgatttggctctctgtttgttattggtgtataggaatgcttatgatttttacacactgattttgtatcctcagactttgctgaagttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgacttcttcctgctttagtcttgggagggtgtatgtgtccaggaatttatccatttcttctagattttctagtttatctgtgtagaggtgtttgtagtattctctgatggtagtttgtatttctgtgggatcagtgatgatctcccttttatcattttttcattgtgtctatttgattcttctctcttctttattagtctggccagcggtctgtctattttgttaatctttaaaaaaaaacagctcttggattcattgattttttttgggtgggaggatgagtttttcatgtctttatctccttcagttctgctctgatcttagtaatttcttgttttctgctaccttttgaatttgtttgctcttgcttctctagttcttttaattgtgatgtgagggtgtcgattttaggtctttcttgctttctcctgtaggcatttagtactataaatttctctctaaacacttccttagctgtgtcccaaagattctggtacattgtgtctttgttctcattggtttcaaagaacttatttatttctgccttaatttcattggttacccagtagtcatttatgaacaggttgttcagtttccacgtagttgcgtggttttgagtgagtttcttaatcctgagttctgatttgattgcactgagccacagtctttttatcactaatcgcagaagcgacagtgcatcacgtatatgtattcttttcactagaagtgagtcactaagcctacccatactccaaggaacaaatgagttccatctcttgaagggagtattaaagatggacatatccttaaaaccatcacactacattagcctcagttttctgttccataaagtgggaaagtgatatttcatagtggctcagtaatggtagtaattaaattattctgatgattataattttttatcataatcattatcatctcttaagaactttacgttcaaccaaattttctgatgcatgaaattctccccacctaaatccatattttataaactgccacatatcataaaagcctcttcttttaaaaaaaaatagaagaaatttacccttataataaagccagcctctctacagccaaaaaagttaaagactgatattaatatgattatggatgagaacatctgtaataatttatttattgaataggagtcagcaactattaaatgaataagccgtattaccaagtgggatgtatcctgacacacaaagactgtttctatctggtacgttaaaaagctatcgtatcatttagccttgtagtccatgtctggtattttgtcttaagaaaataataccagcatttttgatgccagaagatgtttaacacaggattgtattttcaggcagcctttaaaatggcccctagtgattgatccttatctcttgttgttcaggctcttgtgtaatcacctccccttgcatgtgggctttacctgctgactcacatctaatgaatagaaatgaaataattcggttataaaaaagactgaagcttcagtcttgggggctgctgcttgctctctctgtttacacacagtattttttttaaccacacctggcataaaacttctccccactcccagaaacatactagaaggaaatatacaaaattaataatactcaatgtgtttaagtgttaggactctgtcatttgatctacttttttgtgtttttctatttcctatcttgatcatatattattttacaaaatggcaatatttaaaaggaaaacaataaagaaaagaaaaagcaaagaaaaaggacaaagtacatgtaggtgtttaaacacaggtaacatttgaaaaacatttgattgtttagtgagaaaaaagttgaaatgtgtgcatttgtatttaaatacctacaaaaatgtataatttgtattcaagattatataatattgaaaatttgtgtggtggtcatacatcacttataatttttttaagcactaaatgagatgtttatacaaaaatactggtaaatttttacctaacacttgctgatgaaaagtatcatgtaaatttctagtaataatattgatgatgatatagtgacaacttagtaaaagtcctatagtaatccaggcaacagacttgactagcacatcgctgctagttggttcctcccaatccgaatccttcaaccagtgaagatttttgaatcgttggtcttgtttggctacaggatttttataaatgccattcaatgaagatttgccctctggccttcttgatgttggtttaccctccctcctccagtctattatttagcatggtgatgccttccataatgactgagcccatctccttgtgggctctctttggggtccactatgggtcactgtgatatgggtgtctggcaaagggctggaaagcaggaacattaaattacttcagtttcagaccacttactttttctcctgcaggaactgaagcagagcaagattttgttttcctgctcattcattattagcagtagccttgtctttagaaaaaagcaggttatttttctcacttttgagcctttggttcttaaaattacctgaagcactttgagacttgacttcatttcatatctttctgtgatgctcaaaactaatgtttgcccttaatttttttagaattgctcaaaccaaataaaatagtttcccaagtaccaaatttactgctataacgtatacatctcttcggatagcaaatacaatttcaggaccgcttttgggagacactattcctcacatacttatattacaaacagtattaatagaacttcagtctaaaatatatgaagaaaagaacatctaactacatttaatggttagtggaaattccatttagctatgttcgtgtttgttcctaagtgaagttatttaaggggaaaacagtcataattgagtgagcatataatgttgtcttgtctgtacttgattaaagcaaaacagattacatttagggcccatctttcttaatagaaaatcacatctaaaaaatattttctttactttcactagctttcctattcttgcaaccttagaggcacatatgtgtggacataacattgggcttagataatgtgtattctttttaatccataagatgatgcatgtacattctccccactgagtcttaagggctgctgcaatttgaactgtgtagtaattttgcattttcattttctctgacttaacgatgtctataaataaaggtggcatcttactttaataataaaaaacccattatcgccatgtggtggagataacatattatcattaccactattaacaactgctagtgttaataatacatattttctgcttcagccagagccaccttgcatttgaagcaaaagtttgaggtattatagccttttaagtttattattcttcctatgttttgttcaaaaggaaaataattgttaaaggatcctgaaagcatattgtttgggcctaaatcaatattacaaggttgcaaactgcagtcatacaagtgtacttgtgatttgctgagaatgagaactgtggtcctcaaacctttgtcagctgtagctacaccagcccatggaggagaggtcctactgtagtttacccactcaagcagataaacaggagaaagcaagtgagtgcagaaaaagctattatacgattgaccttgagtcttttgtacttcatttagaagcacaagtacattattcacagatttatatatttaattatcattagttactggtgaagaacttacctaacaacagttgagacgtagaaagaatgcacatttaagaactggtacaatgtatcagattggacttgacccagcccttttgggtgcagttctcttgcccatttatttggaatgaaaagagaaaggaaatgaactcattgcatctcatgttgctatgtggtatacatagtcacatatatatgaaatctgataaagaaggaaatacatttttaaaataaagcctttgctttgtattcagatttgactgccatctacccttctcccaaccagtataaaatattactgctggccttccccttctctcatcctaagtgttgagaaataattttaacacctttttttgttaggtaccctatgtacaatatttaaaagcagattcacagtcccacattgttgttattgttgttgttgttattgttagagacaggaaccagactggaatacaagtggcatgatcaccacacactgcagtctcaacctcccaggcccaagaaatcctcccacctcagcctccccagtagctgggactacagatatgcactactatgcctgactaatgtttttcaatttttgtagagataggttcttgctgtgtttcccagcctggtctcaagctcctgagctcaagagatcctctcgccttggcctcacgaagtgctgggataacggacgtgagccactatgcctggccacaattttaaattgaacttattttagcagcatcaatttcttgattatgttaaacaacagaaataatcatatatatttgtgtgctcacttttctgcttttcaaagagatttctgacagatcatttcatttgctcctgtagcagttactcgtactttagtgatttggggttgcaagatcagtacttatgagacctgcttcttctcatgcactttgtcaacctctagtgtatgtgtggtggcctcttggatttgccctcatggctcaattagacagagttctcgtaggtattgaaagcttttttttaactacaattttttgtgaacaggaaattaagctaattattaaaccagcaagaaaacagttaaaaagctgtgttttatagatgtttttgtagagctaggctaactaagcatctctgtgcaaataagtttttttttttttttactaaatcccgcacctcatacttcctagctaatatgaccctggtttagtctttacaccttaaatttaattcacccaatgtctggatttattattaattctgctaggaactctctatccctctgggcatttgagcagtttgcttattaatcagctaatgtggtaggctcatctacctcgctactcagtttatacctcatttcgcagttctctgcaggaagaaatagccttttttcctcacacagcagctagcaaaaagaaaggtcactcagtcacttgaatctgggcccactcccccatcttctagaaaggattctcccttcttccacacccaccgtgcgcaccttcctatctttatcctcagtgggcatcacggctcacatccgaaagtttccctgaataaaattggttcctttcagccaattgcaagcacagatgaggtcacaactggtaaatggaatgaaaaaataaaccagtagcatatttagcttgaagtaacattccagctaaatattttaaaacttgttaaacagggtttggggaagccatatgaagtggtttctcctggaggtcaactttagggtttttcaaatggttataaagtggtgttctatggggtagcttttatagaagggctattttgaacttttactagaggaaatggctagcagcaacctcccccaacccccagaagtacagtgaggaaaaacccaaaagacaaataatagacaccctttcccctaacataggggagaacagtacagcataacaagataccatctcagctttatttcttacctattcagaggattttaagatcaggaagctcgagagaaattagttattccttcaatttaattcaatccaataaaagagtatggagttcctcttcgttttaaaattctgactgtggtgttacggaaggaccttctaggtgaaagggtaaccgaaataacaaaggttccatttcgtccttcagcaaattcaaaagcttgagagcgagtcatacaatgtgattatttgataattctctctatattctgatagaagaaccagagggatataaaagacagaaaggtaaaatgggatggcatatggtaacaactggaggcttagaacctagcagatcggggtcaccatgttggatgaatgtgaagggtaattatgccgggagaggtcacaagaagaatcttaaatgaagcttctaaggataggcaggatttgaccaggtgtaaagaaaaaggaagctctaggcataaggatagaaattagataaaaaataaacaacaaatttggaatataatattgtatagctggaacgtttatagttgaccacagaaagtttccttcgcagctgtttgcccaaggtttcaccagtgcatgtgactttgtatttcaagtcagaccttgttgatcataaattaatattatcacctctagtactgtcctagacctgcaggatacagcatttactaagaccaattgctgtctgtaaaaagcttcttagtctagtataatatgcagccagttacttgctgcttctttactgaaacaagtttaataaaccagcaaaacaatgcctagcaacccactgttgctgggtttaaaagtaaagatgctggttgtcatctgccaggcgtgtacttcaaaaggtagttagcctcccatctagcctcccattgttaaatctagtgcctgctaacagtatctcttgacagctgaaaaatgcagttgggacaaagggaatctgaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctttggtctttgatgatggtgacgcacagcatggggtttcggtgtggatgtcctttctgtttgttagttttccttctaacagtcaggacccttagctgcaggtctgttgtagtttgctggaggtccactccagaccctgtttgcctggatatcaccagcagaggctgcaggacagcaaatattgcagaacggcaaatgttgctgcctgattcttcctctggaagtttcgtctcagaggggcaccctgctgtatgaggtgtcagtcggcccctactgggaggtgcctcccagttaggctactcaggggtcagggacccacttgaggaggcagtctgtccattctccagttctcaaactctgtgctgggagaaccactagggatgtttaagtctccagaagttcctgctgccttttgttcagctatgcccggcccccagaggtggagtctatagaggcaggcaggcctccttgagctgcagtgggctccacccagttcaagctttctggctgcttcgtttacctactcaagcctcagcaatggtggacgcccctcccccagccttgctgccaccttgcagttcgatctcagactgctgtggtagcagtgagtgaggctccatggttgtgggaccctctgagccaggcatgggacataatctcctggtgtgccatttgctaagactgttggaaaagcgcattattcgggtggaagtgtcctgattttccagatactgtttgtcagggcttctcttggctaggaaagggaattccctgaccctttgtgcttctcaggtgaggtgatgccctgccctgcttcggctcgtgctccatgggctgcacccagtatccgacaagccccagtgatatgaacctcgtacctcagttggaaatggagaaatcacccttctcttgagctgtagactggagctgttcctattcggccatcttggaacctcttcctatttaacttaggttttaaggttgaactgacttttcctaccaactagatagtcaattgacaacattagttctgggatataatgtgcccatagaaatacttttgaccagtagcttccttgatattaaggcatttctgaaaccaagcatttgtgtctatgaacaataaaatcaggtcttcagttgctgacctggtttctattgtttactttcttgtcaagggcttctcctcctcaaagttattttaaagcctgatcttaccacagtaaattcagtttcacctgtgaattggtaggctacttttaaaggaaaatgtttttctaaaaaaagaagagtgataacataaaatacatacctttggctattttaggtgactggaaccattactaataatcagtttcattcagcaaaaaaaccgttctttcaggtaatatataaaaccttttgttcatccttagtataaggccaatcggtaggaagaaatcctattgtaaattacattcttagtgttacttattattttatgtgtttaaagtaggcaaaggatgcttggtcaaatggatggattttgccacttttttttttgagatggagtcttgctctgtcgccaggttggagtgcagtggcaagatctcagctcactgcaacctccgcttccagggttcaagtgattcccctcctcagcctcccaggtagttgggactacaggcgcgaaccaccacacctggctaattttttgtatttttgtagagatggggtttcaccatgttggccaggatggtcttgatctcctgacctcgtgatctgcctgccttgggctcccaaagtgctgggattacaggtgtgagccactgcgcccagcatgccacctattttaattagcagaaaagagtgtcatgctattaaggaatcaagtatttataaatgagacatttcaatactggagaaaagtttattttcttgaatatggtaagtatgttctttacagtcttactgtaatatatatttttttactcagcaaatacttttccttaaatattgcaaaggtaaattgtggaagagtcctccatattcacattctgaacaaatggagtttgaaatgaagagttttaattgtttgtgcagagccattattagcattttgggtaatcagagctttctttttcacctaatatattctttcttatatgtctgttttacttgctttcaagtatgttttggttattgtacaaaccaaccttaatgacctcaggtgctaatatgacactgagttttataagtagtgaaataatcatgattatgggattttgttattgtttgctttttattttttattcttttagctcaagaaaaagcaagcattttaaaatactaaagcttggcaatcttgtcttgtctaacctcctggaatagagacttagcattctctaatactctcagagtacagaatctttctcataggaattgtgtcatatattaagtgagacagttggtaattgagttatattctttattacagaaaagcaggatcttcctgagctggaattcctctctaactgtacattaaaatccttttgagcttatagtaatattttacaagtctctatttgaggctaaattttatttttgggtcattggaaacctcgacagctcgaatgtttatgcagtatcatggtgtccagtgaaaatttactacacctgttttagagttcaccaaacaggacaaataagagatataaagagatttattataaggtattggctcatacaatcatgaaggccaaggaatcccacaatctgctgtctgtaaggcagagacccaggaaggctggtggtatagtttgaaggcctgagagccagagagccaatggcttagcatccagtctaagtctaaaggcctgggaaccagggatggcaatggcagaaggaagatgccccagctaaataatcacacagagagagcaaatcctcccttcttccacctttttttttatgcttaggcccccaacagattggatggtgcccacccactttggtgagggtgggtattctctattcagtctatgaattcaaatgctaatctcttgtggaaacactctcagacaccctcagaaataatgttttaccagatatccggatatcccattttccagtcaagttgacatataaaattaattatcgtactttccaagcatcccaatattaattctagggataaataatacacttaggacagaggtgtgggtcagtccactgataatacccagatcttattctgtatgcctaaaatgatgctaagtacaagaaggcaataccaagtaaaaataggaaactctttgccctgtaattagaaaaacaaagtaaattcataagtcagttaggaagccataaatcatagtaatcttatatgacattgaatttaaaactagaagagcgcttaatcaaatgcaaaatgattctctggctaaaggtgtgggggaaggggaggcgattgtgggtggaagatgttgagtaggctcaatgagcagccttgatagcagaagagttggaagggtgtaagagaaggtaagggcttttaggctggatgattgagcaggagaatacagtaaagagattgttcagattggctaaaagtggaatgctaagcaacatattcagccagataaaatggggccaaatcttggagggcaaggaatgctgctgccacttctataatcatcgttgtcctgcagcagttcatttggggtcctccatcaagcagcagtagtgagaatggtggtggcagaagtgatgctgggggttttagtaacggccagcaattactgagctcttatgacgtgccagggtcttgtacttcatgtggattattgtattttaagacattattatctattttacagccaagaaaaggaggcatagaagagattcataactaaccagaggacacagagctagtatgggtatagctagtatgttgagcccgggcaattttacactatattccgtatttctaaacacatccctgtattaccactggacagtaagtagctacagagagcagcagttccaatgcatcatcctacattttaggagggatgttggtgactagagtccgtccagagaaggataactgggaaaataaagagtccttgaatctctgtgaatggaaatagagatgtcaaaaagataatccggtttgtgagagaaagtggtaaattgggctttagattcccccctttttctcctcttccccaggcacagtgggctgagtcccctcaccattgtatatcagagattgaagaattatgtacaaatgtttaaatggattacaagattattccaggtagatggaactatttttatcagtgacaaaagagttcctaagagttgtcattcactgaccttttttgaatgagccatcatttgcttttatattctactaaagcaatccttgaagatcaagtacagagaaaacaaaatcagagtatttatcagtttctgcagttttgattttccaccaaacatatgagatcctttagagacttcatgaagtggaacaagaggaagggaagtggtgtatagttagtatcagtgtcagtcctgttattggtcaggacctaaacaacagaaatgcagtatttcttctgctctagaatcctagctatagtaagatacctcactgttttaataatggtgttttaggagcaaaactcacttcagtaaagggagatattcattctaagggggattctgatgtcaaaaatgttaaaatgtctaaaagctttttattttaaaatagcggaaataagaagtaagttctgctctgatctttacagaatcttgtagagcagggggtaagagaaaactgggcaaatattaacaaaggcagcatgatgtgtgagtatttgggctccaagaggtgagggaggcatgaggaagatagactcaaatgccaggcacagaaagagcctaaatgaagttggtggatgttgggaggagggaattgtagtgtctagactttgagtactcatatcaggttagccctgtaatggaaacattacaaacatgcattttatggaaatgcataaaattattcctaggtgtattagtccattctcatgttgctaggaaggaacacctgagactgggtaatttataaagataagagtttaaattgactcacagttccgcatggccagggagtccttaggaaacttacaatcatggcagaaggcacctcttcacagggtggtgggagagagaatgcaagcacgggaaatgccagacacttacaaagccatcagatctcgtgagactcactcagtgtcacacgaacagcatgggggaaccgcccccatgatccaattacatccacctggtcccaaccttgacacgtgggcattattacagtgcaaggtgagatttgggtggggacacagagccaaaccacatcactgcacctattaaccatccacaaacaagactaaatcaaccctggcagcctggtccaaaaaaacctaccttcttcagcctaataaatttgtctccaaagaccctgaccacataattctaccttccattctcaggtccagaagcttccacctaatgtgatgggtgtcctcacaaccttctgagtattgaccatctctcttggtgtagctgaagatgcttattaagtgtaaatgatacagatgccctatccgtcagttgcccaccctttagtaagatgcacagacaataaaaagtccacagttacctccctataggcattatcttagtaaatggtgaagtagctattaaactggaactttatggtttataagatgttcttagttgagctatgcctttgaaatctctttctcattctcaacatcaagttcaccactagattataaaattagcaaaggcaaagactatgactttctggtcacagatttcctttgtctccacatctcaacacagttgtacacatattgtaagatcttagtaaaattgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttgagatggagtctcgctctgtcaccaggccggagtgcagtggcgcgatcttggctcactgcaacctccacttcccgggttcaagcgattctcctgcctcagcctccagagtagctggggctacaggcgcacaccaccatgcccagctaattttttttgtatttttagtagagacagggtttcaccatgttggccaggatggtctcaatctcttgaccttgtgatccgcctgcctcagcctccttaagtgctgggattacaggcatgagccactgtgcccagcctgaatgttctttttttaaacttccctgtcatactttattgctcatcagagctatttagggtgaaagaaaaacctcaagttttgaagcttagtctctgagactcaggtagggctgacagccattcagttctgttctgcatttacttgcctcatttgagtaaacttcttcctgccttgaaggactgtactatatacatgtggactgatgactgtgcaaatcttctttgcttttattcaaagaattgaaaacatttctcatcaaaatatcctgctcctcaacataaccgaaatagactttaaaaagccaattttaattatttttctagtccagtttatgtcaaggatgcaattcagttctcttgacagtctttatattctaattaaactcttccaatttgcaatttttgtcttcattcttcatttattaataaaagccaaatttgacctagatatgtaatagtagatgacaaaatgtggagttgctaagcccctttctcccaatgaatactatttatctttcatttttatagcagtaaaacatttatataaacataccatagtggaataaaagcaacagtctggtgctagtgatcttcactgtgattgacttctattacttgcctatacatttagtatgtttgtgcagaaatgtttctcaaggattttctaacaggtgatgttattgaggtcctgagagatgaagagatgtgtccaaggtcctgtacctaaagcagggcagagcgaagactagaacccaggtctcccaactgactgctagtgaaatgttatgcatccctgcttctttgattgtttttttgctgagagaggattgttttgggaaatataaaaaggactctgttagcgtgtgtctagggtcatgttatactgtaatagcatatgtggggtactctggcagtggtaggacagtgggtctttaaatgggtctttaaaatgggtctttaatgacagtgggtctttaaatgtggtagatggggtatcaggttggataagagtttgggtaagctgcatggtcagatgggcccagattgaaattcctgctcagacattaagcagctgtaggactatgggcaagttactaacctctgtgatctccagtgtcaacacctgaacttcttgtgaggatgaaatgacctgatacttatgatgtgcttagcattacacctcacacagactaacacccttaataaaaagttaactattcttagatattacatgtttatctgagttatggttattgaaaaacccatatgtgcctgacagtaaaactaggattactgcaaggggaaaggaaaagatgacagtcatgtttcttactaactctcattggaacacacaacaagcaccttctttagaattaagataaatacccacacacactcacacacatacacagtatgcatatggtgtatgtctttgtgtgtgtgtatctattcctttgttttttactttatcatgctgcctaatggaggattgttttttgaaatatgaaaaggactcctacatgtgtctgtaagtcatgttgtaggatagttgtggattggatagtccccttgagattctccttgctcttcaatatcaaattaacagagaaagaacatagttttactttgtggtgtatggacttttgcaaatcagtaacaagaaaatagtctattatttcccacaccatcccacactcatacttaataatactcatcctactactttgtttttcattctttcccttacttctcttgaagtcagagatgaaaatataatttgccaatatacagccaaatttgtttttggaacacattctagattattatctttctcacttaccaccagtgtggtatactgcattgttataaaacaaaatcacaaacaattttcaggtcagtacattttagtaaagtcagtttattacgttgcctattttgtagatgagatacctgacttgtgacaaatggttggacttatatttgatagtaagtcacttcagactcaattcaatttcattttccttttttcacccaagtccattttccccatttttctcctgaatttagcatggcaagtatgtactttatgctttgcagataagttggtttctgtgtaaccataataataaatcaagccaactgggtgctgctgcccatatcaaagcctacagcttcctagtacattccaattaattatcttcatgaagcaatcaaaccatccctgccttccttgcagtgtcttttctgtttccctcaccttttcttaaacatcttaaagagaaacatgcctctgtgaaatgattgaatggttcagcagcttttgattttcagcttctcatttaatcatgcaacctgtcattctaaatatttttcacctcacaattatcctattttcttttcctgcttgtttattgtccactctgtgaatcatgtcaataacagtttttaaatcattgtaaatcataatagtttgacacttatttggagaagccttatttttgacaaggaggaggaaatttcatatcatactgtcataaattgggggtcaaatcaacatagatttctcttctcattaacatttcagacagaatgctcctaatataagactttaagaaaacagtcactaagatttgagtttaaattgtttcctctggccttactagctaatgaaagcacattcataaaagaccttcccagataaaggaccataattttttgttaatattatggttcatgattttagttacatttctcagagccagagtcagacaattagacattctgattcactgtagtttgtaagccaatttcttatgtaccttcctaatgaataggcagaactgtatcttgtaagttcaaaggagtagaaaatctatatcaggagagaccgagataacatctgacctggtgttctaagtggggtgtgataagcgtatctcttcagaaaattacagacatgatttagagttattttaatttgttcctctcaacaggccatcaacagaaagtcagtttctttgtaaatttagctgatgtaaatagaatgccagcatcctttcatcacaggactgagtgcttggtgatagaggacagagatgactgagcgtgcttttgtaatatcaggaagcaagcaacctggaagtactcttaagtgtcataccattgtattctgatcctaacattgtgcagaccttttttttttttaaatccatgacttggcatagagagcacacagctatttcaaaggtttcactgaatgcatttcttataacattcacctgtgtgtctttattcccgactagataattctctctcaatacttttttgttatccctgagttccaggagaggtccaggccgtttgtgattatcccatgaagaacagttaaaggtagtggaagccccacctctacagaggcagagattaaccaggatggtatgggctccaggaacagaggttggaacagcaggcaggatggctcactggaagcagggctcagggacttcaaagattcttccatctccagggctcctgttctcccatggctaggaagggaggaatcttgtggttagcttttggcactaactatatttatatcagagaaaggaaaaattttggatttgtcatagattttgtcagtgaatactggccctgtcactttaggattaggaagttgccttactgttcaccagaacagcttagtgtaatggttaaagctcttgtcattagataaacctgtgttcaaatccttgtctagccattaattagctgctgatcttggcaaactacttcagctttctgagcctcagttttcctgtctctaaaaataatggtaataaaatcatagctcataggagtttggaaagggttgaattacttatatgccaggtaaatagtgagtagcaataattgctgactgctaataagtacttaccacttgccacgtactgggcttagtgccttattttaattatctcatttaatcctggcaccaaccctgcaaaggtaggtactaatattattatccccattttaaagatgaagaaactgaggcccaaagaagttagctaattcacacagctaataagtgatagagccagtgcttttgttgcagagatcagaatcagaacctactgcatgggtagaattttacagctcctcgaagtcaggatcatgtattatttatctttgtatcttatgtcctctttttggcctcaggaaccagaacagtattttgttgtgtcagatgaggtcccccagtataaagattaaagaataactttcaaacagctatagcctcaacaatgcaatggagggatgcaatgggccaccttgcaaaggaggaaacttttgtctttgaaaaggttcaagctgcggtggctgaaccctcaggtcctgcctagctctaagattttctggttcattcatctccccggcatgcccacattacataaggtgcctttctctgctggaggaaaaggggaaagagtacacatctgtgggttatgtgttaaatcattcagccttcactcttacaaagtaaaatctcctactcaggatcctaccaactattattgtctacgttttactaaagaatcagattttcatttccactccgatttttagttttgagaaactagttcagttccttgttaaaaagtattgtaggcatcgtgtcgcaccattattaagaaatgtattttacaatatgaatgtagtgctaggtgaatttatatgaattattccatgtttgagaaggaaccatttggtacttgttctgaatacagttgtttaagggaagaaaattgcagacatgcagttttgttccatcccatttcaaaacccttgaccttgtctaggcagctagcaatgatgactgccttgaaaatgaaattactgtggtactttctaggtactccagatctttaattatttccaatatattgccaaatgaaacatttatgaaaaagcttacagttacaccaagtatcttgaaaatttacacttacgttggtgaaacatcaaacagtacagtgtatggtagtactatttttttttctctagacaagaattctctttgctcttttttttcatgactcatccttccttaactcatctttcttatcctctgaagctttcttttcagagaatcaaaatagctttcttcatcttttttttcttcacttcacaagacctccacttttgaatagtaggaataaggttggtttttccacaggaattggttataaattccttctccatgccgaagtacactggcctctagtggatacctgtctcagttgtagttcatactgatcttgccttaattcacttattgtagcactaaaccagatattttaataattttcaatagtctatattaaggaacacaatcagaactttggagggtttaaagtagattttattatgaaattgattaagctttatgtggatagtcatatacttagcaatatatttaacaaatttagattatctcctgcaatttcttaagatgtaattgtgatgttaactccacagtacttttcatttaactcacattgcacttgaagacttaaggcatatgtaacagatcattatagaaatcagcccaacttactcatgtcagagaaataagattctaataggataccaaattgtctcatattccctgtacatagtcctgattaagaaaaaaaagctagcattttccaaagcagtattattatagtgggattttttaagtataaaatttaggaaaatcatctgttaaaaagtataaatctatgtcacttcttagaacttgcagtttagtatatttcagtatggcaaaggattagtttcaattttcatatgtggtcattaaatggtaaaagcatatacattttattcagcaatctgccattaatttaaatgtgaaaaatattttattgaaagagctacctaaattcttattcaaaactctgcctatcagtgagccaacaattcaaccttgagtttattgataagtgacatctggttttggttgtaggttggttctgcctcagggtctctcatgaggctgcagtcaagaagtatgccaggttcactgtcatctcaagacttgattgactggggctagaggatcaatctgcttccaaaatgactcacatggcagttggtaggaggcctgaggccttggttccttgctggatagaagtctcttgagtgtccgtccttatggcttggcagttggcttgcccagagtgagtgatccaagagagagaacaaataggaaggagccccaatacccttcataacctggtctcaaaagtcgcacactgtcatgtgtaccatattctgctcattagaatgaatcactaagtacagcccatgctccagaggaggaagattaagctctacatcttgaagagaggaacattaagggatttgtgggcatattttaaaactaccatggaaggagatcttcaagggaggatttgtctcatgtttaaggaatgtgttgcatctggtgtatataaaggacattttaggctatgccaaggatttcagccaagttggccagtaaggtgactgaaggtgttagagtagaagagtataaggcaaaccatatgacacagtagatctggagtcacatgagggtttaggattatcaaatgtgtggcttagaggagttacctaatgcctctatactgtatgccatctgtaaaatatggaaagcagttaccttccttatagggtcgtggtgagatatcagtaagttaagatagataaaatacttaggcagtgcctagcatctagtaagtgattaagaagtgttagctacttcagccttagcatgattgctgtcatgtgtaaattcatgttgtataactcttcaatcctcgttttgtagccggagaaatccttgtgtccttctccaaacttgcttggtttcttttctctctctgtgtagctttattctgcattccaacattcacacatgtaacagttttccattcgaatatttcattatatgcagaaatattttcaaattctggccaagcatggtggctcacgcttgtaatcccagtactttgggagacctaaacaggaggatcacttgagcccaggatttcgggaccagcctaggcaacatagcgaggctccatctctaccaaaaacttttttaaaaattagctgggcatgtggcagatgcctgtagtcacagcttctcaggcggctgaggtgggatcacttgagcctgagaggtcaagtctgcaatgagctgtgattgcgacattgcactccagcctgggcaacagagccaagattgcatctcataaagaaaaaagaaatagaaattttcagattatttgagggagtgggaaaatccaaaagttagagagggtagtgatagtatcaggaaagatgcactggtttggaaagcatcttctgggatgttgatacatctacctagttgtgggagatacacagattaagcagtaaggacagatgctgctctcagatacattttgtctagtaagcctagtgtttttaaaaatccagaattttggcttttgaaaacaggaaagatctgggcataaaaggcctacattcgcatggcaacaattggatagattgtgtagcaactgccccatttgaaaaggcatgtccttgctggtatgtcagagtattttctgttgtcttaatctaatacctctctactcatttacttacctgtctggcactgagtttgaaaccaccccttccaattaaaattaacactctgcaagtcagttagtcaatataatctcccataagaagtacccccaacatcaatgtactcaatacatctataaaaagagtcatttggaactgtaacatgaaactgggatggaattcctgttctcaaatctgccaaggcagagattacagtcttctcaactaggtggcaagaacttcggagtcgagttagatggcatagtatgaaagggaactcgtgtagcagaaatgggcattacaggaagcatcacctactcaagacaaacaaaaaaatgggagatgccctcagctagccttgagcaacacagaagaccatccaggtttccggagtaagaactttgacatgatattcaaagcaatcatgaaaataaaaaggtggcaggtcaagacatttacaaaaatatttttttcaacccaagaagcttttttttgataggacacaaaatagacattaaataagttaaaaactattttttggatttaacatattggaaaatacatgttcatgagataaacccacactgagaaacatgtgtgataagatggatgaggtaggcgtctgcaaacagggacatttgtccagacatttcagagaataaaggagagttacagagcagggaagacaaaaggaagctctagcatatctggaaagcaaatgcttgtctacgttgtggacttaggtactgtgtgtgtatctgtctttactggatgctgctcagttcctagaaaagccatgtggaatttgagagctttagtttccttccgcatggtttttcttggttgttaagccatcctatacgtattccctttgggtatattttttggttgactgttaacagctcaatgacacagtttatttgcttagtagaacagaataatgtggcttttgagataaatgtatggtgactacttgcagctgggtcattggcattttatggaagttaacactttttgttcaaggttgcagacctacatttttaaatactaaccatcttctcgagtttgtctccatgttacccatgttccttctttagacagactggaagaccacatggggattcagtcttattgagcccatctttcatcatgctgaaaataaggatttcaagtcactttcttagtgggccttccttagttttgtttgtggctaataaactgaatgaagccgttttagtgctgagaagctcgttttcacctgacaagccatcatctgtcatttgtaatggacaggacccaagataataaagcctttagcttgttttcctttttctgcctttaactggggtgtagatccagacagctaatgagcaacaatttcagattcttaggtattagccatgtcccaaaaagagccaaggaaagaaatgtttgtgataatactcatttaatggcttgtgctgagaatgtgcagctttatttgacttttattttattgtgtaacccatgaccgtggttatcttgtggagagggggtaactgaacaaaatgttaaccttccagttctagaaggttgaatggattttcccaagagcaagctgggttggtcaaaatggcacattatcagttagtcttaaaaggaaacaatggcacactcatctcacagtatatggaggaaagtttatttttaaaaatattgataatgacaatatatgtggggttaaaggaacctggggctggcagcgtgggatcgcttctgtcccaatgctgagagagagagaaggaggtgactacttgaccagaagagaatatcctgtaatgaagacttttttgagatgctctgataccttctgtggaggaaacagccacccaagacaatcgtgctgggagggacgggggaataaatgcccccaattccctctcctcctgccagggctccccagacatcagatccaaaaggaacccattaatccgttctctctagtcagcctcccagggccaagaggaggttgcaaaagagtggagaggatctggagaggcccctgacaattctgcagcacagctaggtcccaaatcacgatgttttcatagtctgtttaacatgtgcctcagagaatatgatattctggaatccttttgcaaaaggagtctaatagctggagaactctactaggtccatgaaaggttaaccatggatgagagaaggtgtggccaatcaatgatttagacactttgaggtagaaagcattttgttcaattccttacttagcaggctgtagggagtgctctgccaatgtagtttctaattttctccagtcatggtatactgacatttgctgaacagctaaataaatagatctctgttccacacaacagataacagcaaggtcagacagtgatattagtaattttagaatattgtctacagctgagaatgtttttttggtgacagtgacacttaatactgctggtcagtgtagaatgaattctacaagattccattcctcctgatattaaatattaccaggcaccagccctgcccagggatttcagaggagccctaattcaaatggggtgttgatttttataacacatgtttgaatgtgtaactttcttgcattattgtttatttggttttcctcttaatttacctgaatttaagtttgagatgctaatgaattttttcagcagtgactgaaaattctgaaatttcagaatttaagattctgagtgtcaggtttggcattagagtcattttactggaatgaacaaaaggtggggatttggggaaatgaaatggaaacttgtttttgtaaagaaatttggcagtaaattgcctttcacaaatatactagtgagatttgtaatgaataaaacatgtatgtgttttaaaaatgcttttacttaaaataattttaatataaattttagtctataagaaatagcttatagatcactgaaatcatagctggaatcttatgtttttactctttccagccagatatttatccactagggttttgatatgaatctttgtcaaccccttatttttccagaaaactaaatgatcaaataggtttatttgaacagatgcctaaaacctcacaggatcattatattccaccatcgttttacattagatttgttatttacagaaacagtgggttttgccattaactaaatttgtcttcatttctctgtggtgtgaagtgtgaatctgtgtggtcttaagttttggctctctctgcttagctatttttttttctaattgatgttaatcacaaataaaggagaagaaaccactcatagaaatatattttttcctcttgcttgtagggacagtaaccctgtggagactgatatgttgcaacaatagatgggtagacatcctgtttatagattaataaatggatccttcaccaagttgccaattttatgggtgttctctatattaactctccaacaaatgatgatggagtatacgtatttacatgcatcaagatgacataagtctgagatgattgaacaaaatatggctcagaaagaatgtgccaataaatattctcaatctgcaccaatgtagctcccattacaaataaaatatagatactgcattataagcaatgagtatcctgctttgaaagcaattatctgttaagctggaaagacagttttgtaaccaaatatttctgaagagtcaattctaatagctgatttgttaagagagaattatatgactctttttttaagccttttgatgcccctttatgaaatagtatgaccaaaatctctttgctctatttttttttagctttgaatatctctgtggccaaattatacattatggtagtttttgcatgatttattttaaacacacagcactcaaaaaagaacgttgcatttgccattctaaatgtccaaatggtttttgtaatcatggcagtggttctgattctcagttcaaaaggatacgggaactatggctgtaaaaaaatagaaactgtgcttgtgctattcccccaaatctctgtgcccttcagtccttttaactccttgtctccttttcctatttataatgccattcaatatttccatcttcagatttttcttctcctgaaaatcctgttaatacctgacttaaccactactaccctgtctgctgacaactacagaagcatttatatgccacccttggcctggccagggcctttgtagttgctgttcttgcttgtgaaagccttctacttttgtagatactataactttgacctaaataatgaaatgattagcatctttgtaaagaaggaccatagatctctgtgccacctaaccacaaacataccagctcctgaacaccttttctgacagctctctgcagatcaaatttccaacccattgactcttttgcagaaaataactaaattaaggtgttataatttagaacacagatggtctgctaaagttcacattaaggtagaatccaaattatttgaccagaagattttttcaaggagcattacttaggtctaatacttcgtacaatatactttggagaactttgatttaaggaaacagatccttgttttgggaggaagtatggctttataatttatatggtgcagtattcacattagtttttaacctgttaagctataccagtattcctaatggaagatgtcttcattctatttagagctggaagtctatatttaaattttttgctttacatatacctaatcatacataattaatatattcttggtggttatgcaggatgtgaactggatttctttactgcctgatattttctttgtaaaagttattaaaggaggggcaatgttgacagactaaacctttagttgtaattatgtgtaattatgtgtaaatatgtgtcatgtaactccaaagttagggaaacaaatgtattatacacttgcattgactctttcctccacttccatggcagacattgttaacagttcaaagatctctgccatggaactaactagaatgtgcccccatcatcattcttcaagcagccacttacagagttaccatgcctaccagtggccattccactgcctgatatctaaaatctgtattgatgatgatgtctcaccattagaatttttatggccataatttcaaagaataatagtggcaatggtatacatttcagtgtttcagacatggagaggaggagctatcagtctgcagagagagttcttgttaggaacatctgtttcagctcaggacagagtttagtgtttgaaggccaggccccactcttgtaccttcatgacccctccccagccccatctaactaggaaatgccaaaaccatgagctctggacaactcttttatcagtaaacaggaaatatctgtattgtaaagaactaaaacccattggtccacaaacctataaaagatatcttacctctgattgattttaattcagcagcaaaatttgaaagcaagaaatacttgggcaccagaatacaggactcagaagcacgttcttgaagcttggaaataggaccaatatggagctggaactcctgactcatcttgggagtctctgattatagagagactgccagagggagtggaacgaacatggactttacagtaagaccgccttaatttaaatcttgacaccattgcctactgctgtgtgatgtttaagctcattgagtttatttaccagggaaagttataatacataattttagcacctaggaaaattaacactcaataaaccttaatcctccatacagttttgcttattctaccaaggagtaaattatagaatataagtaaagtgaagaatttaggaagaagagaatagacagaataaggacagattagagtctaattagacccatttccctaggttcgcctgactgctttcagaggtcaacctgaatggaaacttgactctccatcaagttactgtccccagaggatctctccataagatgtcgtttccatgctatcagttcagagaagttggaataaaatggttggttcatctcaattgatgaatttaaaatgcccaaatcttgttttgtattaagggtgttgtataagacatttccttttgattctgagattttcaggcaggatcgtggactcactaaaattatttcttttttccttggaagaaattaaaagggcagagtgggagggtatctttcgaggaatgctgtttttcacatgtcagttttagctattttggaggtacatgagttgctttattccaaggatcctggcatttgaagtcacacaaaagaaaataatttcaaactccaagaatataccaaaggtagaaaagtgagcctgagcagcttgccataatttcagcagaaggcaaatctggtcccaatcgaaccaatctgttggtttatttgtattattacaacaaagcccaagattgaattcctcacctgaatcacttccttattgactgaatctatttagactcccctctaatttagcagagtattttttattaaatccaggcatacaaacatcaattatccaagctgcatctcatttccttcaccatttattttccttcgttggctgccagtggattagaagacatgattagaattcatcaggaaaataaaaacaacaaaaaagaaaaacagtttcacaaaaacagatgcttaaacaagagcaacaacattcagaattaaaataacctgtgatttttttaaaaaagtccttatcttggctaatataaacatgcttgcttgatttttatcaacctcatgcctgctacagtgggactaaattagcattcgtgattggaataggcacagacaaaacctaatagttgcacttactgtgcttcacgtatatgctacagtgtttttaaatacaatgcagtacttaactatttgcaataacctttgcaaagtagctggcttactctgaaagttttctattttttcacttccaaccaatgtcagggaggaaaaaagaacaaaacagagactttccttctatgaacttgttaaaggtaacaggttttgttttaaaggaatgttattaaagttggactcctttatgtaattggccaccactactgcctgggtacctttgtgttatcagtgatggcaagaaaataacacaacaaagaaagacaacgtaatgtctgaaaagtgttatcaaagatatatcaagtgacatgaagaaggaggggtgatggtatacttgccatgaatttgaggggaaatgaaccaaatcacattctgtgtcaggttagcaaactatgacctgtgggccaaatctggctcaccgcttgttgttgtaaataaagttttattggaatacaccatgcttatttacttatatattgtttgtctatgattgctttcatgctgcaacaagggtaagtagttgtgacagagacgggctcaaaaaacctaaaatatatactgatagagctcttaaaagcaagatgttgtcgatccctggtgaatgtcagtggctcctttatcattatccagctattcctaactgccctgcatgtgctgtggtgaaacagtgttggtttgaactgtaactgcttaatagctaggaaaccctaaattttctgagactcagtttatctataaaatgaaggttaaaaatacatttttaagcttattgtaaattcattgtagatgctcaataaatgttaatttccttcctgaccttactgtagtctgtgtaggtgtctcaaaaccaaaggcttctcaaactctttgtcatggcgttcgctctgtgagactctgcatgatttgcgagggggcccatcttgtttccatcactctacttctcaggccccagggacctgatactccagattctgttcagtttctcaaatgcaccacactcttttctgttcctccacctgtatacatggtattctgttgtcttaagatacttttctccgtctcttaatcttgatctacctgccctcttcccaactgcccttcagactctagcttaaatgtctctgcctatgagaggccctccctcaccacctggtgtaatataggtcctgtcctgctactcacataggacctagcattttcctccccttcataactattatcgtggtttgcagttttagatatatagaacctttttgtctaattttaaaatctttcttgctggcttagctactgcctacaagcacagggcacatagtaggccgtgaagaatatatattaaattaataactttttattgagcagtcttgcaatatttttatttcattaaggggactcaggatcatgttgaataaaaagagctgaattttttagactgacagcaaacaggctgcctaatttggcacaatttgtttctacctctgagtcttggttttctcatctgcgaaaggggggtaggtaatatctgtctcacaagtatatggcagagttggttgtggtaatgaacacaaagagactaagccatcactcattgtagggcttctctaggtttgctggcttggaaggatatttgacagtagataaagctgtaacccctgattctcccagatcttcacctcaatttggggatgattatacccacctcctgtgatactcatgtgttaaatgcgttagtacatatacaataattagaatactgagtacaacctgctaaatgctttagtaacgttaattatggttgtatttgtgattgctattcatatatcaactctagaggattatgtacactttgcccagaaaaatacacattcagacaaaaattctgtggacagctgcgaagaattcacttttcctctgaaactcatagccctctcctgaatacatatggtgtgcactaacacttgccattatctgaaactcatagccctatcctgaatgcatatgctgtaggttaccacttgccattggaggtcttggaggccatatcctgtaggagcagggtagccatgggacttaactactattatcccccaaaaatgttgtgtttgtgaattcacctgactgaggaatccctaatattcatcagatattcaaaaggatccatgttccaaagaagaggtttagtattgatttttgttggtttgtttatttgagcagtggggatgatgttgaaagaagcttgataaatagcaagggctgtagctgttcttttttcaaagtttagtttttacttttaattgtgtactaaaatctgcagctagagtgtgttttgcaaagcaaaatacccagacatttgaaaaacttgtgtatggactgcctgaccacctgcacagctgccagagcaaacttgccttgggatcagctgtctggggtctggggacccgggccctgtatctggcacttcaactgcctcattagatgatctttacttttgtaaaacagtaaatagcaaccctcataattctcacccgagaattagaaaaagcctctgttcccaaaagcacttgggatcttcacgggagagtctctggttacttaaatagacctaacactgaattcttaaaaaaaaaaaaaaaaaaaaattctctttgccagggggctgggggaagataattaaaagttgctgttggtatcatcatggaacagcagttagtggttgtaaaatgaatgaacatgtgaggcacatattgaaaatttgacatgctttataaatgctaaataataataatgatgtcacgaggctttcatttttaaactgtcttaattgcattcccagtttgagattgcagattacagtagttaattatagaagttggcccagagttaaaccttaaatcagatttccattaaagtgcatgactgcagcaaattactttacagtgggagagaaggcgagaatggcataatctctggttgagtgggatcttctcaccacccagggtggtgactttcctcttagggtgctgtggtgtatcgtgtgtcctaaacaatcccatttccctgagctaagcagcctgcgtacttctatgtcctgttgctcttcttgtagaaatctcaattgctttgttagtatttgtcatactctttctgttcctctgtcttcctcatgacttctcactctcctttttgcactttctctctctcttattcttttgcgttctctcatgccttctctttactgcttcttgttcactcattctctctctctctctctctcccatgctctctcatggttgttctgtatttctcattgtctctcatgcactcactctcctctctgtccttctgttcccctcctataacttctcttcggcgtttcagggagcctgctttcaagacttgcgtccacccagttctgaagaaggaagaggccaggcacggtggctcacacctgtaatcccaacactttgggaggccaaggcaggaggatcagtagaggtcaggagttcgagacagctggccaacatggcaaaatcgcctctctactaatactgcaaaaactagtcaggtgtggtggcagctgcctgtagtcccagctactcaggaggctgaggtatgagaaccacttgaacccaggaggcggaggttgcagtgagtcaagattgtgccactgcactccagcctgggtgaaacagtcaaaacgtgtctcaaaaaataaataaataaactaaaaaggaagaaataagaggatccaaattcccatccctggcatctggcacctgacaatcttggcctcacctgtatcatcttaacttacttcaccattcaaccattagttcctcagcgaactaagttgggtgacatatctgcctttatcctggctgctccctttatctcagatcctgctctttttttcttcctgtctactagaacctcacctattccaaaaatcctctgtcatgtcagcagcctgcatcaccgcctctcccttggtcttggctgtgtgagacatctgtagaccctgtatttgtaattgtcagtttattggtctggctctcaaactagtctttgaatcttccctgaggacagtgatgatacttcatccttctccatatcccaaaacttaattctgtacctggtacaagggagatgttgatcaagtgtctgttgaaattaattcattcattgttaaaccattatttttacgtgattatgccatatcatggattgtgctggctactgattattaaaaaaatgggaaaatacataatctttgttttagagaagcacaaagatgatccaaacacgggagttgcatcttgggatggggagaggaaggtaagaggagaataaagtacattggagaacaacagctattcatttctcagtaagtctaacaaaaccagttatccctctgcagttagaaaagaaggcttttcctggggttcagcaccaactaaagtagttaaattttaaccgcaagtggttatatgaagagtatctatttttaacatcggactctaattaaacacgagatactaacacatgagagactcatgggaactgatgccacctgaggcaacactgattcctgtttgacacttactccaggcactcacccactaagtagaattgaatcacagggtctcaagccccttctctcctttttgctcctatccctcactcctgcctgtttaggtgaattcacataagattatgatgtaaactatactctgtaaaatgatcgtaaagctttagatgggttaaacagagtcagtgattctaatttaatgagaattccctgagaagttgacatccgaacttgtccttaaggaatatgcagactggaacatggcagaggcatgcaggtgccaatgtgtgttttactagaatgccaagttcctctgcacaaaccttactgagcctcagcaggtcctgagtttctatcatggaccccatggagtcattcttgctcttgaatgtttttcttctattgttctggcaagttcctctccatcctacagttatttggaaactactgctgtaccaagcctcaatgctaacagcatttaatagctgtcattagaaagcaagcttctgcttaccagttgtcctactgtgaatagtaatgggagatttcttttctgggagtagccccaatctctaattggtttgaaaaatattgttcatttctttgattcttaaggcattacctttttgttgaatttcaataagtttgtatttccattatatttgaattcaacatgagctgcagtctactgaaaaaggttttcttacttgctctctaggtaacctgcccactttcatcaatgcttgctgaataaatgcaagtgtaaatacccattaagtacatttaaagccatgtggtaaacatttcacatgtattacctcatttaggcctttcaacatcctgtgggctaggtcctctttttattcccataatacagatgaggaaatgttcaagagaggttctgtaactcgaccaaggtcccagccctagcaacaacatcaatgaacaaatcagtagacaatctagggagctggctttgggcctggccacagccacatgacagctgtgtgaccttgggacaacatgccccaatgcgcccgatggctttctcagctagagagccaaccttcaccctacctaataaatagggttctgggaaggctcacaataaaaaataaggatttgtgtgatggcactttctaaacatttaaatgctatacaaatgtaagatattctcttctcatatgtttggtgtaggtaatttaacagacagaaataataggattctatgcagcacatatatatatgctttacaattagtgtggcataatttaattgtgactctactgttggaattttgatgcctccagcttcatgaacagccatttttctgtgggtgttatcaattaatctaggtaatgaattctcttcattatctcgttcttcatgttaattatacaggattttcttatgcctatttatcaagtcaggacaagtagagtttgttttttttttttttttggcccacatgcctttgaatatggaatatgtacaaacaagttaacatgatgggtgatgggtttaaatttacatttctaagaagctccagtcagtagcttgactttccttacattcttacttatgctataagcttggatctctttatttcgagagtctttttttaatcaaaaggttgctgtctaagataattaaactatctctgatttttgagaacatacctctagcatatcaaagaggtattaaggaagcatgaaaacatttgaatcttttttaccttttaatacaaaacaataaatggtttctgattttgaaatattgtgtgaggcaccatgacatataaaaaggcaattgtaaatcgtggaggaaaaaaacctaaatgcaagaaattttaaatgatactactcataaaaagaatagacaataatattttcagaaaaagaagacattatataatagacgaatgaatgatgattaaattcattttgagttgaaaagagtgattgatgggaaaatttggtaatgttatattgtgatatttattaatttattactaatatgagctttcttaacatgttctgggccatttttgtattttatgctctgtataaaacaaaaacaaaaaaacgagcagtcttattttaattgtctctattatttaaccagttatttttgagactgttggcgatcagcattttgattggtaactttttatttttgatttcaggttgaagccatccttgtcaatatatttggtggtatcgtcaactgtgccatcattgccaatgggatcaccaaagcctgccgggagctagaactcaaggtgcccctggtggtccggcttgaaggtgagtcatggtagatttccgctgtgccagcaccccttctccaaggtcaggtgaccagcatgttctggattcacaaacttcctgagataacagaacgaaacactagattgtgtaagatgaaacaaacacagtacggcaggacttccctgggcctctagcaaactaatgtggcttttagctctccaagtatggcaggtgttatgattctccagattttgaaaaattaccccagagcaaaagcccttttatttatgaatcattttatgagattagtgtttggggaaaaacactctgagaaatgtttctctgagaatcatgcatcataactgaggatcccaaaaagctttggttttttggcttatatttgtcaatgtttattaattgatttaattgataaattaatttgataactgaaattacttggaatttaaaaaataactcttaaaaaataatttgtatattttatggtatattttatatatcatatgtattatatattttatagcaataaatattttaaaaaatttttagtaagaataatgacattgttttacaggtttgtaaataacttttcacatttagcatgtctgtttctgcataaaatgttataacatgttttagttgaagtatatgaagaaaatctggcctcacagacatatgtgtttttcaaaatgggagtagttttgtccgtttgtttgtttgttagtttgtttgttttgagacagggtttgtttgttgcccaggctggtcttgaactcctggcttcaagtgatcctcctgcctcagcctcccaaaatgttgggattataggcttaagctaccacacctagccagggggagtttttaatgctcttttcatatagttctgaatattctttggtactacactaaaagtctattggtaatagtttattgaaaattagtgtccatgtggaatctggaactatctcgatgaacttttcatattccattaaaacccattggtctgtgttacacattaagggagttttatccatgcatggttcaaaatcattcactgatgatccagaaaatttgtgattatgcagatcttccaaaggttgtctcatttcaatgtacaatataaaaaaaatcacatttgttaatattaccaccatcatattagaaaagctttttagtaggaagctgtcaagttcacagggcaggtgcacattgtctagaatttgaatttgactttatagtgcaaattttatcagccacaaaatggttaagttgttttccttgatgggacagactcacttcactcatatttaagaaaatgtctgccagctaaccaagtctgagcaactatagtgtgtcagtctttattccaagaaagaaacagcatttcatggaaaagtgagcagtttagcttgatacccagacagttgcacgaacacttttcctcagaacagttcaagatgctgcagaagtgctttatgtgtgtttataatttggtcacaaagagtatcaaacagatgtgtaatcaagggttgaggtttaatgaaataattttttttctttttttttattttattattattatactttaagttttagggtacatgtgcacaatgtgcaggttagttacctatgtatacatgtgccatgctggtgtgctgcaccgattaactcgtcatttagcattaggtatatctcctaatgctatccttcccccctccccccaccccacaacagtccccagagtgtgatgttccccttcctgtgtccatgtgttctgattgttcaattcccacctatgagtgacaacatgtggtgtttggttttttgtccttgcgatagtttactgagaatgacgatttccagtttcatccatgtccctacaaaggacatgaactcatcattttttatgactgcatagtattccatggtgtatatgagccacattttcttaatccagtctatcatcgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttcctggctgctttgtttacgtaagcaagcctgggccatggcaggcacccctcccccagcctcgctgccgccttgcagtttgatctcagactgctgtgctagcaatcagtgagactccgtgggcgtaggaccctctgagccatgtgcgggatataatctcctggtgcgccgttttttaagcccgtcggaaaagcgcagtattcgggtgggagtgacccgattttccaggtgccatctgtcacccctttctttgactaggaaagggaactccctgaccccttgcacttcccgagtgaggcaatgcctcgccctgctttggctcgtgcatggtgcgctgcacgcactgtcctgcgcccactgtctggcactccctagtgagatgaacccggtacctcagatggaaatgcagaaatcacccgtcttctgcgtcgctcacgctgggagctgtagaccggagctgttccatttcggccatcttggctgccttccccaattttttttttcttactgtgagtatgtggtagtaaaaagtacaatgatctctcaggtgtagtgatgcatgcctctagtcccagctgagcaggagactgaggcaggaggattgtttgagcccaggagttcaaggctgcagcaagctatgatcatgacaatattctccagtctgggcaacttagcaagaccccatctcaaaaaaaaaagtacagtgactactagcacagtatggtgccactgccttgattccatgataacatgccagcggttttgcctaccattactttcaacctatgagtacaaatgccaacatagtcttctcttattgttattattactgccactattaactatgaaagtggtttttaccttaaggagcacccctctgcccctgcctaaagtgtattaggacgttttctctaaggtaaggcagtggatgtctaacatgggataaatttcaattactcacattatcctaggggtaaaatgaaaacccaaagggccaaatatagtagattatttacctggaaattgatatattcgatctaagaaagctagcctaactaatactttgatcaggtcctgtgagcctttgtctaatgtttacgtgtggtaaagtttaagcattaagaagtgttttttagacaatggagcagatttgaggcttgacggcagcatgggattccctcaatgtcttactgggtttaagctgatgatgaagaattgaacaccaggaggaaggagcaagggggttctgcagggaaaaggtggagaggatgcgagtgataaggcaggagaggtgaaagatgtcactgtgaagtgaaactggtcctagtaaggacatgtccacaggggtcagtgaaggaggaaggagatgaagaggtgagtgggcactggtgaggcagagagcaaagtgatgaacaggacatgtagaaaatggagacctggagagtaagaagagaaaggacaatgagactcaaacatacagaaggacaggggcatgcactgacaaaaacatcagaccctcctccaagagccacgtctccaatgacagcagcaacagaacgacctcagacaggctgtgggtggaggtgggaaacaggtccatcttaccttgcaaggggacagggcttgagtaaagaatagaagatggaaaattaactccgtacagaacacacgttggaaacgagcagcggagagaatgcctaaatccagaaaagtgcaaagaggccaggggacatcatcagacacagaactggaccttggctctgctggggatctgcattcactctgcccagaacaattccaccactcagctaagggcccgttctcaatgtattctgggtgttagcagcaaatcttgggctctaatattctgaatgaaaatgttttcaaagctactcggcccacagtcaatctaccgaggctgcctttttgataggaggtaaaggcattattactgctctcatctcttggtcttagaacctagcataactgaagacttgaagaatgaatagccacgaagcatatgggacacagctgaaaactctatggctgcctctaaactctttaatacccaaaggtttctttctctcctccagcagaccaaaggatcacataccatcatgtagcgaataggagtgcaaattgtgtccttcttagcataccgagtccatgctaagaaggacacgatttgtactcttctatttgtggctccagtttatcagtatttcagaatcaaggataagaaagtgtccacccagaggaggtacagtgcctagtcaagaaagcgaaagacacagaatatgtttatgttcacaacaactttagagaaagtttagggaatgttagagagatttgtaagaatgaagggggtgggataattgtttttaaagacatttggcaaaagaaaaacaaaatgtttatgttgctgaaacaaaccttttggtattgggtggaaaataaaattgagaagatttggctaagagaaacggtatccagtctacaaattatctcgaggtttattattaatatattaagagctcaacttggagtcataatgaacacctgagaaacaagcatattcctcttcagacatatctgagacatagaagtttgctgcagatttaaataggacagtaataaaaggaattcttaaaaaattattataagatgttggtggattctgataaagaactgtaaaaccactcaaaacattttgtttactgcgtttggccaaaacgctttgtacactgactgtatagagctgtcaataaatgtacatttctcaacagtttcatgggttgggccaagttaaccgtctaggcaatttttgtgccaaggtttttatacgtttcaaaaaggaaaaaaaaaaaaccctcatttcagataatttgttctttattcacaccagaaacaattggttacaaaggctgaatttcccccaaatatgtagctgttcatttcacgcaagagtcttttgaacaaaaataatcctctgtctcagttggtgagttctgttctgataaggcaagtaaatacatgtaattataaagttaccattttcaaagaggagaataatcctttccttatccactggtgaaacagcttgtaattattatacagctgagaacaaagatttgtccacaaaatcccactacatcaagcctgatttgattgattaaaacttttctcatcaggatatttttaatacattgtgggtgggcaacagaatctttaaaatgtgggctgcatattagagagactgatggcaaggaccctggatcttctgaatggtcaccaaacaaacaagaaggccacttactttattcacaggaaataggtagtagttacaaaatgtgccactgggttttgaaatgtctgttatctggatcactgaaaatctcacagttcttcagactgtgataaacatgtggcagcgtgcctgaaacttagaaagtacttaataaatattagcaataaaaattatgtaccattgtaatccagtctctggtaacatttttccatcacatctcatttttagtgtcacttggctttgtaatagctactgggatgatggagacccgttttcacctcactctccctagctagacaatggtgtgtgttgtgggagtctgagccaattttaatattgatatgaataaagaaccttgagaaattcatccatcaaaacagagtatagtgtaatgtcaggtcaaatagaaactaccactaaaagcgtccaaaatgtttccatctctttgtaccactttatctttctttgttcttgtagacaaatgaagacttgctctgtttagaaaaaaaaaacagaaggaaccaaatcatactctaaggttggataaactacaactaaatgtagagaaaattgtgagagaataagaatttatgttttgacatagaggaaagcaaatgaaaaatttagatggaagataaaagacatttcgcaaaggtccctgtagttggcaactttttctccactggaagtactgagaaccactatttgtgacaagatatttttggttttggttggtttttcattttcactgagctatctttgaaaaccacagttctgcatgtggtttatgaagggcctttaaaatgaccataacttctccatttgtctgtcacatctctccttggatggccccttgtattcatacatctttctccacatgcactctctccagtgttgcagcttcatctctgatcctctcccacgctctctattgagttccctttctgactttcccaagtccatcaactatgccatcattcttctggttcacagatttaaattccttagattccccttgttgtctcatctccttttctctctgctcttgcctccataccactttatatctgtggcaattctgcttgggtttttggttctgcctaatgtcattgactcggtacctactcagttttcccactctgttcttttagccgtaacatattgctgcaaagccattactctctccaggacatccttctgatctacccaggtcctgggcttcagtttttacctctgttacgaccccaataccaactctcaggtatggatgatgacttacttgatgactgacttctgatcctctacccactccttccttcttcctttgcaatgattcaattcttacctatcctccagactcaacttggaaattctccttttatactacttctttgctaactcacatctctaaatctactataactataatagtccatgttgaataagcataaaagtgggttatgccaatgaaagtgagcagagctacactaggcactgacttttgtcccttaaagggacacattattaggagtctgcatttccttagtctaaaaagcattggcttgatttgcatttagttccctttatggataataccttcttcaaatttctgcattgtttcacctatgatcagtgccaagaatacagttataacagaatgcttcatcttccctttattaggcatggtcaatacaatgttgggataggtcttgtcttgctatgggtctgctccattcacagaaatcacacatatgaatattagtgagtatccctggtagtttcatgttgagtgtgagaccctgtatctatccgaggacgtttatcacacaagatgccaattcccacaagaggaagaaaaggacaccagctaggactccagaaatgtccaaagctctcttgctttttctctcttgataaagatcccagattcttacggtaagagaggagctataatagtggaaagagggtagtggctaagaagggtcactatgtatatttttctttgcataaatttggaaggcagtgccctctttgatctcatcctgagctatcacattcaattccttcatgatacagtggacattgtgaagttatcaatatttctgaagattcagcaaaccagtctggtggctgtctgggatcccctgatggctacttttactaagatagaagcaggtcctattagcagataacacttgttaccattttatagatattgtcttatgttgttagttttttccattttattttcccagccatctagtagctgacatttttttttacatctctcttgatcctccttaatgcctaaagttcattgacctgcatgcacatggtatttactaatatactaattaactaattaaaaaaccacaggcataaaccttggaagtacatttagttaaaagattcaaatctgatcatctaacaaatttagaaatgtcaaatcttcttcttagtatctcagatagacctctgatgcaatcagcagagaatattaaggaaaataatcttgaatgtggtattttgcatatttcagcatgaatatcatctgcgtattataaaaatcacttaattcttctggaatactaagcagagtatgaaaataaaagatgcactcctttaaatcttttgggaaaaatttaaggcagggtaactagcttttctcgaaatgtatgaataactaataaattgtgggcctctgtgacaactcaggcacagaaaggatccccagaaagaatgggtcaatcgtagtgtgcattcatttctagttatttccagtgacaaacaataatataattggctgatagagacctttccccctttaagaacaggagaagagttgactcttaaaatctgagggtctctgatcactttgaccctgaaaacagtctgacatcaacattttaatcagaaatacaccaatactgatgcactcattgactccttgatcaattttttttcattgtagctttgtcacttattttccttttattacttttattgggatcaattatgctgcatttacacttctaagaagatttaattcatcagtatgttttaatgttcatattaggctttgctgactggcgtgtctgccattttcatttttcctttgtgattattatttctattaagtccatattgtgcagatctaaacatgtgaggcagacagtctcagggaaggaaagagaaaggagagtggcagagagtggaagaagaaagagatacaaagagagaggcaagcacagagaacaacacaggctacaactgtttgggagtcttcatgtcaaaggatgggggtacaccagcagagtcaaaatatccttggactttttcttgagaaggtctccagggaattatggctgcaacacagagcttgggaaaactgagctgttccaagaatgatactgtaaatgatatggcttgcctctgtgtccccacccaaatctcatcttgaattgtaataatccccacgtgttgtgggcagcaccctgtggaagataattgaatcatggtggtgggtttttcccatgctgttctcctgatagtgaataagcctcacaagatctggtagttttacaaaggggaattcccctacacatgccctttcttgcctgccaccatgtaagacatcccttgctcttccaccacgattgtgaggcctcctcagccatgtggaactttgagtcaattaaacccctttcctttatcaattacccagtgttggatatgtctttattagcggcgtgagaacagactaatacagtagatgttgactcagtggggctgcttgagtatagtaatctgagtttgttgatgaagtgtacaagacttttggatagttatcatattaaagtgtctgttattcaggtggataatgaggtcggagatcgagaccatcctggctaacacggtgaaaccccgtctctactaaaaatacaaaaaaaaaaaaaaattagccgggcgtggtggcgggcgcctgtagtcccaactacttgggaggctgaggcaggagaatggcgtgaacctgggaggcggagcttgcagtgagccgagatcgcgccactgcactccagtctgggtgacagagcgagactccgtctcaaataaataaataaataaagtgtctgttactgctgttactatggtgattctcagagtatggtccacagaactgactttctcactcctttgtgttttttcttggtccctctgagaccttctagcctctcaggaaggccatcctgatcccacggtgttccttaaaagtccagatcccataggtagccaacctaattagcttacctaatagccactgctcccattgttcacagcccatccagccaagccttggggttagggtctttgaagaggcccaacagatccttttccacctgggttctgatcccagtaagaaataaaatagactgaggaaacaaaagtattaccttcatcaccaaagaaaaaagaagtagttggaggatgcaccttattgtgtgaccaccagtgagcttccttactctaagccccagaattaggcagctttgtaaacccagtcacaggctccactagacttcagtgtaccttccatcccagggtggaacccaaggagcagaggatgacctggactcactctgagtggcatatccctaaaaggaaggccagaggaaggggcgggactacccatgccaactttctccattcaaatattcagtcagctccctacaccatcaccactcccggatggagccagtgataggcaaagagaacaggaggggttacactaatgactgtccctctgcatggaaggaaacatcccccagtgcacatcacaggtcttatctgccccaggagtgggctgcctttggtcgggtagctgccccactctaggcagtggtcatcccttcaggaacaagagcctgaagttgcttccctgagcagcagctgtgggtgtggccatttttataaggagaggttttaaaactgggcaggtaccaggactcgcatatcctaagtgctgccttatagtgtcagaacaccactgcgtgctctcgggtatcttctgagtgactagtcagttcatttcttcctgactcaatttccacttgaaagtcatatttgatgagccatcaaaaagagcgagcgagcacattgctatcaggacgagacttacaggtgattcagtctgtagtgtcttatagacgctaagtgtgtcccgctgagactcttccagagagcgccaccttgaggctgtcctgaggcagaactacctatggggaaagacttcatgagaaatgtttcagatgagggaagacagctttcatctcatgccaccttctctttattggcagtggctgcctgagcagtgctgtgccaagaaagattctgaggctatatcccagctcagtggaaaaagagttctatgatctttccagccacacatgtgggaaggggtggagggagtggaaattcgagccaatatttgccattgtcaattcaaagagaccataggtgggtttttttctcctagatatatagctgcttaccactatatcaagtcagaagtagggactgcaagctgggaaacaccagatgaagatgattcttgtcttcacctgaccctttagccacaaggccagaaatttggattgtatagagcaaaggtctacaaactttttctgtaaagggcaggattttaggctttgtgtctgtatattccctgttgtgattactcagctctgccattgtagtgttgaagcagcagtagacaataggtagaggaatggacatggctgtgtcacagtaatctttttttaacaaaaacagatagtggaacagatttggtccgtgagctatagcttgcagatccctagtgtagaaaagaggccagcagcaagacctagaattctggaaaatcctcacgttatctctatctaaatctcccttcccctaagctctgaaatgtctcgtgagagtcaagtaagaatttggcaggcaatattaagctctgagaatctgacttcttcccaaggaaaatattagcaatgaggtccactcagtcatttccccacgtaaggacagaatcacactgagtgacacagtgatgaatgtgattctgtcctaggcagtaatggtggaccaaagtcagcattttcgacaaaagtctcacactgttaaaattacctttgaaaatttcttaaatcatccgtaaattagagtatgcatggcttgaaagctaggaggaagattcaaggaaagcatgaaaggtaaattcacatgcagatgtttgggtgtataaaacatcccttctttaaaagaattgtcttatccctagcagatgatggcaggtgagcacagaagtgtaaggtgttcttgcttgccagagggttcattccattcttgtttaatattaaggctcctttaactttggtttagtatctatgttgctttttttcaagggttaacgtaattgaaagcataagcacgtagcatcagctctcagtgaatatgttagacttgatcctaaaccttgcttgcatgatcatagcacatacacaccattctttgaaaccgtgtagagaagaacttagccattggcttcctgccactggagctgggggctcctgctgtgatggtccgaataactatcacattcacacctcgagtgttgatttcttcttactgtgcgagaagaaatcatcgaggagattaggtgtggatacaatacagccacacagaatatcttatgtcatctttaatcttcataaaatgttaggggtacaaagcatttagatatgattcacattcaaggagaaatctaaagcctcaaagctgcagtaacttccccaggttgttcagctacttgggaacagaaccgggtttaaaatctcagcttcttcctctgcaaaatggaataaaaatagggcaactctataaggttgctgtaaggagcagatgagtttttaaataatttgcaatagtccttggctcagtaaatgttagctatccttattattatctaaacccttgtcagtatctcgactgaggccacatggatggccaatgctgttggctgccaagcacggtgctaggtattaggcacatatcatctcaaagaaataagagctgctgacatagcagaagttttgcctctgattctcaatgaattattctgtttctgacataaagtaacaaggcaaaagagacatgaaaagttatctaaatttacaggtcaccaagaaaatggacctcctctatctaattgccacttgaaaggagactaaggaaggaggtgcaagggtacaggagcagtggacatttgaggaggaatttgctgctttagagaatttggcttgtttccactgaattcccctctcccagtggggagaaaaaaactcagttacttccagcagaggggctgaaatactttaggctttcgaggccatgctgtctgtgccacagcgactgactcctcccattgcaaagcgcaaacagccactgatgaagcaaatcagtttggctatgttccacgaaaaagttatttatggatgctggaatttgaatttcatgtaactttcatgtatcataaaatgttcctgtgattttttcctcccagctatttgaaaatgtaaaccctattcttaacttgcaggtgatacaaaaagaggcagctggctcaattttgcccaaaaactagaacttgccagccctgactcagagcactagaccaagaatcagacctgtcagggttaactggttgtttgatccaagcaaattgtctgacatctctgggcctcattttcctctagtgaattccttctagcacttaaaggccagctgcgtggttatgtggctttaccctcaggtgaacctgggttcaagtcctggctcagcctctgacttgctggggatgtcgggccagttccgaagcctcccagtgtttttgttgcctctcctgtaaaatggggattaaaatgatgttgactgcagggttgctctgaggattaagtttcatgatacttgtaaatcccttaactcatgtatccaacaaacatttgttgcacctaatatgtactcaataagtgctaactactgtattcttttttaaaaaactgaattcctattaaaataataacttttaaattacagtttctacatatttccagactggaaaatgattttcttcacagccttatgataaaaggcaggaggcgtctgcaccttgcgaacaaaatcctgtaccatgtgcccactacctttattttctcttgtgtgtaataaaagcgaagaagaaattttgataaattaaccttgcatctttgtttacagctctcttactccacccagtggcagaaagtcactggtaacatgccaaggaggtcacgaatttttaacattttaataattgttattatttataatatcccctagtagtagagcaagatttcattttaaactcattcccctttgattttccatttttaaggcctgcagtgggtagataaccatttagctgagtggctctcaacaagcagatattaagaagtgcctgaggttccaccagcatgagttgatcagttatctgtacaggtggttattaaaagtgttgtcctgaaggctcattaaaaagcaatgtagcatttaataaatattagaacatgtcagtagcaccatttaaatgtgggaaggagatcaatttcctttgtaattctgtgcacaggcataaacactctttagaacacttaattccatgtcagagtttaaagcagctatgataatttctatttagaagtaaaggcagggagagggttggggaatagatgtcagacacttggtgaattaagaagaaaataaccttaaatactcaaataatatcattttgcaaaaaaggaatgcagaaactcacagtcatttccaaggcttcctctaattcttttcttccttttctttttcaataacctgtttccactctctgctgttttacttttattttattttattttattttatttatttatttatttattttgaaaatagaagtgggtctcactctgttgcccaggctggagtgcagtggtgcaatcacagctcactgcagccttgaccttctgtgctcaagcggtcctctgacctcagcctcctgagtagctgggactacaggccaccatgcccagctggtttccttttaatccctcttctctgcgtgtccccacctccccttccagttgttccctcaacaggaaggaggaagcaagtggtagttaacgacaagggcagggtcagtgggcagtagagctatgccttcaaggagaaaccaggttgaatgctgcaaagagatggtgccagcatcagggtaggggctggtgtggaaggcacttggcaaactcatttttttcctttactttctcttattctctacctgtcttttttcttatgtctgttcctttttgagctattccccatgactctgtctcttgtctctctcttcatttgtctctctctctatctccctctctctctctctacccccctttccccttctgtaacaagtttctacctggtcatgatggctctgcatatgacccatttctcataacagatgagcttcatatttgaatatgagaatcccttcaaaaactgcttagttctgagcatgcctagtatatgcttaataattaaggtggtaattaaagtgtaactgcaagtataattaaaattcacttttgtggatcctagaattatgaagcaattaggcattttcacatggcactgaaggagcagctgggaggagagaagggttgtggttttctgggaaactgctccgtcccctttcttccctggccctgtccaccagtgttagcctggagcaaggcctcacttgtctggggcacttgaagctgctacaggttgggagaagtggtaacagcttggagtcctcactcagggcagtgagcacagccagctcttcctgggcccttcccagcaaaaggagccactcccaaaacccctaggtaaccgtgagaggactccaaaaaaaaaaaaaaatccctcctgattgcaccttgagcagtttgcggtatctatttcaaccctataggaaagggttgttaggacagcaaggagatctatcaaaaagtacccgcccactcctcttctcgtcaagcacactttgtatgtgggaatccatctggagttaccccgtcggtcagcacgtactgctagctaacggatattgggaggtatccagtaagcaagtctgacaaaggaaagtggatgtttggaggggacgagggaagcatcagtaagtcatcccaataaggcttcatccatggtaagattttagaaatacaaggtgctccagaagttcattgtaccagcccctgctttagttggggcatggggaggtggtgattagaaagatatccccaaagaaataccatttaacagatgccttgtgaatgaatgggtgtcagcccagtggagagaggtgtcagcccaacagagctctgggtggaaagcccagcaagggcagtggcccagcacatctttgtgctcatgaatttctaaatcatttcttttcccttgggaatactggtgctaagttgggtgcaaaagaggatattaattaaggaactaaattatttagattacttggttgcaaggaagcacaactcattaaagttatctcaaaaaattaagaagatcaagagctcatttcatccatacacatgcaaaggaactcaggtaaaactgaataagaagttatctgaataagtgggaaccgtgataaaaaactagtctccagaaagagcaggatctgaaatggaggaagacatcaggagcgccactcctgcacctatctggaggtcttagagctgcattgagattggaaggtgctcaaaagaagaaaggaagaggaagaagggcctagtctacgtctctgcaggaggagatagaaatttacacatggggcacggtggctcatgcttctaatcccagactttgggaggccgaggcaagtggatcacttgaggtcaggaggttaagatcagcctggccaacatggtgagaccctatctctactaaaaatacaaaaattggttgggagaggtggccactgcctctcatcccagctactcaggaggctgaggcaggagaattgcttgaaccagggaggtgaaggttgcagtgagctgagatcacgccactgcactccagcctgggtgacagagcaagactctgtctaaaacaaaatttacacgtgtaactgtcatttaccttctggtccaaagactggtttgctcctgtgtccatcagggcttttgtttcacactctgtcattactccatgaaagccatgctttgattagtttctaaattccttagcctgctatctaacacctgccacagtcaaatgaatcaaagtgcacgcaggttgtgttaatgaaataatacatttttacatctgtgttacttacctatcagcacttaacaaattaccccaaaatgtagcagcttaacaaaaagaacagttattatctcacagtttctgtggtcaggaatctgggtgtggcttaggtggatcctctcactcagggtctctcacaaggctgcaatcacagtgtcagccgagctgtagtgatctcaaggcttgactagggaagaatttgcttccaagatcccttatatggttcttggccagatgcacttcctccttggctattagacccagagcctcagttcctcatcagccattggccagagtttgccctcagttccttgcccaggtgagtctctccagagggcagctcatagcagggtagtttgcttcatcagagtgaaaaaagagttaaagggagcaagactgaagccacaggcttttgtaacctagtctcagaagtgacactccatcacttttgccatgttcttatctattagaagtaaggctgtgggtccagatcatactcaagggggacggattctacaaagatgtgactaccaggaggcaagagtgattgatctttgaaaaccattttagaagctgccttccacagcatttacaaagtcatatgttagtcaaaataatgctagctcctgtaacaacagaaaaatgcagaaatttcagagtcttaacattatagaagggtctttctcattcccataaggtctaagagggtgagtgggtaagatgcttggctccagagagttattaaagtatccaggctgaaggagtcattgccatcttcaagaagtgatttggctgggtgcaagggctcatgcctgtaatcccagcattttgggaggccacggcagatggagtccttgagtttaggagttcaggaccagcctgggcaatgtggaaaaaccccatctctacaaaaaatacaaaaaatagctgggtgtggtgatgtgtgcctttagtctcagctacttgggaggctgaggtagaaggatcacttgggcaccggaggttgaggctgcagtgagctgagatcacaccactgcactccatcttgggtgacacagtgagagcctatctcaaaaacaaaaagcaagacaaaacacaaccagaaccaaaaaggtgacttccagggctgccccagctaggaacactccagaaagcagacaaggaaaaccgagtgtgaagagtccctttggagattgtcatggccatgtgacattcctttggcctgaactcagtcacatgtccccttcgagatgcaggggggcctgggaaatgtagtttctggctgggcagctgctttccagcaatagcactctactgcagaagaggagcaggagtctgtggtgcaaagccagccaggcctgccacagatactgcaccatttacaaaaatgcttttacactcatttcatttgcttctcatcacaatctataccatcagctatactgtcctcatttttcaagtagggaagcagactagcatatctttagaacatgcagcgtttataattacagagaacagttcaagtcccatctctgacacttaccgcctctgtgaccatggaaaagttatttaacttctctgtgcctcagttgccttatctgtaaaataggaacaataggactactcatagtttttgtaaagatttcatatgctgtgtataagttacttagcactgtgcctggcatacataagcacttaatgatattagttcttgggaagattacgaggatgatagtgctctgtatggaaacaaaagttaaggctcaaagaagttaaacgatttacccaaaactacataacaagtacatggcagagccagcatggagattttaggtagcagcttcccacattttatgctttcaccttccagagaggactttcaccagcttcctctgtaaaaacaggagtaggtgagccttaaggtgaagacacagtgccaagcggccatcttcactgctgcttgggtagacccagggtcccaggggaatcagtgctgcatcatcttttcaatccacccatttctatttaatccagcatttgcctctttatatgaaatgtgctgacccagtgcctctttttatctgcactctttgtggtaaggcaagttctccaaggcctatatttcaaggtctttgtttataaataggctctgtcttgccaactagataaaagcacaggaaatgatgtaggatgagatatttcattagacacttaaattctattacatttctcctacaggagttgttcactctaaaatggcagaaaagcagttctcatgttaaatagtccccaagcacacctttgaatgaagtgacttggccagaagatactccagatccaccaggaacagtcaagagattgccatcagaggctgctttgcccgttttgaagggctcagcccatttcattttatagagtgaggagaaggcagaaatggacatgctggatgcgccagagtctccaaagcagtggatttgtggacatagctgggcagattctcggaacttcctttctcaaatcaggtcacagcccaaacccctgatgacgtctgagagggctttaagacagggtgacttctggtatgggccaaaaccgcattaaatccacatggctgtgattatcagcagacaactcagcttccatcagtaaaatatgttcatttccctcttgcaagcccttgctttcatcttcttttctagctggaccacagcttgagataaatttcatcacataatcttttctgtcagtgaccttgatgagaacctatatttaattcatttcctagtgaaaagctgtagacaggtgagtcttgtgtgtccttgtgcaaacttcataaggcgccacctctagtttcattcagtgattgttccctgtcccccttctaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaaggcaagaatcactgaaaaatcttaaatctgtgttttctggaataagatatctagacagcctaaatctgattttggtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttggggagtgggagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgtttttttttttccatgatgtccaattttgttgtgggaaaggatttggataaaatttttgtttaaattttggtagatttttatctatacaaatttaaataaaattatgttttgtaagctgtaagatctgtgtgtatctctcattttactcaattttattcctcaaacattttttttttttacaaagacactagtcttagtgtcttaggtatgcctctaaaatttgataatttgggtcattccgggattattccagttccactcaactttatcagatacccatttctgtgttaggagattattgaatccataaaagttatacacaaaccagaaccccaggaatgtatctcagatgtctgacaggttgaactgtgatgtcagtctgcgtaacgcaaagggagatactccagtataactcattccattaagtgaggctcaattgccaccgttaattttcctttcagtgtataaatatgtagtagaccaaactattttgtttgttttttttaccagcttactttgttctcataaattttatgtgtggacaaaagtatgaaagtcattattgtttagagccatgtttgccatggagaaataaactattggatagatcagtcttacatcctttcttaatgcccatgcaatgaatgaagaatattaacaatgtcttcttagttgtgttttggtttttgatagcttaatcactagttggtgcagtaaaaaaaataacctatattatgtcaactagacaacatttttaaatttttgatctctgaagaggactatgtttgaatcacttgtaaatattgatgtttccagtcaacccaatttggaggaggggataaagcaattaaatcatttttgtgattatttcataaaagggttaataacaaggaaatagccttttattttcaaataagctcaaagccatcagagcttgttctttttgcatccttagcgtagcttgtctctaattgttttattctcaggcaggccatttttacaggtggataatggctgctggccattacatgtgaggttctcaaatttagcatcctcagaagagaaagagagagggagcagagggaaagagaaaataaatgagcaaataaacgaaagaaagagggaggaaggagagaggaaggaaagaagcttctcttggtaattctaagacacctcccaaaattgaatatgactccagtgatcagtttcaggtcagtaacctattcctgaatctggccccggttcatttacaataatttttgtggtcttctatacaataaatataggccataaaaaactcagacaagtttacatttaacatattaactacctgatatggtttggctgtgtccccacccaaaatctcatcttgagttgtaatcagtgtttttgattgttttggctttgagcttatttgaaaataaaaggctatttgcttgttattaacccttttatgaaataatcacataaatgatttaattgctttatcccctcctccaagaattaaattacaattcttctacattttattttcatgtctcttcctctcagttttctctctgaggaaaaaaaaaaatgtcattaagaattatattgttttttaagtgcaaagccttgataaaaattagaaggaatattattttttcacattactaaagtaaatatttgaatgtttgattgtgatcatttgtagaatacactatatgttcaaaattaaaataagcgagaaaatatatatcatagtggggaaggaaacaatgtggggaagtgaaaaggatatgttctttcatatttttctagatctggagttggcaaactaaggcccaagggcctattttagtaaattaagttttattgtcacagacacacccatttgtgtgcatgttgtctgtggctactttcatgctacacagcagagctgagtagttgtgatagaaaccttatgaccctaaaatatttcctctttggccctttacataaaaggtttgccaaccccagctctagataaataaaaaaatacaacattgcccccaaaatgacagcaacggagtattgttttcaaacctgagaaaggaagatttagatattaaagtgaaacagaaatggaaaagtaggaaataagatctttgatctttccattttaaaccctgtgagagctacaaaaagtctacaaaaggccacttgccaatgaaaaccaattcagttttgttactttttgtctttccatcaccacaaggactgtctgcagtagctccttgcacttttgaacatatgctgttcctaactgctcacaggtgcattggaataataccaaatcatggctatgaatattaaactaccaaagggctgcacctatcaactaactcatcctcaaagtgatccttgctagtaagtatgtcatgcattgtttagtcttggaaagactaaagcaaggaaaaaaaagtaactgcagtgtacttgatccccaccacattactgcaaaggcagtatccattttaccagtgaggaaattgtgacaaagtgagataaagttgctcctcttgagtttcgtagttaatggcaaagatgttggcttctggactttggattcttgtttaattctatcatttcttctattgtccagtaaaactttctgtatgacagcaatggtaaatatcagtgctgtccaacatatagtcatccatcacatgtgactattgagcatcctgggaactgaattttaaagtctaatgctaattaattgacagccacacattgctagtggctgccatattggacagtatagctctctggtctaaatctcctgagtattaggatgcgttactttcacttcagagaggctcacattgattaagtgctttctgtgtgccaggaactttacctgtgctatcctaattaatcctctttagcaactctatgaatctgtcattgttgttttactggtgagaacattgtaactccgagaatttaagtaacatgaccaagagcacaaaactagcatgtggcgagtcaggattgaaacttggtcttctgagtcaaaagccactggtctttgttttgtatctatggggacccaaattcactaaggttatgccacttatgatcatttgaaaggatgttggaggcaaagacatttagcaagctgggttcttgaatgtattgcttgccctgtgtatctcatactttgggaagcaggatttagaagcagaaagatcaccataagcaactggcaggtcatatggactacaatgtgaatggcacctccgggacttgcacaaggcataaggcaagggccattttctagggatctaattcccaagtgtcttctctttaactcagtgccttcccaacatctataaccatgaccatccaaaagacaaaaggcagaggggcagaagagataaaggctggaggcagttttatcatattaggagaaaatttagtttgcagcctttacccttcttctggagaagtttaggtctggcagtcttatctcatattttcatattctaagtaagccaggagcaattcctaggcaccttatgccaaatttcacaaatccaaaattaattaaattgtatatgccagctatggggaaattgtcaggtttttgttgttgttgttcttgttcctcccttgtgtttgtagaggcagcaacatacaggcatgtttattgggagctctcctaattcctttcctagctagggaagaaaaaaatgaaagtaagccatgatgtagtagtcattaacacatctgttttcaaacatcagacaacgggagaaactagaagatttggagattcaatttggagttttttttcaattaccttttaatattgaacattcatgtgctttaaatccttataactagttgccctgagcaaaacaaataatttttgaaggaccttgtattaaaaagcagaaacgacatcacaatgataaatcgttttaaataaataaatagccttgtattaggaatcacatacagcacatacagtagtcctcccttatccatggtttcacatttcagttttagttacctgtggtcagctacagtcagaaaatagattagtacagtacaatgaaatgttttgagagagaccacattcatataacttttattacagcatattgtcataattgttcaattttattcctgtttgtctcttactgtgcctcatttataaattaaacctttccataaggatatatgtctaggaaaagacatgctatgtgtagggcttggtactatctgtggttttaggcattcactcgggagtcttggatgccctgcaggtaaggggggattcctgtatattaataaaagtattggttgggttttatttatcactcttcatgtatatgatctcatggatacaaacaggtgaccttgccaattggtgctttttgtgtgtttaagaaaagaacagtagtaaccttgctccctggataccaataaaaaatctattatttttttaaaagaattttggacctctagttaaaagatcattgtttcccaactgcatgactctatcttgaaacatttacttattgttctttattaaacatatttttaattatcctatgttttaaataatttcttccaagattgcttcctttcaagagaacttttaaacattcagttaaataagaaccctttaaatttctgttaattgtttcaaatgttacataatttgtatggacccattgacagttgtaaactttcagaatattgcgtgtgaatttcaaaaaaatttgtaaaatattcgcatacattgaaattcattaaactatgttttctcatacttttattttttataaaaatctagtattaaaaataaaagtattaatattcaagtttgacaaaaatataagaaagtagatactcttcattaatttagtatttactatgtaatcagtataacgtttctggaggtcagttttttagtacagattaacagcctcaaaaatgttcatagtgccacttctttagggtatggaaatggcttctgggtaggaacaggtgaaacaggaaaacagaatgcctgggctgatctatgtgacagaagcaaaggttgaaatctctgtgctgaaagccagtgggcgtcttttcttctcaccatccagagctaataaatggcaacggcatacgcctccaactaggtagatgcttagcaaaatcacagaggagacagcatggtgcagctcttccaaacaagactgcacacaggcccagcggaacggctcccatccaccctctcctttcctccccgctacacacaacacatttccaccaatggcacacagcctcaggaaagtattgcatatgcacttcccagctctcagggaggtagacaactgatctcagataaggagatcagagagaattagcacacaatatatcagaacaaagagaaggtagacagctgctgtgttcatcatgaccaagaaaacaagaaacagaaacaacatggcatctgtgctattcagtaaaggaaagaggggtaagccaaaggcagaaaaacgaaggcaccacccataatagacaaataatcccttttggaaaaacatataactgaagaaaaacattttttaaatccctaaagaacctattcgtgtaatacttaataaaactattaattcagttaataaacaaaaaggtgatcaaatactgacataaaaacagaaaaagaagaaaagggaggtaagaaaatcagtggagaaggaggaaaacaatattcaagaactgaccaataaatcacaaaaagtaatgaatcctaaatatattgcaatgcacaggagagcccccaccctcagtgaagagttttctacccaaaatgtcaatagtgtcaaggttgagaaaccccaatttaactacatttactaatttaacataataaatgtgggttacggattcattaaaatgaaaatgccagccgggcctggtggctcacacctgtaatcccagcactttgggaggttgaggggtgcagatcacctgaggttaggaattcgagaccagctgggccagcatggtgaaacccctcctctactaaaaatacaaaaactagctggatatggtggcgggtacctgtaatcccagctacttgggaggctgaggtaggagaatcacttgaacccaggaggtggaggtttcagtgagccaagattgtgccattgcactccagtctgggtaacaaaagtgaaactctatctcaaaaaataataataaataaataaataaaatgaagatgccagaaaaatggaaacatataaaatagtggattgtatgattcaccatgaatgcagagggggaaataaagaaattaaaggaactaggagacaataatacataggacaaggacaatccaacataaggataattggtgtgcttaaagtagaaaagaccagcaactaaaaatgaaagtgattttaaagatataatagaataaaagtttattgaaatgaatgtgaaattgtgccaaaagactgaaaagaaacactgtatttcaggaaatatcagcaagttgatactttaaagacaaaggtttttaactttaagaataaagaaagaatcctttgggttccttgactaaacatgcagatgaacaaatgcagaggagaagaaattttactggactcatacttctcagccatttttgataccaaaagacagtgaagcaaatctgcaaaaatttttggggaagaatgtgtttcccaagaatatcatacccaaccaaaggcacacttttatcaaacattgggaataacttcaatatctaaaagtagtaaatggaataaataatattgtgtataaacagtggaatatcgtgtagccattttaaaaatgaggaaataaacatatacttttttgtgaaagaatgttcataatatatgctgcaaaagagaagtaataatgctaattttaaatgtgtttatatatattccatatataaaatatcttatagctagatacttggatacatatctatatagatagagaaaattgaccataacaatataaactaaaatataagtgtggaagaaaaatgggtgactttgttttcttttcataaattagtggctctcaactaaggacaattttgctctccctgggaaaattttgcaatgtctagagacgcttctctttgttgaaactggagacactcctcacttctagtaggtagaggccaaggatgctgctgaacattctacaacacagggtctgccctccacagcaaagaattattcaacccaaagtgtcaatagtgccaaggttgagacacactgattcaattatatgtattaatttactatagtaaatatgggtcattggtataataaagacaaaaattaccaaaagaaaaagcactgcataaagttaagtgagacaagagtatacttattagataaatatattaaatttaaaaagatacaaatgcttttacacatttctctgagatcttgaactaatttacaaatgttctatgattgtgaaaacttatgtaagttatactgttcttttaataatatactttttggggggataaatattaaactgcaaaaaaatatggtaaatacaaacccaagtaagtttgttttaaagctgatctattcaaataacatttaaaaatctcactcagtttacattttagtgtctcagaatgaaaactcatcttagttttagatctttaactggaataatataattagttactggttctcaaagagcatgtatttcatggatatgccacccagttttgttcaatatatagaacttaattttttctataatatgtgttgtaattattgatgactttttcatgttgctgtaagtctctttaactttgaagtgcagtgtctaaaattctagtatttgaaattatgccacattttgttccagtgatgaatgtcaaacagtatgttgatctatattgaggtgtttcatgggggtgaagcttgctacttagaaaaaggcattgtgtaaggacaatcagcacctcaaaaacatggctggttaaaggcaacatggcagaactttgcctcctgagtatacaaaaaagcatgttccaggcagctaacagttcttcccaaactctaacagagtgctggagggggctaaattctgctcaacgttgtcatcctatgagtgctcaggttgcaaatatggctggtgagcttcaggttcttctgagtcatttcatccttggaagccaaacctcttcaggaccactgtcgcagaatacaccattttaaaatagagcttggaaaatgtagctgattaagttgaattcaaacacgtgtttctctaccatctgctcttccctggcaccatggcagctgcagcgataacagagattaaatagaggcaaaatctctactcaaggaatgagtaatccagacatgcttagaactactcacttgaactggacaggacttggagaagcaatgcaactttccacttttctggggtttttttgttttgttttgttttttgagatggagtcttgctctttcgctcaggctggagtgcagtgtgtttagtagagatggggtatcactgtgttagccaggatggtctcgatctcctgacctcatgatccgcctgcctcagcctcccaaagtgccgggattacaggcgtgagccactgcgcccgaccaagtttccacttttctagtgtttccacactagaaaaagttaacaagatttttcccatagatgatgatcataccacatgttcatgtatatgttagtgtgagggattttatgtctttaggggcaggttttaggcattgaaaagatcttccagaggtttaaatgtgaataattaagttacaaattttaaagccaactttctgaatttgtagatctcattctatttataaatctattcaattttgaaaaatcacctttaaggggattgattcatgttttcaaacaatgaaactcctttaaatacgcaaactgcctgtacaaatttaatatatttcgttatagttttgttttcaattttatgctagtccgctccatttaagaaattctcacaaaaaagtttaaaaatcgtcaagaaattcttaagttctcttaaatgtgctgatactgcctgcatactcagtaagatttcaacttaaaattgcaaattttttatcacgtgcttagtcacacatgttagactgaacatgtatgcttagtcatacatgttagattgtatgaaaacaggacactgacctgttaatccaaatatttcttacatgtggaaaatgcataaaatatcaaatgcacaaaaatattgaacaatggagtgtcttaaacatttctacacttaatttgaatcttcctgggctaactgaagtcataactagtcactctggctagacactgtctaacactgttactgtagcatcactgatggtctctgagtccttttcacaggttaaaaacaacaacttcataatctgaacaaagtgattatctggtggctttcataacctacatagtcatactcagacttattcttgaaaatcgtgagtttcgttcagcttcttgattctaaaggtgtatgtctttagccaaatttggtaaattttcaactattatatcttcaagtttccagccccactttctcctttcaatacaggagttcggtgacataaatattagctcttctgttataatcccacaggtccctgatgttgttttcactttttcagtctgttttctctgcattgttcaaattgggtaatttctatcattctgtcttccagtttacagatgcttttctctgtgccctccattttgctgttcagctcatccatttttattttattttggttgctgtatttttcagttataaactttccatttggttctttctatcctgtttctttgctgaaactttctattttgttcctgtttcaagtgtgttcataactgttcagtgccagcattttttatgatggttgctttaaactgtccgttagatgattctgccattcctgtcatctccgtgttggcatctatggatcaccttttttttcattcagcttgagatcttcccagtataaagcatgttactcgattgaaacttggacattgtggatgttactttctgagactttgg

SEQ ID NO: 1037 - DNA, 2401 bp, Homo sapiens
ctcccgctgctcctcctccgcctccttcccctgcccgcgcccgccctactgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaaggcaagaatcactgaaaaatcttaaatctgtgttttctggaataagatatctagacagcctaaatctgattttggtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttggggagtgggagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgtttttttttttccatgatgtccaattttgttgtgggaaaggatttggataaaatttttgtttaaattttggtagatttttatctatacaaatttaaataaaattatgttttgtaagctgta

SEQ ID NO: 1038 - protein, 432 aa, Homo sapiens
MASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHLTKDPNVVGQLAKQMIGYNLATKQTPKEGVKVNKVMVAEALDISRETYLAILMDRSCNGPVLVGSPQGGVDIEEVAASNPELIFKEQIDIFEGIKDSQAQRMAENLGFVGPLKSQAADQITKLYNLFLKIDATQVEVNPFGETPEGQVVCFDAKINFDDNAEFRQKDIFAMDDKSENEPIENEAAKYDLKYIGLDGNIACFVNGAGLAMATCDIIFLNGGKPANFLDLGGGVKEAQVYQAFKLLTADPKVEAILVNIFGGIVNCAIIANGITKACRELELKVPLVVRLEGTNVQEAQKILNNSGLPITSAIDLEDAAKKAVASVAKK

SEQ ID NO: 1039 - DNA, 24127 bp, Mus musculus
  misc_feature (1)...(24127): n = A,T,C or G
gtggaagctgtttctagatgggatcctaagaactgcagcagtgaagggctaaaagctgggaaaatgatgtaatgggtggcatccctttgcccacaggttcatatggctctcctcatcttgctcttcctgctgccaagtcccttgcattcccagcacacttgtagtatctccaaagtgaccagcctgctggaagtaaactgtgagaacaagaagctgacagcactgcctgcagacctgccagcagacacaggcatcctccacctgggcgagaaccaactgggtaccttctccacagcatcactggtgcatttcactcacctcacttatctgtacctggatagatgtgagctgacgagcctgcagaccaatggtaaactgataaagctggaaaacctggacttatcccataataacctgaaaagcctgccctccctaggatgggcattgcctgcactcactactctagacgtctccttcaacaagttgggctcactgtctcctggtgtcctggatggcctaagccaactccaagagctctacttgcagaacaatgatcttaagagtctgccccccgggctcttgttgccaacgaccaagctgaagaaactcaatctggccaacaacaaattgcgtgagctgccctctgggctcctagatgggctggaggatcttgataccctctaccttcaaaggaactggcttcgcacaataccaaagggcttctttgggaccctcctcttgccttttgtttttctccacgccaacagctggtactgtgattgtgaaatcctctacttccgtcactggctccaggaaaatgccaacaatgtctacttatggaagcagggtgtggatgtcaaggacacaactcctaacgtggccagtgtacgatgtgccaacttggacaatgcgcctgtctactcctacccagggaagggctgccctactagtagtggtgacacagactatgatgactatgatgatatccctgacgtccctgccacaagaactgaggtcaagttctctactaacactaaagttcatactacccactggagcctactcgccgcagcaccttctacttctcaagacagccaaatgatttctttgcctccaactcataaacccactaagaaacaatctacattcatccacacacagagcccaggtttcaccacactcccagagaccatggaatctaacccaaccttctacagtctaaaactcaatactgtactcatcccctccccaaccaccctagagcccacctccacccaggctaccccagagcccaacatccaaccaatgcttaccacctccaccctgactaccccagagcacagcaccaccccagtgcccactactannnnnnnnnnnnnnnnnnnnccatggattctgagaaccaaactccagacctcttcaagtagcagcggcactgttacaagctaagccatctctgcgggtgtaggagtgaccaaggtaacccaaagcagacagtactgtacatgtccacagacaccaccgttttttttccaggtcagaagccactgctcgcctcctccaagtggcccatccctggtgtttccactcacttcacatagcatacctggatccaagcaagctgaccagaatcaaatccgatgggatggtagcattcctggaggaggggtagcaaaaacaacactgagactctgagggacacatctctagttcctagatgtggaagcttggacaagtgaagaaagcatcatgggtatcaaaatgtctcactgggtaaatgcttcatgcaagcttgatgaacggagtttgtttgatccctggatcccacataaaggtggaagagaattgattctacatagctgtcctctgcctctacatatgttctgtgacgtgtggacacatgcatacacaacacacacaaataaacacacagagagataataacattattaaaagtataaatgtaataataaatttgaacatctaagtgaaatagatcattttattaggaatataaatcaggctggcaagatgggtcatcaagtaaaaggaatttgccaccaaacctggtgacccaagtatgattttcctgggacccacatggtggaaagagagttctctcccccccacccccgctcacaagctgtcctctgtttccacacaggtgttcttgtatttgtactcccacctttatacaataaagagatgaaaatgtcatcaatcagttacccactgtttctgtacttgtgcactcaggcagggaaccctattgttacttcatgaccaaagcaaggatcctggtacaggaaattgacccttgagtagaacaaaatgcaggaccatttaggtagagagaacatgaacctctttcatgtttgttctttaacagtatctttgaagaaacagaacatgcgtcctatttcagaagctgaaaataaccaaacctttgccttcctaggctctcttggcagttgggtcacaggcatatgagcaaccagactcacatccaggtttgccttcgttcataatcacagagaaagagggacagtgtaggagtctctgcagcactgnnnnnnnnnnnnnnnnnnnncccactactgccactctgactaccccagagcacagcaccaccccagtgcccactactgccaccctgactaccccagagcccagcaccactttaactaatctagtgtccactatctccccagtgctcactaccaccctgaccactccagagtctaccccaattgagacaattttagaacaattttttaccacagagctcactttactccctaccttagaatccaccaccacaataatcccagagcagaacagctttctcaatctcccagaggtagctctagtaagctctgatacttctgaaagcagtccttttctcaattctgacttttgctgcttcctccccctgggcttctatgtccttggtctcctctggctcctatttgcctctgtggtcctcatcttgttgctgacctggacctggcatgtgacaccacatagtctggacatggaacaatctgctgcattggccacaagcactcacaccacaagcctggaggtgcagagggcaaggcaagtaactatgccccgggcctggctgctcttccttcaaggatcactccctactttccggtctagccttttcctgtgggtaaggcctaatgggcgagtggggcctctggtagcaggacggcgaccctcagctctgagtcagggtcgtggtcaggacctcttgggcacagtgggcattaggtactcaggccatagtctgtgacagtgagtggagatcctacgacttcactggactctactaggatctaactgggatgggaggctgagacaattacaggacatcctagccatttctcctttatctgaagccccctctacatctaggcacccagatccagacctcacaaatcaagaggtagaggtgatggaactgggtggccacaggatcagcctcccacattgagcctccactcagaacattgtcaggctacatggtcactactaccactttgtgagggaaaaagctagaaaaagcaaacagaaatggagcatggctcccgctcattcatacttggaagaaaacttggaaagccattagccaggatgggagcactatccctaaatatcatgagtattttttccctgtttaacactttctggttttctaccaatgttatcatttgtataataaaaatatttttaaaaataaaatgtagcttttggggggaaatgagagcggctgaagcacctgttacaagaattcccaaagtcccaactgctaccatcctgatcccaaatacccaacaaacttgtagctgtagctgagggtggcaggtaggacacctccaccttagtgattcatctcctgcagagcttggcttcccgtcaggctacctcagtatcaagtctagaatagaaaaggctctagagctaaagctgcctggctgcaggagaggcggctatgctcctcacatgtgtagtctttagaacacaactctccttgctggccacgtcagtgggactggcaaagggtgtggcagcctgttgggtttgagtctcctgttttcaaagctggatgtaatggcatctttctctctcccaaaatttcatcgattctcccagtgaggctttcttccacacctcattttagtttaattcggggattgggggccagataagggaaggaaggttgcactttccggggtctatggaatgcccttctccagatggttctagatcttccggtgaacctgactcaatctctttcctgccattaactcttccaagtagaagacaaatcttagaggttagccatcagacttttcttcatggacttcacccttctgaaagcagtccttttctcaattctgactgctgttttctccccctgggcttctatgtccttggtctcctctggctcttatttgcctctgtggtcctcatcttgttgctgacctggacctggcatgtgacactagtgtccagcttcatctctcatggtgttcaccttcatctctcatggtacctcatacctgaaatgtctcatgggtcacctgtgccagcagtagtcttcttctgagcccatcctcactttagctaagagttctgcctccttctcagtctacctcactactaccatgaacaaatctttctcctaagttgggcaagatgcagtccactgctatagccatttccaaatgttcttgcatcttcttgctggactttaaactccttaagtaaaggtgcaggctccaaatgtctccaggtggctacctagggtggcctagggcatgctgcgcatggaaggattaaggaaagtagcggcagaggcaccaggatgttgcactaccatcttttttgttaaggctttgccaaagggacagctcgcacctgctgcctgcctgttgtctgacctggcatacagccctcaggctgcctagcacgtctcctggtttgacctttccatagccctttatatgccaacaagtctgtaggatccttgagagcctgggaatcatacttcttaaaaaaatggatgaaaagccgggcagtggtggcgcacgcctttaatcccagcacttgggaagcaaaggcaggtggatttcttagttcgaggcgagcctggtctacagagtgagttccaggacagctagggctacacagagaaactctgtctcaaaaaacaaacaaaatggatgaaaaaaataatcactttctctagccaacccagtttctgatcaatattctttttgcctcaatccttgggtttgactccgttatatcccccaagagctctgaacctctcactcaaccactgtggctctagcccatagaagtccagggggtttttgttgttgctttggtctttcaagacagggtttctctctgtgaccctggctgtcctggaattcactttgtagactaggctggtcttgaactcagaaatctgcctcctgggtgctgggataaacagcaagcaccactatgccctgcttcaatttagacttgttgtcccttccctcttgatgctgaaaaggcagatcccagaggcttttcctgacaactgtgatataatttgtgagtcagccacattttgggacaaatggcttgcaagtatgcacaaggcccagttttttcttcttcttctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaggcctgagccaccactgcccagcgctgctgcttcttcttcttttctgtcagctgttgagttacgactttacacagcattttcataaaaccagtaggtgactttctttaattattttgttaaaactccagtttgttttccagagatataagcttctttgtgcagctacctcccccctatgatccttaagactatccagatttggggttggtatttcaatccaatttattaagtcctcagggaggaggaaggccacatcttccaccatagaccctttgtcatcttgacagcttctgctttctcctgtctcctcagctctgccttggattccccagagagagggatctgctgtctggtgtgccctgaatctaacacccaagaggagactagaaatccttggtgtgtgtcttaggtctcctcaggaagagccaggggcaaagtgattctaagcatcaggcaagcacagcaggcaggctggagtagggggagaacagactaagttctttaccgcaaaggagaaaaccacactggagagggaaaataaatagaatagcccagggtagcagaatccaggtcctccagggcatagcgactgtaatagcagtggatggcttggaagcctggcacactagtcctgggaccatgccagatcagccactgaggaagagacgcttgtaggccttgttcatctgttccaagaagatgaaggtgaggacagtgtgggggcccagtcgggcatagtatggtgtgaagcccttccacaggctgaagaaaccctcatagcggacgactttcagcagcacatcctagacagacaggcaggcaagtgctggggctaggccctggtcctggtccaggctctgtcccctgtccctagctcccttcgcatccctcccagggcaccccttcccccccctcctcaccagcccattcttgtattctggcttcccatcaatcatccgcatattctggatcctgaaagagagtcagtatgaacatgaaaaccagaaaggggggcctccccaagttctccagtcccaggctgcagactcacctagttttgacgatgtccacaggcatggaagcagcagtggtaacgaggccactgatcatgctggcgcagaagtggcagagaatattgtcagagaagtagcctgggaggtgaagcaaaaggtggtagtcaactctcaggtagctcaggccaggctcaagttctcagctctgggtctctcacctgagtccagcaagaactgcttagattgagagtaagaggcaagctgggcggcattgacaacgacagctcgagccatggtagggatgcagccctggaggtggagggtggaagcaatggagacagtcaaaagtgccagagatctaacccagcatggcccaagactccatcccttgcactcacccgccacagtgtggggactccttcttccctggcaatcctaactagggcattaaacacatttttgtagccacggcgctggtcagctggaagcctgggggaaaggcagggaaaggccaagatcaggacagaccagggtccatggaacaaagaaagggaagcctgaataggtaagtgccctgatgtagatatagactaacaacaccatcctagagtccaggaatggggctggagttaagctcagaaacagaactcaccgaccatcagcagtcatcctgatgagagccacctcagctggcgttcccacaaatgcaccagttgcacctgcagtcatgccaatcagggctttcagaagaaagccagggggtgtaccatcagccccagtcaggcgctcaaacaacacagtatatattccaaggcgagtagtggtgtaggtggcctggcgcagtagaccagctgacagcctgaagagtagaaatgtcagcacatcaggccaaggtctggacctgccaaccaacaacttccctccccaacttgaggccacagtacccagtgtaaatgcccttcaggccttctgtcttcaggatgctggtgagggcatggaaactggttttgtactctcgagtcttggccccttcaccactcaactgcatccggttcttcaccaggtccaggggctgcacaaaaactgtagcacccatcctgaagtgaggcaggaaagggaatcagaggtcagtggttccagctctactgcaacctggcaagaagttacaaaggtcagggccactaaggattcaggaggctggtgggcatgtgtgttaagtgtgtgcatcaagggcaacgtgccagcaaaagagtccagttgcccagtaaggggcatgcaaatcaaaacgcctcaggcagttctttagggttcaagcagaattaggactacaggcggtctaaagaaaggtggagagggcgtccccatcctaagactccaagcagtcctataacaaagcctttaatgacctatacccaccacccaaacaggcacaacgaagcaaaggtagtggaaacacagggtaaagatccttgaatgcagcacagttgggtccctgcaaaggatgaatagatcctggcaacccatcagggaccctgcaccggctcaatttactgcaacacaccccaagttacactgggcccaggtgcttgctcccgtcccttcctccttttccccccatcactggggcctgagcttacccagccaggcccccaaacaggaacttgacagacttaggggaggtacggggtttcccgtccatccggccagccccaggactcgccgtcgccgccatcgccccttgatggccctcggctttgggtcccgtgcacgtacagccccgcttgcgcccaaggtgacaccagcgcgcaacagggtgagggcgcgcgcgcgctcgcccctccgacaggcaaatctggctccagctggaagctggggcgggcgcaggctcggagcgcaaaggcagccggggaataaggcggggctaagatgcacgatgaaggggcgtggccgacttaggaagctaccctaaattcccgcccctccggaattggaatcgcggggaaaaaaaaaaaaaaaatagcttgtttgaaaacctcgcgagagcaagtgaatcagccgagttcgggctatgaggcctctcgcgatatatttcagcggcgaaagggggtgggggggtggagggagggtggtggcaagcactctcgcgatactttgaacgtaccgtggcggccagacgaaggagaggtttgtaaacagggcagctccaggatctcagggactgagggaaaaaaactagatcgtctcctgagcatcgaagctccctccatctccgcaggctccttctacatgtcaaacatttctttcaaccggcctctcgggaccggaagtcctccgtcctgagcgtccaatactggaagcggcctttcttaccggaaacccttttccaggggcataggaagacagtctacctggccggaagtcccacctctttgaggtttctcctacccttcctgaagtttttttgttgttgttgttacctgtttgccttcgctcctattctgtcttatttctgtactagagaaagatacattgtctcccctaccagctccgctaagctggtttgatagctcactccctgaatcggagttccttccccgacgcccccatgtagctgagaagtgggacctaggggtggttggacccctgggatcctgaaggagaggcagaggagggcgcaggactcggcttctgctcctgcgatcagaacgcgaccttcgcagctttacccctcccgctgccatgcaccctgcggccttcccgcttcctgttgtcgtggctactgtgctgtggggagcagcccctgtccgagggctgattcgagcggtgagtctgagggtcggacggggacagggtgctgagaatggggttcagactgaaacacgtagtgttccgtctgcagacttcggagcacaatgccagcatggactttgcagaccttccagctctgtttggggccactctgagcgacgagggactgcaggtgatgttttccccatttccctatatggatcctgggtaggggcgaagtggccgtgctcaggaggtaggaagtagtggagttagcagcggaatgcagtggactgcggatagttcaatgatagggtgctttttctagtatgagtgagattctaggttgaatctccagcaaaaaaaaaaaagtgtccccaatccagaaaaacctaagtgcatgatcatgtccagcgcgcagagtccagaatccagagataatagatagtgcccacctctagaacttaacattttttattttatatgcataggtgtgagagtgtcagatcccctggaactggagttacagtcagttgtgagctgctacatggatgctaggaactgaactccggttctctggaagaacagccagtgcgcttaagcactgaaccatctacaacccctagaactcccaagtttaagagggagtctgagagtgggctaagataaaaagcaggtgcttatcagcagtctctggagcaacttactgtttgtatagatggccatggacagctttttatgggttctgagtcaaatgagaaatagaaattaacctagggctatcgtgccagtgtgataagcatgtctgtagtagttcactacaaagttcatgccacatagcaagaattcattcggccacagttagcagtagagttgtaagatggctaattggaaaatgaaacttgttgaaaatgccatgaatgagtagcaaggtgaaccactatcggtgggaaacttaaaagcagaactaaactacgcttgagaagttaagggagcctctggtaagggatgtagtttactgtaactgcatcttcaagaaagctgagagatcccttttcttttttcttttttttgagtctggactctggaactctggctgtccccaactcacagtagtctcaagtgctgggattaaatgcatgtatcaccatgtctgagttgtagattcagtgttgggtgggatgctcagacctccagaatgagcaatgatagagctgcagaatgcaggtagtatatagtgttatgtgtggtaggtcctgtggaagacagaactaaagatgaaaatgtttgcctttatccctcaggggttccttgtggaggcccacccagaaaatgcctgcggtcctattgccccaccaccctcagccccggtcaatgggtcagtctttattgcactgcttcgaagattcgactgcaactttgacctcaaggttgctgaatggggaatgggaggtggtaagcagggtacatgacaccaggaatgaagggcaagggtgacagctctatccctcccgcttggcctccttaggtcctaaatgctcagaaggctgggtatggtgcagctgtggtacacaatgtgaattccaatgaactgctgaacatggtgtggaacagcggtaaggaagaagcctgcactactgggtgcaccgtggagttgagtgggagggcaattggttgagatctgcaaaaagtgccaaaagccagtttcagggaattgaggaacagaaggctaaatccctaatatcctgctccttacagaggaaatccaacagcagatctggatcccatctgtatttattggagagagaagcgcagagtacctacgagccctttttgtctacgagaaggggtaggacgcatgctttcttccagttcttctcaatccactcaggctcaggctcttcctcggctgccttgactttctcctcattatgccttgtcccaagccagtaaccctattttacctggcttgaggttgtgtctctctctcctcagggctcgggtgcttctggttccagacaacagcttccccttgggctattacctcattcctttcactgggattgtaggattactggttttggccatgggaacagtattggtaagtagctgaggagaacttacgatgccagactggatcggtagaggggagggtttattgcattttccaatcattttttaagcctggtccactcttccttatccctagatagttcgttgcatccagcaccggaaacggcttcagcggaaccgacttaccaaagagcaactgaaacagattcctacccatgactatcagaaaggtaagggcaggagaaggggcctttctcctagctggcctcatcttgaaggatttttgaacccagtaagtagataaagggttcaaaaaagaaccggaaaggtgccacctttgcttggttaaaaaaaaaaaaaaaaaaaaaaaaaaaaaaaaaagatgaccaaccaaccacaagcaaaggaggtagggtagagcaggcgctggaaagcagagatgaacaaaggaaacttgactttgtgtgtggggtgtaagaggtgtaagagccagaagaactcaaagcaagcaggtgaggggttgggttatctagacttggagcctccagtaccatataaggctatagcaaacgcctcgcccctcccagttctgctttcccctcctacccccccccaactcacttcccttatctctgcttgtcccctctagccccaagattttatgtggtgccctaagtttgcactggcttggtagaaaacggggcaataagacttgtacagtgagttttcttgggcgtgactgccaatagttgagtgaatcctttcctttcccaggagatgaatatgacgtctgtgccatctgtctggatgaatatgaggatggggacaagcttcgagtacttccctgtgctcatggtaaggcccacatgtgcctgtgtctgtgttcctgcccaacctgcagagaccagcctttcatataaaccactccacagcttatcacagtcgctgtgtggacccctggctcactcagacccgcaagacctgccccatctgcaaacagcctgtacatcggggtcctggcgatgaggagcaggaagaagaaactcaagagcaagaggaaggcgatgaaggggagccaagggaccaacctgcttcagaatggaccccactcctgggctctagccctactcttcccacctcctttggatccctagcccctgctcccctggtcttccctgggccctccacagatccctcacctccttcatctgctgccctggcctgacacccccatacttggtacctctggtgaccgtcctatttgcacaaactctttttccagtctaataagctgagggtgagggataggggacattctaccccaggttcatgaacccagcctcatccttttgagggggctagaagccatagggacatggttttcatttcttggattaataaaattggtttttttttgtggatgaaaaaaaaaggttaagatcatctttacacaggtgaaattctggaaaaataatcacctcataggatgaacttgtcgggggagagccctagctgcatttgctatgactcagggaggggagccccacctacacaggatgactcaagtggccctgcctcacccgcaggcttggacccattctctggtctggatggctatgttccattacatactaattcaactggacctgaaaatggaaataccactatagaggggcctaggtcacatgactaagtacacagaagaatgcctacttagtttagtccttggggcttagaaaaggaaataagactggaaataagagttcattctggacacagccaagaagcaggtacctaattgaggtgggtcactgtgcttgtctcccaactaatgccaagtgcaaaccaacacaggtccttgttagtagaatctttttttattcagaaaaaaaaaaaaaaaaaaaagaccaaaaaacaaaaaatgaaacccaaaaacaaaaattttccaaacacacacaggagggggtatgggtgggggaggtgtctgtccatccagccccagcccccagcccatgtggttttggcagcaataagggaaatggggtaatggcccaaaaaataatggtatgtgtgtgtatggaaagaagggggtgcaaaagccaaagggaacggtggggggaagggacagatgaggtcagtactgggaacgccgcaggtgagaggccatttcataacatttcttgttgatcaaaccaccgtggacaccttctttgcccatcagcaggactagcgctggaggaaagaaaaaggaagctaggacccaggtgtcacaattcaaccctgccagctgttcagcagctgtctggccccgggggttgtaacctaacctcagccctcctaaccagccctcccccccttatacacaggcaggctgtcagtcatcctaaaacaatagagcttttcaaagaaggaaaaaaaaaaaagagctttaagagtagtaaagaaaaaggcaaaatttagaggtcctaaacttccaggctgtaggtggctaggaacggctgtgatgcgcttcctacctctcaagtctttacagaactggagattagagccaaatgctgacttaagatcccaactgccctaagcaaactaatctcaaaaaagctcaaagcaagaagggacttaagaggtaatataagttttagtttctttacaagctggggagccagagtcagaacccaaaggaccatccacggttcccataaccagcagagtaaatactgttatgcagccttgacactgaggacacataaagtgactaacaaaaggatttcaaagctagagaatcagtcaaactcactcttggcagtcatggtgacagtgacattgaaggtgggggctcctccggtgctcttggtacgaagatccattgtaaattccccgtcttgcagcagtgagtcccggatcacagaacatttctggcccccaagtgtcagcccattgacgaaaaaacttgaccggtctttgcctaccaggacaccaacctcagctggctaaaagaattaatcacctcattaagttagtgcacctgcataacttgtcctcttatgtactgtggagctggagttgagggtgcttcatccacaccaccaaaagttggggggaaaacccagtactgtgggtattgcagagaccgatcatggtcctaaagtctggtaaatgggtcaaggaggaaaaagtattcctctgaagtcttagatgttcatgcttaatagggaaagcaaatgctgggtaccagaaatcgatcaatgatcgagggggagcctttggatgctcagaacagcccttcaggaaaagcagaagcaaagaggggaagggagggggtaggaagggaggagaagtaactttgtccttatttggtcaaaggttctgcaggcgttgttaggagccccggacgcctgggtctccgggtaacctggagtttgggtccaggtagctatgccccaagataaggaagctgaccccgggggctctctaattaagttcaaaaagtttattagggcaggagactagtctgtgtgtgagtctagacatcccagagaacctttctccttctcccccttaaacccccaaacccctatatccggtaccctcccgcccggaaatcccctccccccattcgaacttccgctccccctccccacttccgggcagtgtggtcagggaaggtggtggtagggacagcagcaaccttattccttcacttttaccgtctcagaacttctcacaaagttcccctacgccgggcccgggcggatggcgggaagggagggcgaggggacttccggaatcggcctcccaggaatgttgaggctaacgtgccgacttggggggtgtgtgtgtgtgtggcggcctcgccctctctaacggagctgggaggggcagggtggctaccgaggtccggcccgggcccaaggccacgcgcctggcgctcccatcagcgtcagggggaacaatggtggagggagagcgagcattcggcccgaaggggagtccaggctccggagccccttatcaatcataatcccgggctaaaactgcagcgcgtgcccgccccgccctggaggaggcggaagtgggccgccgcaccggccgccgcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaacccccacctccgcgggagggaaggaacggcgggcggcggcgcgtgcgcccgcgcctgcgccggggcagtgagaagccagcgcgtggggcggttggggctagcggcttggctgcgtgagcgcgcgcctggcgggacacatttggaccatccgaggagggaagacgcgtccccagcagtcgggacgggcagacgccccgggttgggccctgctgccttctccacatttatctaaacgataagggagcaaaagtgaaatcgatataatactctagtcattttcagtactaaaggtctctccaaccagggcacctgtcccaaccgtctgccatgtacagcgcacacgttgggttcattcgagcgcgtccccagattcccgaggaatcattcccttcgctggatccgctccagctcagcctcgccccatgcctgaaccctgtctacagaggtcactgaataggggcgccacccgggtgacacgacgggactcatttttcaaggcggaagaatactaaagtaccaaggatgacaacttttataagaagaggaaagtcccctctactttggacgcactggggctttcttcttttccagaaaaacttttgctaagtatttatgtgcggtcagctcactcgccgccgagcaggtctaggggcgaatggcaggccactgaggctggagggagtaaaggagtcacccgggaccctggcctccgaggggctcggccgcttccggtccctcggaggaggggcgccagggtgtgcagcctctcccagtggaagtacttggttcgctgccttttggagccgggttgggttccctgacgttcatccccaaattctggctccccacgccccccagccgaggttcttcgacagccgcgtggctgagtcacgggcggggccgcgctggggcacgtggcggcctgcgcccgccatcccttgacctctgatctgcgcgcctcctgcccgggggtggaaaaatcccgcagggagcggcaggagataagagaggaggggcgggacagggacgccacgacaggtggggaccctagggtggaggcaaggagggcgaccccgtggggagggccgacggggaggagcgctcgagagccggccgccgcgtgagtcaccagctccagcgccggcgagtgaaaagatgaggcgccctgggaaaccagccggcccgccaggctcccacaaaacgcggagcagaccccacactagccctagacccctagacctgctaaggcggagagagttaccgagtgcagagattcacttcctgcggtgctgcaaatggatggacagagtggccacaggcgtccaagagcttacaaagggtcatccccttttcacgtccattcatggttttgttttgttttttccattcgtgatataacaccattctttgataggcaaggattgagcgctgaagcgcccacagtcggtggggaaaagggctcctgaccacttaggcttcacgcaggaacataaatgctgtcccagcagtatctttcgggcgccaggccagcgctcagtgctggtctatattcgtctcctggcctctcatcgctcatcactggccaagagaggatagggtggagtggtgccggaatggctgttctgaggaccctgagaggtgaaagcgcaggccttctttggtcgaggggtgtcgactttagaccacagagcttgctcagcatcactgatgccttcccccaactgtgtggcctgcaccgcctgcctccgagtgagtggagcacgtgtcagtcttgcagcccccttcctaggccccctcctcagcctgcagggctcaggttacccctggcctttctaaaagggcactggttcctctttaacctttgcaagagtggaatgtaagtttgaggggaaagaccctcccatcagaaacctctctccagctttcccaaagagtgaacctcaaagtagagacttttattgggggacagaaagagaatgcatagggacagtcagtagcttttgagaagggggtacacgccccagggccccaggtcaggagcttttgcttcgggctgcagtgggcacttggctgcctgcctgtggaggggaggaggatggaatgagagaggcggggctggctgggggacagggtggcttggagataaatgcccagtctgagagggggtgaactgacactgtcccagctgctacctagaggagacactccactcaaagttccaaggaaggctttccaggtttggtaaaaggttacatggtgtgcaggagtggggtggtgctggcttggaaaaagtgaggagaatttgggcttttttttcttcctaggactgagggtacttgagagaggtctggttggaggaagcagaattaaaatactgagggttactgacagatacaggaaagaaggctctgaagaatgggaaagtagataaaatacagttgagccaggcagagagcctggggtctaggaggacttgggaatgggacaatgggaaccagataggtttgagggggaggaagatgtagcaagcagagtacttaatcataaagtgcaagaaggtgtaagctccgtgaggtgttcagggagtggtgtcatcttgggagttataaagttatgaaccctcgattctcttgattggaagggtggaacaagagctgttctgagtgggggggaagggaccagtctgccttcctctttggtctgtgacctttttatggggtatttttagctccagcacctgccttcttcgggtggagaagactcttaaaagggcaagggatttctagttccttaagggatcaactgtccactcttgctcactcacatctcctgtggtgcagccatggccatgcaaaaaatcttcgcccgggaaatcctggactccaggggcaaccccacggtggaggtggacctgcacacagccaagggtaacacaggcttgttttgcctcagaaaaccctcaacctcgtcctgtccttcatcagagattccctcccctccccccttctcttcctggctccaaggctgggggaagcaggggtttctctgtatttactcctattcttgggtccaggggaggtgaccccaggcctttgtgggtggactccttctgatctgcagttcctccccccaggtcgattccgagcagctgtgcccagtggagcttccacgggtatctatgaagcactggaactccgagatggagacaaagcacgatacctggggaaaggtgagccaagactaacccagcacggaaggagcccgtgtgggctgactcaggacagggataggggactggaactcaaagccaagggcctaacccgcttagaaatctgaaccccattctctggcctccaggagtgctgaaggctgtggaacacatcaacaagactctaggtcctgctctgctggaaaaggcaagtggaggagccagctcccccttccctcctccctgtgaccccgtgccttccctcaggtagccccactctgagcattctcacttatccttcatcctgcacattacctgactgagtcctgagaaatcccacctctgcctcttccagaaactaagtgttgtggatcaagaaaaagttgacaagttcatgattgagctggacgggaccgagaataagtgtgagtgaggtgccagaggtgggaagggtgtggggtacagcgagggtggaagagaaaccactgacagctgcccgggctctttctgtcccacatcttggggcacaccgtaactgggtagccttttattcatcccacaggcatttcctgaggcctggcagaagacacatgtgaaactcttggcccagggatgagggggtgaactcccagagagccacaggccaggaaagagagatgagttaacaaactcttaatgttgagtggtctaggaatcttcttccgggggtgaccagaggaaatatccaaggacttaagccccaaacctgtaagagtcctcatgctttctccccgcttgcctccctctagccaagtttggggccaacgccatcctgggtgtgtccctggctgtctgcaaggctggagcagctgagaaaggggtccctctctaccgacacatcgcagatcttgcaggcaatcccgacctcgtactccctgtgcctgtgagtgtggctgtgctgaagctctaggacagctgcccctccctagctaggaatgtttcagcagcccccacccccacccccagaaaatctaccttttcagatcctgctttccaaagaagcatttcctgaaatgaaatctttcctactgtgccccagtccctccttcgttcccaccatctaaagctaagcctctgaggcttccgtccctcgccaggtcccttccaggctcaggccattcctgtccagagctcattccgtctcctgtctcacttccgcagtcagtcagatttgaaagcgtcttcagggcaaagctctcagtacatctttgtattctctgagactacttgaaacattgccctcttaatagtagccccttgaattttgcagaaagagccccaagtgtgcaaagtcctgggtgaatgtgtgctgtgccatgagccagccttgtcaaaggccccagggcctcagacccttggaggaatggcaaagccttccccctaggctaaggttgagagacttgatgaagccttcttccttcctcggtgaccaagttgcacgtgttgagagtgtgtccaccatagctccttcccctttgggtgtttacagtctgaagactgctcctctacaaagactgctcttaccaggatcccctaaacctgttcttgtggttcagctgtgtgccataaaccctgcctccttgtttatctgtatgcagtaacccacttctctgttcagctctatataataaacacgctgggctctgtgtagtaaacacgttgagctgaagtgctgaggttttcccatcagagagcccactctgtccagtccccagcttttctgtctgtgtgtccatcctctgtcttttcttcattcccttgctgtccccgtcacttccattcttgcagctctgcgtgggccggaatatgttaccatactggagatacctggctgggttcagaccctggcctttcccattttctagttgtgtgattttaggcaagttatttaacctctgtccctcacttttttcatctgtaaagaagaaataagagtgtacagttaagccgggcagtgctggcgcacgcctttaatcccagcactcaggaggcagaggcaggcggatttctgagttcgaggccagccagggatacacagagaaaccctgtctcgaaaaaacaaaaacaaacaacaaacaaacaaacgcaacaaaaaaagagtgtacagttaatagaagtattttgagagtgaaacaagtcatgcatttagaatgccatagaattattccttgtcataagtatatttgatttcccttaactgtcagagcagtagggaagtaagcactgttagcattttgtagaaagagagaaaggctcttaggagtgcagtgctgcatcctagaccattgaactagggagcagagcgcagctgtcacctccagttccctctcacctttgacccctatgccacccagctctgagcaccaacttctgtgtcccaggcctttaatgtgatcaacggcggctctcatgctggaaacaagctggccatgcaggagttcatgattctgccagtgggagccagctctttcaaggaagccatgcgcatcggcgctgaggtctaccaccacctcaagggggtcatcaaggccaagtatgggaaggacgccaccaacgtgggggatgagggtggctttgcacccaacatcctggagaacaatgagggtcagtgctgaacatcctggggcagagtgcctgagtgcccctgaggtggggggaaagagaggctgcagatacagccatactggagtctcaggtcatctcttgctcctctcccagccctggagctgctaaagacagccatccaggcagccggttacccggacaaggtggtgatcggcatggatgtagctgcgtctgaattctaccgcaacggcaa

SEQ ID NO: 1040 - DNA, 1762 bp, Mus musculus
acgtaccgtggcggccagacgaaggagaggtttgtaaacagggcagctccaggatctcagggactgagggaaaaaaactagatcgtctcctgagcatcgaagctccctccatctccgcaggctccttctacatgtcaaacatttctttcaaccggcctctcgggaccggaagtcctccgtcctgagcgtccaatactggaagcggcctttcttaccggaaacccttttccaggggcataggaagacagtctacctggccggaagtcccacctctttgaggtttctcctacccttcctgaagtttttttgttgttgttgttacctgtttgccttcgctcctattctgtcttatttctgtactagagaaagatacattgtctcccctaccagctccgctaagctggtttgatagctcactccctgaatcggagttccttccccgacgcccccatgtagctgagaagtgggacctaggggtggttggacccctgggatcctgaaggagaggcagaggagggcgcaggactcggcttctgctcctgcgatcagaacgcgaccttcgcagctttacccctcccgctgccatgcaccctgcggccttcccgcttcctgttgtcgtggctactgtgctgtggggagcagcccctgtccgagggctgattcgagcgacttcggagcacaatgccagcatggactttgcagaccttccagctctgtttggggccactctgagcgacgagggactgcaggggttccttgtggaggcccacccagaaaatgcctgcggtcctattgccccaccaccctcagccccggtcaatgggtcagtctttattgcactgcttcgaagattcgactgcaactttgacctcaaggttgctgaatggggaatgggaggtgaggaaatccaacagcagatctggatcccatctgtatttattggagagagaagcgcagagtacctacgagccctttttgtctacgagaagggggctcgggtgcttctggttccagacaacagcttccccttgggctattacctcattcctttcactgggattgtaggattactggttttggccatgggaacagtattgatagttcgttgcatccagcaccggaaacggcttcagcggaaccgacttaccaaagagcaactgaaacagattcctacccatgactatcagaaaggagatgaatatgacgtctgtgccatctgtctggatgaatatgaggatggggacaagcttcgagtacttccctgtgctcatgcttatcacagtcgctgtgtggacccctggctcactcagacccgcaagacctgccccatctgcaaacagcctgtacatcggggtcctggcgatgaggagcaggaagaagaaactcaagagcaagaggaaggcgatgaaggggagccaagggaccaacctgcttcagaatggaccccactcctgggctctagccctactcttcccacctcctttggatccctagcccctgctcccctggtcttccctgggccctccacagatccctcacctccttcatctgctgccctggcctgacacccccatacttggtacctctggtgaccgtcctatttgcacaaactctttttccagtctaataagctgagggtgagggataggggacattctaccccaggttcatgaacccagcctcatccttttgagggggctagaagccatagggacatggttttcatttcttggattaataaaattggtttttttttgtggat

SEQ ID NO: 1041 - protein, 354 aa, Mus musculus
RRGRGGRRTRLLLLRSERDLRSFTPPAAMHPAAFPLPVVVATVLWGAAPVRGLIRATSEHNASMDFADLPALFGATLSDEGLQGFLVEAHPENACGPIAPPPSAPVNGSVFIALLRRFDCNFDLKVAEWGMGGEEIQQQIWIPSVFIGERSAEYLRALFVYEKGARVLLVPDNSFPLGYYLIPFTGIVGLLVLAMGTVLIVRCIQHRKRLQRNRLTKEQLKQIPTHDYQKGDEYDVCAICLDEYEDGDKLRVLPCAHAYHSRCVDPWLTQTRKTCPICKQPVHRGPGDEEQEEETQEQEEGDEGEPRDQPASEWTPLLGSSPTLPTSFGSLAPAPLVFPGPSTDPSPPSSAALA

SEQ ID NO: 1042 - DNA, 24741 bp, Homo sapiens
gtccaggagtttgtccttgagtgaggcatgattgcgccactgcactccagcctgggagacagagcaaaggagaccagcctggacaacatggtaaaaccccgtctctactaaagatatgaaaaattagccgggcatgatggcgggtgcctgtaatcccagctactcaggaggctgaggcaggagaattgcttgaacccaggaggcagaggtggcagtgagccgagatggagccattgcactccagcctgggagacagggcaagactccatctcaaaaaaaaaaaaaaaaagaagaagaagaagaagaaaggaggaagaggaggaagaagaagaggaggaggaggatatgaacaagaaacaacaacaaccttggactaggaatgctggcaggatggtgtggatggagagtagatttgagagagacgggagataaaatcaccaggacttggtgatggggatgaaagacgggagacgttagagatgactattagggattttgtttgtgttgactgaatggttaggtaaatgagtggatgatggtgccactcaccaggctgagcaacacaggaggagaagccatttggagagagatggtgagttcagctttgaacatattgttttggtgtctgtgggacatccaagtagagatgtccagaaggcagctggacatatgtgcttgtgtctcaggagaagggtctggactagagacatagatttgagagtcattaggttgtaggtggtggttgaaggcaagggaatggatgaggataatctcaggtggttgcatagcgtaagaaaagaagagaatgccgggcgcggtggctcatgcctctaatcccagcacttcgggaagccaatgtgggtggatcacttgagatgaggagttcgagaccaggctgaccaacatggtgaaaccccgtctctactaaaaatataaaaattagctgggaatgaagacagcctaagcacaaactctgggggcagtttaattgttcaagaaggggaatctatgaaggagactgagaaggcccaaccaaacaggtaagaagaaaaccaagaaaattacagggtcatgtgtcacagaggccaaaaggagaatcccaaggggcgagtggccatgggtatgcaggctgccgaaataaagtaagatcacagtggagaagtttcccatggatgtagaggagggagagcattaaagaccttggtaagaaccgagtcaatggagtagcaggggaaagaaatcagcatagactggggtgagaaggcagagagaaaggtgggagagaattaaaagtaggcaactctcagaatgcagctgtgaagaggaagagaagcgggcatctggagaggtttttttgtttttaagatggagttttgctcttgtcacccaggctggagtacaatggcacgatctcggctcaccgcaacctctttccacctcccggtttcaagcgattctcctgcctcagcctcccgagtagctgggattacaggcatgcgccaccacgcctggctaatgtatttttagtagagacagggtttccccgtgttggtcaggctggtctcgaactcctgacttcaggtgatccgcccgcctcagcctcccaaagttctgggattacaggcatgagccacgcgcccggccctggagaggtttttaaaagatggcagaaggctgtttggaggagtccacccccatctcccctgtgtaaaaggaaagcggaagagagaaccacaaagagggcctgggggaaagccgtggagtgaggcgataagggcttgtgtccaggggattcccggtcactggaatccctatcaggcctgcatttcctcctcacccccatccccttccttgccactggcttagtcctccatggggctagaagagagaaggacggagtcgagtggcaccctagaagacgctctgtgccttcggaggtctttctgcctgcctgtaagccggggttggtgctggggcaggagaggggtctgagggaggggaaagagccaaggacctggagctagtagttttaagttctgcaggcaagggtgggagatgggagtagggaggacaggaggtgtggatgctgtttctggaagcgaagctgcagggggaagggggctggggcctggggggatgcttccaggggatgcagggggatccactcaaggctcccttgcccacaggtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcgcctcactcagctgaacctagataggtgcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagctctacctgaaaggcaatgagctgaagaccctgcccccagggctcctgacgcccacacccaagctggagaagctcagtctggctaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttatgcaactgtgagatcctctattttcgtcgctggctgcaggacaatgctgaaaatgtctacgtatggaagcaaggtgtggacgtcaaggccatgacctctaacgtggccagtgtgcagtgtgacaattcagacaagtttcccgtctacaaatacccaggaaaggggtgccccacccttggtgatgaaggtgacacagacctatatgattactacccagaagaggacactgagggcgataaggtgcgtgccacaaggactgtggtcaagttccccaccaaagcccatacaaccccctggggtctattctactcatggtccactgcttctctagacagccaaatgccctcctccttgcatccaacacaagaatccactaaggagcagaccacattcccacctagatggaccccaaatttcacacttcacatggaatccatcacattctccaaaactccaaaatccactactgaaccaaccccaagcccgaccacctcagagcccgtcccggagcccgccccaaacatgaccaccctggagcccactccaagcccgaccaccccagagcccacctcagagcccgcccccagcccgaccaccccggagcccaccccaatcccgaccatcgccacaagcccgaccatcctggtgtctgccacaagcctgatcactccaaaaagcacatttttaactaccacaaaacccgtatcactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgataggggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatctatgcacagaagaaaatctggaaagtgatttatcaggatgtgagcactcgttgtgtctggatgttacaaatatgggtggttttattttctttttccctgtttagcattttctagttttccactattattgtatattatctgtataataaaaaataattttagggttgggagtgatggctcatgcctgtaatcctagcactttgggaggccgaggcgggtggatcaccagaggtagggagttcgagaccagcctggcaaacatggtgaaaccctgtctctactaaaaatacaaaaattagccaggcgtggtggtgcacacctataaccccagctactcgggagggtggggcaggagaatcgcttgaacctgggaggcggaagttgccgtgagccaagatcgtaccactgaactccagcctgggtaacagagtgagactccgtctaaaaaaaaaaaaaaaaaaaaaaaaaacttctggccgggtgcaggggctcatgcctgtaattccagcactctggaaggctgaggcgggtgggttgcttgaacccaggagtttggcccaggcttggcaacatggcaaaacccgacctctacaaaaaatacaaaacattagccaggtgtggtggcatgcacctgtggtcccaggtacccgggtggctgaggagggaggatcacctgagcctgggagatggaggctgcagtgagccctgaaggtgccactgtactccagcctgggtgacagagtgagagcctgtctcaaaacaacttggcttcttttggtgaagagtggctggggcacctgtcatgagaattcacaaggctccaaatgccctaccctggtcacaactacttatccaatagacctccagttacagcctacacttcccctgcctggggtgcctcctctcctccagggctggccacccaccaggccaccccaggcatcagatccagctcaaaaattgccttcctggagtttaatgacaactgctgggacttacctggcagcagcctgcagtactaggggcaaaggtgggtgcctgctttgcacctgcagcctcagaagtgcagctctcctcactgcccaggtcagcaggacagcaaggggtggaccctgcagcatgcaccatcttggtgtgactgaatagtcttgggtttcctgctctcaggctgggacacaggcaaatggaaccccatttcttttctcataaatcctgccattctctaaacacactggtgtggcttcctctcctgccttgtctccagcccaatccaaggcttggggcccagagaatgggactatggagacccccatccccctccagatggtcctgaagatctcccaaacctgaaagtctgaccgaatctctccccaggtggaggaccaactcctgagcttggcagtcagggagtgccaagcactgaccccatctgacagtccagcttcatctcaagggagatacctcacagtctgtgctccaactatcacaagcctatagatcacctgctccccaacagtgttttactctaagcctttgccctcagtccagccaggtgtgctatccttgccccatccccagccagtctaaccactcagtctgcaagtcactactcccaggcgaggccaggtgctccaagttaccctgcaacactattgctacactcagtttcccaactgctcctgtataatcttgtcttctggaccaggaactccttaaggacaaggtctaggcttcaggcatctcacaatagccaccaaggcgcaggacagtgtacacagaggcagcagcaggggcgccaggatgctgagctccacctcttctgctgatgaggctctgccaaagggacagctcccacctgctgcctgcctgtcccctagcctggcaagcactcctcagtttgaccttcccaaactctcttgtgccccaagaggttttaaggctccttgaaggctggcctgggaaccacacatcttctaaagaaatggacaaggttctcactctccccagccaaggacccagatcaggtctctggccagcattcccctttcctcaagcttccagtgcccacccacttaagccctggccttccacctgcactgcctccagcccacagtggtctgacttcctctctaagtctctttatttcctccctctttaggctgcagaagcagtcatcagaccgaggggcttttcctggggattatgtgagatgatctgggcatcggtggcattcttgggcgagtggctggaggaaacacaccgggcctgggatttgagtttttctggccctgtcagctgctgtggcatgacagatttatacagcatttgcaaaaaaccagcggctgctttttctttaacaatttttcttaaaaactccagttcctattctccagcttctttgtccagtctcctcccctctcctagccaccccccagactctccagatttggggctggtgtcatcaatccaatttattaagtcctcaatgagggggaggaagggccacatctccctctgcaggccctttgaccatcttgatggcttctgctcctccctgtcccctcagctctgccttggtttccccactgacaaaggggatcttctgctgtcctgtgtgccctgaaactaaaacccagggggaggccagaaatcctcaggaagttttccagctccctgcaagaatagccaaggacagagaaatcacaggatcaggacgagcagggcaagctggagcagggggtagaacagaccaagtcctttaccgcagaggaagaaaccacactgtggaagggaaataaatagaggggtccagggcagcagagcccaggcccccagggcgcagtggctataggcgcagcaggcgagtgggagcccccggccgcttcagccactgaggaagagacgcttgtaggccttgttcatctgctccaagaagatgaaggtgaggacggtgtgggggcccaggcgggcatagtacggcgtgaagcccttccacaggctgaagaagccctcgtagcggacaactttgaacagcacgtcctagacacagacaggcagggcgctggggctaggactctaggtccccatccccctcacccagctgccttcacacctttcccaggggatccgacaccccctcccaggcccccagaatggcttcctcaccagcccgttcttgtattccggcttcccatcaatcatccgcatgttctggattctgcaggagaggacgcaggggcatgagagaccgaaagggcaccctcccacccacctccaggcccaggctgcacactcaccgggtcttggcaatgtccacaggcatggaggcagcagtggtgacaagaccgctgatcatgctggcacagaagtggcacaagatgttgtcagagaagtagcctgggggaggtgaggcgggggtggcagtcagctcagaggtggctcaggccaggctgggaactaagggcccagctctggatctcacctgagtccagtaagaactgcttggattgggagtaggaggcgagctgggcagcattgacgacgacggcccgagccatggtagggatgcagccctggagggaggggagcggggaagagtcagaaacccctaaaaccagacctcacagcccccaagtctccagcccctccactcacccgccacagtgtgaggacaccctcttcccgggtgattcgaatcagggcgttaaacacatttttgtagccacggcgctggtcagctggaagcctggtgggaaggcagaaagaggtcaagatcaggattgcccacaggtgcaaagaaaggaaggccagaacaggtaaacactctgctccagatccgggataaaaaactggtcctttcattctagattcgagggaatggggctggggttaggttcagacttggaactcaccggccatcggcagtcatgcggataagagccacttcggctggtgttcccacaaaggcaccagtggcacctgcggtcatgccaatcacagccttcagcagaaagccagggggagtaccatcagccccagtcaggcgctcaaacagcacggtatagatgccaaggcgggtagtggtgtaggtggcctgacgcagcaggccagccgacagcctgaggagcagaggggtcagcatatcaggccaaggtctagagctgccaacccacagtctaccctccatcctgaggccccaatacccagtgtaaatgcccctcaggccttctgccttcaggatactggtgagggcatggaagctggttttgtactctcgagtcttggccccttccccgctcaactgcatccggttcttcaccaggtccaggggctggacaaaaactgtagctcccatcctgggggaagacagaggtggagtgaagggccaggcattccagatctaccagtgcccactggagcctggcagcaagaggttacaaaggtcagggcctgccatgcgattcaagaatcaggatgctggtgagcatgtgtataagagtctatatgtacaccaagtgcaacgggtctgaaaagtctagttgtccagtaggggccatgcaatgaaagtgctccaagcagcttcatgacagtcaagcagtgacctggggctgcacgcagtccgacacagggaggggaggaaggggcatccaagatttaggactccaggtagtcctgcaggagccatttaatggcctggaaccccctgccgcccggccgagcttagcaatgcgctgggaaactcagctggcccggcgggggttgtgcaacgaccctgcatgcagtccataagggtcctgcaatggggccctagcagcccatcggggaactcgcaatacgctggagatcgcgctgaccccgtgccggcacagttcactgcaacagacccagagatgaaccgggcccggttccttttgcccttcccttcctcctcttttcccatccctggggcctgagcttacccggccaggcccccaaacaggaacttgacggacttaggggaggtacggggcttcccgtctatcccgccggccccggcactcgccgtcgccgccatcgccactcaatggccctcggctccgggtcccgtgcgcgcgcggccccgctcgcgcccaaggtgacaccgcgcgcgcaacagagcgagggcgcgcgcacgcccctccagctctcaggtccgacacccgctggaagccggcgcgggcgcaggcgcgcagcgcaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggtttgtaaactaggaggctccgggtttccgggcacttttattaggtcgtcttctgggccaccagtgccccttccatctccacaggcagtccctccatcgctaacctttttttaaccggccttttaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcggtgagtctgagggacggatggggaaagggcgctgaaaggaagggttgcaggctgaaggggaacatcgccttttttgtccgcagacctcggaccacaatgccagcatggactttgcagaccttccagctctgtttggggctaccttgagccaggagggcctccaggtgattttctttcttttcttttcctccttccctcccttccttccttttctgtcttttttctttttttagtatttcgcaagatcctccatcctaggctggggttggggaggtttgtcctgggtgaaactggaggtaggaaaatgaagttaggaactgagcacgtctagtgtagaacccagaatctagagggagaagacagagtgtccacccctggaactccgaggttatcagggagactgaaagtggacgaagacagaaggcaggatcaacggtccttatcaggaaggtctcaggtgctagttattgcttatatgactttgggcaagttaatctctctgagccttagtttgttttactgtaaaatgggatattagaagttttcctagggttattgtgaagatcaaagtagatacgcaattttggtagtacttcatcccaaagactgccacatagcaagaactcagttgggccttagtagcagtcgagttgtttgtgagatgggtaattagaaaattgaagaggccgggcgcggtggctcacatctgtaatcccagttcaagaccagcctggccaacatggagaaaccctatctctactaaaatggcaaaaattagctgggcgtgatggtgcacgcatgtagtcccaactacttgggaggctgaggcaggagaatcacttgaaaccggaaggtggaggttgcagtgagccgagatcgcgccactgcactccagcctgggtgacaaaacgagactccatctcaaaaaaaagaaaaacaaaaagaaaactgaagggaggggagtgtgtctgtatgagtatgtgctggagaggggactgtgaaacagaacttgagagaaagtgacatgggtggtttgagaattgaattacaattggaatattagaaggcaaaaataattgcattagcttgcagtatagggtacagattagcccatctgggacagcgagagggatgatgggagagtttggtgaagggatgttttatgtcattgccttttcaagaggctaagagaaggttgtgatggtgggatgctcactcagaccccaggaaggaggaggaagtgaggatagaggatgtgcagcatgtgggctggtgtgtttggtggcccctgtagagagcagaatctagaaaggagaaatctcactgttgtttgcttccatccttcaggggttccttgtggaggctcacccagacaatgcctgcagccccattgccccaccacccccagccccggtcaatgggtcagtctttattgcgctgcttcgaagattcgactgcaactttgacctcaaggttgctgaatgaggaaggggagctgggcagctgagggtaaaaaaaaggcaccaggaatgaagacaggtaaggcccatgatggctccttgtcctctgccttgtctccctaggtcctaaatgcccagaaggctggatatggtgccgctgtagtacacaatgtgaattccaatgaacttctgaacatggtgtggaatagtggtaaggctgggggaatctatacagctgggctttcagtaggacccagagatggtgggaaggctgaaggcctcaggaaaagaagccaatcctttaggtggggtggggccaaagtgcaagatgccagggttcccagaggatttgagtagaaggttgtgagtccccagagtaacaccttgatccctgcagaggaaatccagcagcagatctggatcccgtctgtatttattggggagagaagctccgagtacctgcgtgccctctttgtctacgagaaggggtaggacatgtgcctccttcccattcttccttcagcaagcagttccatgccaacctggagcccaggcctcctcattacccgaaccattcagcctcctgtccttccttccctgcctctttgactttcttcccattcctgtccccacctatgggctttgtccagagccagttactttgtccctctttttttctccctttgcctttctcgccctgctgagactggtcatccttttcccagggctcgggtgcttctggttccagacaataccttccccttgggctattacctcatccctttcacagggattgtgggactgctggttttggccatgggagcagtaatggtgagtagctgagggaacatgatgggaagcactgaggcctgtgaggccagactggatctggagttgggagatgggagtggcttgtcctagattgtctagttttgttcctaagccttgtccatccacccccgcttcccccagatagctcgttgtatccagcaccggaaacggctccagcggaatcgacttaccaaagagcaactgaaacagattcctacacatgactatcagaagggtgagggggttaggggagaagagggcttttcccacagtttacctggttctgaaggactttgagcccagaagatagggtatacaaagatggcagtggccgggcacagtggctcacgtaatcccaagtgcctctaatcccagtactttgggaggccaaggtgggcaggtcacttgagcccaggagtttgagaccagcctgggtgacatgataaaacagaaaagtcccagcactttaggaggctgaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgtttttatgcataaatacaacgaagacgggagaggagatggaaagcaaagatgattaagtgaaataattgtgggaaacaatagagggacagactttgcttataggggatgtggacagagcagaaaaatgggaggaatggggaggattcagttagagaaggaagaaaccggtaccaaggggctggggctttaggccctggggcctccagtgcccgtataaggctgtggcagaagccctgcccatttccgttccttccactccctatctccaccctcacacctccccaaaaacccacttcccttcttacctctgcttctctttgcttgtcccttctagccctaaattcttccatgttctgccctgaccttatcctgcctacctgtcttatctcttccactggctttgtaggtgaggggaaatttttgcaaggctttaaaagccttagccctgggtcattgtggctcagtgaaggactagattattttctttctgtcccaggagaccagtatgatgtctgtgccatttgcctggatgaatatgaggatggggacaagctgcgggtactcccctgtgctcatggtgaggccctcactgcctgcccatgcccctctgccaccagcagccaccaggtgcttcaccttgttcctctctgcagcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaggaagggtaagatcattctcacacaggtgaacttaaccctttggtggaatcacccctttagccataaggagcaagggaatgctgagagacactaacctatagtcatggggacagccccagccggcatttgctatgactcagaagggggagccccacccacaaggatgactcaactagccctgccttgcctgcaggcctgcacccattctctggtccagatggctctattccatcatccaccaatttgaccagcacactgaggacttaggcctggaaatgccactgtggaggggcagggccacctggccagaagctcaaattcctgcaccttgtagtacctcaacctccctgctcccaagccacgataaaggaggcaagtcacagtgcctatcccccattctgacacccaagctcaaatcacacagcaccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgctggaggaggaggaaagagaaaggaggctaggatccaggtgtcacaattccaccccctgccagctgttcagcagctgtccagccctgggggctgtaacccaacctcatctctcccaacccgcccccccaccacacacaggcaggctgtcagtcaccctgaaacaataaggcttttcaaaagaggaaaatcaagcttaaacgctggagaggaacagactaaaaacttaggggtcaaaggctcatagactgttgattcatgtgttcaggctagaaagggctgtggatgtgcatgccacctccaggttctaacaaaagaactcaaacgatgaactcgatgattcaggaccccaacaatctacctatactcctagaaaacagtttctaatccgagctcaaggcagtaagtaatttaagaggtaatgcagttcagcaacttcgaattacaagatgaggaactgagacagaatggagggactatcccatgttccagcatccagcagacaaggaacacaatactggtctgactcccttcatgttggggaatcacacaaaaaagcaccctcaagattaccagaaggcggtacattagagatcttggagctaaaggaagggtaagactcaggaactcactcttgtcagtcttggtgacagtgacattgaaggtgggggccccaccggtgctcttggtacgaagatccatgctaaattccccatcctgcagcagtgagtcccggatcaccgaacatttctggcccccaagtgtcagcccattcacgtaaaaacttgaccggtctttgccaaccaggacacccacctcagctggctggaagaggaaccaagcgcccatcaagttagtcagtgcaccaagattcccaccgtgttctccaaagacccacctgtcttccacttctgagaaccaccccgccgtgggggctaagtataaattatatactcagtacacatcaatgaactgtgagaaactctgaggactgtgggacgttagtgcagaaaaagatcatgattctgaaacttagaatatggaaccagggaggaagggatgacatactcctctagagatttagatgtcagtgttaatggggaaagtaaacccaggaaataaagggagtcagtgaggtaagtgaggagcctttggatgctcagaactctccttcaggaaaagcagaagcggagaggggaagggaggggggcgggcgaggcaagagaagcaactttgcccttatttggtcaaaggttctgcaggagctgttagggcccggacgcctgggtctccaagtaacctagagtttagctccaggtatctctgctctgagatgaggaagcagacccctgggggctttccgggaaagttggaaaacttttgaaggtggacaggggccagacccggcaggccagctctcgggtctaggtaccccgggaacctttcccccctccccctttcaccccaagcccccacatccggtcccctcccgcccggaaacccccttccccccccttttgaacttccgctccccctccccacttccgggcagtgtggacagggagatggtggtgggagcagcggtagtaaaccaatatactttcgcttatgctgtctcagaacttctcacaaagttcccctgctccaggccccgccggatggcgggaagggagggcgaggggacttccgggattggcctcgcaggaatgttgaatccaacgtgctgagctgggggggcgtgtggtggcctcgccctctctaacggagttaggaggggccaggagcccacagagggtgggcaagggaccaagaccacgcgcctggggctcccttccgcaccaggagaaacaatggtagagggacgcgggctggcagccggacggggagctgggggtccaaggatccccgggtcccctctcaatcccaatccccagtaaaaactgaggcgcgtccccgccccgccctgggagaggcggaagtgggccgccgcaccgggcgccgcgcccctccccgccctgtgccccggatgtaacgccccgtcgcggaaagcggggtagcgggcgggatgggcgccgccgcctggggcataggacctacgggcaactgagggacccactcacgtgcagccgccattcgcgccgcttccagggcaagcacccagtcagggcctctcgctgcgcgccctagaccgcgcccgcccccacccaagtccctccctcagggtccaaaccggagcagtgccccggaccgcgcaggcctcgcagtaccgtgatgttgacgaacgttttcccggggacggcggcccagacggagggcgagtccttgtagcccacgatggccgcgtcctgacaggtcccgtccgccatgaggttgtcgatgtaggcgttccacccggccatggcgctgctactggggctgctctcggcgctgctgctggggccgcggactgggctcgagctgcctcggctggcgggcggggggaggcggagagctcggggcacgcgctgccgtccggaccgcggctccgctcgctgtgcagcagccctcgcaccgccacttcctgctcctccccccccccgccccgctagatttttatttgcaaaggacggtaggggcggggcctactccccattccctccctcccccactcgccagcccagacaccgaactttgcaaatgcaattttaaaaatccctccccctattgcaaaatttgcagagttcgatggaaagcaatgcagaaggatggggggtggcgggagagaggtgaagggtagggtttgctccaatttgcactgaatataaaccagactttggtatcggggcagggagtgagccagaagaaggaaggaaggagaaagcaggaggaattagcaagctgcaaatttagcaaattaaggagagttcggggagcccagggttaaacgggatgactcctccttcccccacctccgccgaagggaaggaccggcgggcggcggcgcgtgtgcccgcgcctgcgcctgcgccggggccgggagtgcatggggcggtcggggccggagccggctgcacgggagcgcgcccggcccgacccgtgtggaccctgcgggaaaggaaggcgggctggggacgtgtctcccgcctggcggaaggggcgggggcgaagccgtgcgcgctgccgcctcaccacccttgattttacttattcaagtaataagaaagcaaagaagagtttggccaaatcctctagtcgctctcatagctgaaggcacccaccggggccacttctgtccccagcgtcttctcgggtcgtgcaggttgggttcaccagggcccattctcagtctagaggattgtcccttctctggatcggctctagcccagggcctcaccccacatcccagccccgcccgccccaggcaggcaatgtctggatcaccggccgtgccccttggcctgtgtctgcagaggtcacagagcgcggacacccgcggggcttaacaggcggggctatttttcgaggcggaagaatactcaagttgcaagagtggcaactttttcaagaaggggaaagtcccacttcgggccctttgggtttcttcgcagtcagatgtgcgctcacagccacctggggagggcgggacgggcgggacggccgtgcggcggccgcggtgaaaccgcctcctccgacccgccgccgagggctgggcggcttccggagcctgggctaggggcaaggggtcaccgagcgcggcccgggcggaaagggggttggttttctctctcctcccgagcgcggcgcgcatccctggcgtccacgccgaatcccacagtccccgacgcccctcgagtccgtgttcctcgacagccgcgcggctgagtcactggcgggctcgggcggggccgcacccgggcacgtggcggcgctccccgcccgccatctcctgacccctggcccaccgcacccctaccccagggtggaaaaatcccgggaggagcggcctgagatgagggggcggggcgagaggggagactggacgggtggcggggcaggtggcctggggtgggggctgggaggccgcgcgggccggcggggcggggagcaggggtggggagagggcggcgggggtgagtcaccgggcgcgcgctgccccggcgccgacgggaagggcctccgagtcgggccgaggcgccgtgtgtcccccgccggtcggctggtatggctgcagaggagctcggggcagaccccgcactggccccagagccggcaaagtggagatctctaccgagggcagagacctacctccccgcagtgctacaagtggggcgccggaagagccccaggcgtgcagaagctcacaaaaggccacccgtcctcggtccattcatttttgttcactgttgattcagccccattcattgatgggctggggccgtgcgctgagcgcccacagtcgatggggaaaggggctctgaccgacagtccccacgccgggcgacaagtgctgtcccagcgttatcagtcgggcgccttgccagccgaaagggcctgtctaaattcgtttcctgtcccctaactcatcccggcgctggctggcctggagagggtaggatggggcggcgccgagaatggccgttatgaggaccctaagaggtgagaccctctcgccttctggggtggggggtcccgtcctttcccccactgaggacagaggcccgcccagcgatctgagcatgtgtggacgtcaatcttgcagcccctcttccaggccccctccccagccttgcagggctcaggttacccctggcctttcctaaaggtcactcattcctcttgacgtttgcaaaaggggaatgtaatcctggggtggggggagacccctcatctgtagcccctcccttgctcctcccaaagggtggaattagaacagggactgttattgggagacagaaagtgggggatagtagttgacctttggtaagggggcaggtgcccagggccagaggcttctgcttcaggctgtagtgggcacttggctgccagcccagtgtgaaggggggaggatggagagaaagagaggcggggctggctggggaccgagtggctcagggataaatgcgcagcctgagagggggtgagctgacactgtcccagctgccacctagactcggagctccatccaaacctccagcgaagacatcccaggtcgggtgaatcttccagccctgggggtggaggtagtaaagggtgagcatggtattggcttggaggaagtgggggacatttctgctttttttcctcctgggactggagatgcttgaaaaagctgggggaaggggcggctggagcaagcagatgggacaaactctgggaacaccgaaggatctagggaaaggaggctgtgaggagggcagcagggatggatagaaaagggcagctagagctggaacctgatagggaattgggggcccaaggagatttcggagcaggaaaatgagaaccagaaaggatttgaaggccaccagccatggagaacagactgcttgaccagaggggtggaaggagaaggcctaagtggaggcttgggggaggtgggggcttggtgagcggtggcatcccaggagctatagataagaggcccctggattcttaggatgggagggtggaataagagctgttctgagtgggggagggggctgcgcctgcctctttggtctgtgacctttttgtagggtatttttagctccagcacctgccttcttggagtggggaagaatcttaaagggcaagggatttctggttccttaagagatcaactgtctacactcactcacacctcctgtcctgcagccatggccatgcagaaaatctttgcccgggaaatcttggactccaggggcaaccccacggtggaggtggacctgcacacggccaagggtaacacaaggcccattggataggctcgcctccgaagaccccaaccctttggcctttgccccccagttctgtgccatatcctctcctttctctcgggttccctttcccagacttcttcccaagcccccttcttccaacgtggaaccagagctggaagctaggagaagcaggagtctctctctgcactgcctcctgtccctgagctcagagaggacacctcagccctttgagaggtagagagactccctgtgaggtccttttttttgttttgttttgttttgagatggagtctcgctctgtggcccgggctggagtgcagtggtgcaatctcagctcactgcaacctctgcctcccgggtttaagtgattcttgtgcctcagcctcccaagtagctgggattacaggcctgtgccatcacgcccagctaattttttttttttttttttgagatggagtctcactctgtcgcccaggctggagtgcagtggcgcgatctaggctcactgcaagctccgcctcccgggttcacgccattctcctgcctcagcctcccgagtagctgggactacagctaattttttgtatttttagtagagatggggtttcacggtgtcagccaggattgtctcgatctcctgatctcgtgatccgcccgccttggcctcccaaagtgctgggattacaggcgtgagccaccgcgcccggcctcagctaatttttgtatttttagcagagacggtttcgccatgttagccaggctggtcttgaactcctgatctcaagtgatccacctgcctaggcctctcaaagtgctgggattacaggcatgggccaccgcgcccagccatccctgtgatcttccaattcctcctgtcccaggccgattccgagcagctgtgcccagtggggcttccacgggtatctatgaggctctggaactaagagacggagacaaaggccgctacctggggaaaggtgaggagacaccagcgcagaaggagcctgtgtgggcggctttaggacatgggtgcacaatgggtagaggactggaacccccaaggctcttgaggagctggggtccacagaaaggggcccagttgattgagctccaaaactcatcctctggcctgtctaggagtcctgaaggctgtggagaacatcaacaatactctgggccctgctctgctgcaaaaggcaagtggggaagcccgctcgctgcagcctcctccccatgcccctgctccctcagcccagacaggcctctcccgaaacattttcccttatccttcccctgcatgtgccctgacttctgagaaatctgacctctgctctcccttctcaaactcacccttccagaaactaagcgttgtggatcaagaaaaagttgacaaatttatgattgagctagatgggaccgagaataagtgtgagtgaagggctagcggtggggaagggatgaggtgtgggagagatggcgagaggccatggggtgaggcctgatgggttatttctgggtcccccattttgggtcacaccgcagctggatggatttgtgttcattccacaggcatttcctatgcctgccttctgccaggcctgggccgggctgtggacacagacatgcagctgacacattcccccggggtgggggttcccagggctactcaggctgttggggagagatctgttaaccaattcttcatgctcagtggtttggagctctggcgtcttcctggagtagccaccccaaaccctgcagaagctctcatcctttcttcccgcttgcctccttccagccaagtttggggccaatgccatcctgggcgtgtccttggccgtgtgtaaggcgggagcagctgagaagggggtccccctgtaccgccacatcgcagatctcgctgggaaccctgacctcatactcccagtgccagtgagtgcagctacccgcccttcccagatctcgcctggacagagccaaccccgcccagccagggttggcccccctggaaaatccacctttcagaccagctcctaagaagcagtttcctgaaattgaatctctcctgctgtggtcccacccctccctctcttccacaatccaaaccttccctgaaggctctatgtgcttccttccctgccatataacccagttccttcccattccaatcctaggctcgataactccagcctcgttccaaccccacaccctacacccaaatcatattgagagtttctttgaggcaaagatcttggcatttctttgtatcttcttgagtccttcttaaaccagtgccttcttgatgaatggaaactctttgaatttaatctcaataataatgttaccatttcttgttacttactaggaggattgcataagagcatggtctctagagatagattgctgggtttgaatcctggctctgcctgttattagttgtatgattttaggcaagttctttaactgctctgtctcagtttccccatctgtaaaatggggggtaataacgataccaatgaatagaggtgttttgagaatgaaatgggctaatacatgtaaagtacttagtgcgtggcatgtagtaagtgctatataaaagtgttagctattatatactaggcacatgctaagaactttacattcaatttctctaattttcagcaaaagatcctacagggaagtaggtgctatccccattttacagaaatgaggaaagagaggctgggcacagtggctcacgcctgtaatcccagcacttcgggaggccgaggcgggcagatcacaaggtcaggagttcgagaccagcctgaccaacatggtgaaaccccgtctctactaaaaatacaaaaattagccaggcatggtggcacccacctatagtcccagctactagggaggctaaggcaggagaatcacttgaacccgggaggcggaggttgcgccattgcactccagcctggtgacaaagtgagactccgtctcaaaaaaaaaaaaaaaaaaagaaagaaatgaggaaagaggctcttgagcaaaactactcatcctagaccactgagctagtaagtagggaagccaggtttccaccccaacaccccccgcccctgtcccttcttgagctctcatgccccggcccaggtccagacaccctctccccatctcaggccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaag

SEQ ID NO: 1043 - DNA, 1541 bp, Homo sapiens
gaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaggaag

SEQ ID NO: 1044 - protein, 350 aa, Homo sapiens [sequence omitted]

SEQ ID NO: 1045 - DNA, 24902 bp, Mus musculus
  misc_feature (1)...(24902): n = A,T,C or G
tggtgagtgtcggctccactgagatgactcagggttgtgagtgccagggcggaccctcgggcatcttctaaagggcaatgtttcctggagtgcggcctagggcagctgatgacctgctgggctgtggattgtgctggaagttgaggctgcactctccaaccatagcaactccgtcacaggaggtccagggcctaataattgaatcctctttttaaatcaagtcactctttaggacatcttcctatgctgtgagctttcaatttggtgtcacactgtttgatcaatgacattggcacctcacattgacaaacatagcttccccagctgtgctactgggtagaggtctgcaacttctgcagctatagcctgcccccttcctacagggctctcacagagagacagaagggcccgcctggctcagtaattggttatccacagtcacctccacagcagtttttgtgcagggtgggcaagcacttgtcacccacacagaggaagaatcaagggccagagggcacagagaacaagaggtggcagcagagccgggggacctgcgcacagggctttcacaggtgtgggtagtcccagaggcgccctgactgactcaatgagacagcacagctcttgaaaacccccaagtctcatgacagtagtggggcacctccagctcactgcttcatttctaggagagcctgtgggccattctaccgcccatgctacataagtacactggggtctgttggctccatctaaccacacaagaaaaccccagtacttactgtgtgggtactttccagctgtcccctggcttctagctggctgcagccaaaggaagcctctggaggacagcggagggcatggaagagggacatcagtacgactgatctggcctcccttccctgacgtgggacctatcaggctggctgctgcccatgtcctgtggccaaaggatgttgctcctctggaggtggccttcgttatcagctcttcctcgctggccctggagggctaagggatggaggctgctgtcaccggcttggtccctatacacagttcctgagtttcatccatggcccaccccttcaggaactgctcccctacagctccttaagccaccctgacagaaggtgtccttggctacattcatgggacccagactgaagcagacatgagctcagcctgctcaggagagagcagaggtgggggcatcgtcggcgctggaacctggagctacttcaggtactaaattaaagaccacactttcaccataggctcccatcctaagagttccagaccccaaaccactttactcactcaagagttaagttaccctgccttccacagcctctagtttggagtgggaagcagcaggctggtggacacaggcagacttggttggtggctgctcctcctctttttgagctctctccttgcacaacagaggagccatggaaaaaccctggctgctcatctggccggtcacctgcacacctgagaaagcagggtgtaggaggtggcgacctgcacaagctttgccaactcaaaatcacctcagtgacagctttgtggctttgtaccctctacccacagtgtgcaacccatacctggcatccttcacacgctcattagcttggtaatagccagcgatcacatagctgttgtctttgcaccacgagtcaatctgagaggaacagagatgggaaaaggacctcagcaccaggtctgcgacagcgcacccctctcccgaacgggacaacccatacatccaacagttcttcctctgactacagtcagtgagaactcaagagttcagggcccagaggcagagtcctcccacgcaggctgcactgggcacagcagccgacaccacagagcagtagcactgtgtggaatggatctgagggaagcattctttactatttaatgcgcattgcatgctggagcttgagaaatcctgatcacttaaaactggttccaagctctccacactgtgacactgttgtctcaaatatgctgagcacacttaggccatcttagcattttagatacacagaaggttggagatgccttacttaaagcaaacctctgcaagtaaggaaaactaacgttcagagaggtctgagtaggcatagtggatagaacagatccagacaggacctccatcttgtctgaagtctttgaaatgggctttaacattcttagttacacctgccagggttggagtaccgtaaacaggcacctggggtgggtgcaaatgacacccaagactttgcagtgcagcatgcttgtgtcctgtgggggaaacaggagcagcgggagactgagaaattagctgctctgtggcttatcacatccagtctagctttctgcaggtctaatgcctgcctgtgacagacacacacaaaaataaagtaaaccttaaagcccaaaccaaaaccctatcaatgcaagttagacaaggtagcatttgtgtgtggttttagtatttgggaactcatgcagaaagatcttaagtttgtggccagaagcccactgacaccacagttgtgggtacctaagctatacaagactactgtctttttcttttcttttcttccctttccctctttctttcttttttttttttttttcagacagggttactctgtacaactctagatttcctggaactcactctgtagacaggctgatcatgaactcaagagatctgcctgcccctggctcctgggattaaaggtgtatgctagcaccactgccaggtccagaaaagtctttttttttttttttttttggtttttcaagacagggtttctttgtatagccctggctgtcctagaactcactttgtagaccaggctggccttgaactcagaaatccgcctgcctctgcctctcgagtgctgggattaaaggcatgtgccaccatgcccggctcagaagtcttaaaaaacaaacacaacacaaaaatgcccgtgtttaaaacctggcctccatccccacgctggttcagaccccagtctccttcaggactaaaaacagacaaaggcaggtctttgcgtccctggctcatgtggactagaatacttccaaattcctgacaactccctgagttaccatattgggacaaaaccagggctcactgaacaagctaaaaatgctggtcatctacccaaaagattagagctacatccccaaatatttataatggctccattgcacaaatcccggcaaagctagccacgtgctgccgtctcctcttaagggaacaggtgccacaaatgtccctacctagaagtttctctcccttcccaaacttatcccacacaccatcagagggccttactctaaattttgggtttagcccctttcccttaactcaaagctgaccttgtctttgctgcaggcaaccccacctctggccagatcccgtctcagggcctgccgattttccatttactgctctttgaaacaagacactcaaacacactggcataaaacattctcacaggtgagagcagtctataatgaggctggttccggggctggtgagatggctcagtgggtaagagcacccgactgctcttctgaaggtccagagttcaaatcccagcaaccacgtggtggctcacaaccatccgtaatgagatctgactccctcttctggagtgtctgaagacagctacagtgtacttacatataataataaataaatctttaaaaaaaaatgaggctggttcctcctacaaattctgggttcctcctttccagcctgttttcttgggtctgtgctacctacaccctcctgacccactcctgtcaccattccttacctgttgacttgtttaacgagccccatgcttactctggtcctatacagagaatcgaggacaatccctcagcccgtgaatatcttttgaagtacgttcagctgaccacagctatgctgtgtttactattggggtacaacactattttatgccctaacatacagtatcagtcttcagtgaacagtttaatctggctctttagccaaaaggtccagggcttatatctgcctcattcaaacacgataccaccttgaaattgttctctgagcatgaggctgactgctgtgacaaatgcaacacacacttcattccctgtgtctgccgaggacaaattcctatgtgaacatcccaggcacccaaccaagttccagtggaggccttaatgctgtgacctggaacttcagaactctgtggggaggcttaaagtaaaccaggccataaaagctctggcttggctctatgaactcaaacaaattttcactgtgtgtatgtttttgtctcccacccaactcataggtgcttaaggacctgcacacggcctatccatcaaccagggaacagactccctcctgcgtactcagaggcagagaaaccttttaagaacaggggaagagggctggtgagatgacgcagtggttaagagttctagagttctggatattttcacagagcgcccacatggtggttcatgactgtatatgactccagggatttggcattctggcttccacaaaccacacacacacacacacacacacacacacacacacacacacacacacacacaggcacactcatacacatgaaatatttttaaaggtttattattttttattatgtatatgtctgtgtgtaggtgtgtacaggaacgcgggtacctgtggaggccaaaggtgtcagattccctagaactggagtcgcaaactgttgtgattcacctgacacaggtgctgggaagtgaactcggtctactgaagagtagcaagtgttcttaaccacagagccgtctctctaggccctaaataattaacaaaccaactagggttaggtggcctctgaagagtgaggtattaggatgggaagagacaggcatacagaggcctcacagccccatgaaaagctgggtggcctacagtggcagcacacagtccagtaacctgccccctcccaagtgggccaagataaagcacaacccagacgctgacctctgctaatggccatcatcccagcatggctatctgaaaacccagacctctaccatgaagtttattaagatcagcacaggaatagcaaatagctgtccaggaccacagggagagaagtgaacctcagacagacaccatacctcggacacgtcttcacaggaggagaaagcaggatgtgaacctgctccctctgctcaatgtcctctatgctgttgggtcagtcacactggagagctatcgaggggccagggccaaccctgttaagactgcacagatgggcccttctctgcaagcctgctaacattgtatctaagcaccgtcatggatctcaagtgactccacgttagccagagaccaggcaaagctaagagcacaccacacctgagcctgcacgaccaccaggtggaggtcgcctgcctggtcaaacctcctgtctgcagcaagaagcaggccgtgccttcacagtttcaaggagctacttctcaggccagcccagagttctccttgaaagagaagctgggggtggagtgaggctgctaacgagagggaagtacccagggcagatgggacatcagctgtggggcatggagtggagacagcaggaagaacactggcctgaaaccacatcatggtaagaaagtcatctgagcagaatgcagagagccacctccgctgccaaaaccaaggcaggggaaagacaaagggcttagagaaatagggttacgctaatttccctaccaacccttttatggttttttgctattaagagtaattccttcactgcctacgtcaaagggcttgaggataaataataggcgtaagtacttaaacagatgaaaagcacccggaaatgcaaggatttttgtctaatggaaaatgataatagaaatcccttcaaaggagtctcatgctgtcctttggcagagcacatgttaagaagtggctggctcgtctttaccacgttcagcaatcattccagtgtgagctccttggcagtgggagccaccaggatggggcctcactgaagtaactgcatgggttctgcctgttgctgttaaaacttcgacagcctgcattttgacagctgcaggctctaagcccagagacctcctggccttcagcatacaaggttgcaaagtaaataacacaaattgaagaaaactcaggcaccggggaggctggttagacagcccaggggaagtggaggaaaatattcagggcagggggcatgtataggaggaacagtagtaccgggaactatgtgtgtttgggaagagacagactggaggacaaggaagtatgagcagaggggtggagggagggagcagcaggcatactgctctaagggactttgctgctcccatgggcacagggtcacatcctgggacagatgcactgtccagagagatgctgtcagaccccagtccttcaaggggagcctgcaacctgctgcaggaggcagctcatctgagactggcaggtgatgaagggacaagttcaacaagagcctgagggagacactccacaggcatcggaattcatcacaatggagctcaggcctgagaactgttaaactgagcactggggactcagtgtttccacactgttaaagggacacagtggagggcagcattggaagagagtggtcacagcatctggtgcacaaagtccaagacagtcaactgccagaccgtctcagatgtggaggccctgaggcaggtcacatggcctgggatgctgggctggcctgacacttgaatgccctgaccatcctaaccctccaactttgaccagctaattttcttaaggaggggaaaaaccaaccaaccaaccaaacacaaaaactaccttgtgggtttttttgtttttttttttgtttttttttcaagacagggtgtcattagcactggctgtcctggaactagctgtgtggaacaggatggccttgaactttaaggccactttgccttggcccttgttttagttttaagttcaggtctataagtatgggcatgagtgcagtacacacaagaagccgtaagagggagtctggagacagagttagtggtggttataggtgtctgacctagttaggactgttcctctaggagagcaaccagtgctccaaccactgagccatctctccagctcctccatcagctggtgctaggagctcttcagcacagagcttgccagacctctacaaatccaagtctaactgagccctgggttcaatccaccccaccaagtcaggagagaacctgagaagcctgccctactgtggaaggcagggcccagccaggtgcaactcccttgctaacagaacaacttagacggtggccagaatcacccacaggaactctcaagagacactttaggcactaaaagcacgcttctcttctggaacgaagtatcatctgcaaaccttcctcctgctcagaaagaatctaaaaaacattcaaaatgtgcccagtaaacgtgccgatttgcctgtaggctcttgtagtttgctggaaattacctctggtgttttaatgtaaattaaataatggatgagcaaggtgtggtggtagtgcacacctttagacctagcctcaggagatggaggcaggctggtctgtgtgtaggacgccagcctggtctacagaagagtcccaaactcggcaaggccacaagagtgaaaccctaaccctctcccccagaaaacaaaagaaacagaaatcaaggaatgcgagtcgcgtcggtaatcccagttctcaggaatctagagcaggaagtgctgggagtgccaggctagcatggggggctacattcaaagcaagtctccgattcaatgcagtcattttggtgggagagggggagacaggattagcattccctcctaggccagctcagatttttaacttcagagctcattctgagatgtaaatgaggctgtggggagactgggtggttacgggtctgatctgtttctcaggtgcgtcaggactgcacctgagagcgcttccaagatgtagtaagcagcgcctgaccatatcagtccagggctttataaaggcaaaccgcagagttagaattccgggtcttgcaaatgtctcttaagcagagaaaccgagtttgattacaagcgcagaaacagcagtccgtattataacctataatcttgctaaaacagcaagtctggggcaaaaaaatcggcaagtggacccacaaaatacaaaaacaaacaaacaaacaaaaaaacctctgtaaaactagagatttacatgctataggcatttttttctttgtggcctcacaaacacattaagtttaaactttaaacgttacctatcccagatctcactaatgtagaccaggctggcctcgaactcttgcctccccatctcgagtgctggttttaaggacgtccaccacacattcgagtttctcggtcatcttacaaaacctcgagagctccccgggagcagccgcagcgtcccgcgaagggcgcccgactccgcccggcccggaaccccgcgccgcggcctcgaccgcgagcttaccagggtgagcgccacctccagcatgggcgtcagagccagcgtgccgtggaagagcgggatgcagtccacgaagagcgtgtggctgcccgctccgggaggatgctccttgcgcggcctctgcctctcggccaccaggagcccgttgacgggcgcagtgcgggtacttggcgccgtggagcaccatcttgcagtaggcctgcgtagtcagcttcacgccgggcatcgcgacccacgcacccgcggtcctccgccacgaccctccgctgcacgccgtgacgctctcgcacctccggcccgcggcctcccgcctcagccggtcggccggaaaacgtctgccggaaagcagctgctacccgctcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcgggacgcaggaacgggaagcgggccagggcctgagcctgggcggcctcctcccgcttgcccttcgcagtctctgtacaagtcaatttttaaaataaaactcagtcgcaggaggtgtgctaccgtgctatctatctatctatctatctatctatctatatatctagttctagcagtttcagtcatttttgtctttctagttaattttttaagaagccggatttatagtcattggccaaagccatgtatattacagcccttggcttgatgtaaggaagttcaccctgtgccttcgcatcagtaataaaaaccggatcctgggggcatgcctctggcctgtaatgccggctcttacgaggtagaggaaggtaatagtggaagctttcaggccagtccgtgccttaaaaagttgatgaaatcattaccaaaaaaaaaaaaaaaaacatttaacatttcgggggataagttgcatttacttccttaatgttttgccgcaaaaagactttggctaaaaggtgtttgctgtcattgttaagaggtataagggtttttttttgtctttcagaatgttggcttccagagcgctgagcctgattggcaagagagccatttctacttcggtgtgccttcgagcacatggtgagcaggactttcactcccttccctgcccttttctttctcctccctttggtttttcatgacagggtttctctgcatggctctggctgccttggagcgcagagacttaacctgcctctgactcccatgttctgggattaaagatgtgcaccgccatgcccggctcaggacttttactttctttttcttttttttttttttttaaagatttacttatttattttatgtatatgagtacacacagtagctgtacagatgggtgtgagctttcatctggttgttgggaattgaatttaggacctctgctcgctctggtcaaccctgctcgctctggtagaccccgctcattctggtccaaagatttatttattattatacataagtacactgtagttgtcttcagacacaccagaagagggcatcagatctcattacgggtggttgctgggatttgaactcaggacctctggaagagcagccagtgctcttacctgctgagccatctcaccagcccccgacttttactttcaaacaggcaaactaaatgtctttttgcccctatgtctcaggtcctgtgctgggatttttttaacaaagatgcctggtagcttggccttaccgggattttagggagagatgagaatttgaacagggcgtttgcctgcttgaaggagcatggataaatcctattagtctgggtctttgcttgctttattttcttcttacatttttttctctctcccttcttccttccctccttcctctcagtctcactgtgtagctctgactggctttggacccacagggttccagactgtgcctcgtgaatgctgtggttaaaggcaggacaccacacctgtaaagttctgtccctctgtctggcgccatgtctgtctttaatcttttcctgccacaagcctctgtaaacgcataaagcccgcttctgttgccatcccagaagcatgaagcgaagggaggctgctgggcttgagtctgagctgtgtggatttcacctcagccatgggccagctgctggtgtcctaaggctctgcagcagtgagagtgctgtgtcctgttgctctccccggggcaccataggtgcaggctgagacagaagggtgttgggtaagggaagtccctcttttattatccaacacggaaaagacatgctccatctccaagcacagatatctgtgacaagaccagtttttgtctgacttggctgtcattttttggcagtctggccagtggacaaggagctgcagtctccttgttgtcctctgtggacatctgtgcccacagtattagagcgctttgggagcctgctggggcactgctgtcagttgaggtattcatggtgtgaggtgactgagaagagatctgagccttaacatctgacaacccgggcagcgcttgcctggggtgggaacagaagtgatcttgtgattgcagtctttgcttttcccccttttattattattctgtaaattttccccaaaggttgaggtttactaagggcaagaagggtgactgaggcctggcatatgcctgggtaggtagggaaggtttctgcaacccggtctacttggaagtaaccctgccagctccccttacccacagcccttaggcccaggagcagggatggttgcttgggacttgtcttcatgtgcaacgtggccctcagcagtcggcgtctttctacgtatctcatgcttcaggtggggacgatgccagttcttgcctaatgaggccactcattcaggtgaggtcacctccctgcacatttgagtgtggtcctgcacaggtggccacagctacgaggaagccggctgtgggctctgcacctctgaccctgaccttttaaaagaggagggtttagcctttgttttcctctgacccatggaagaggcacaaaagctctcaagtgcgcctagaaaacaacttacccactcttgatctagaatgtagtgctttatggctgcaatgctctgagaccatgagagtttatggcagtctgatagctgagctgtaattcacacgatacattgggtcactcaagtcacttctcgttatttcagtgtagttgctggtatgtgccattatcatagttgattgattctagaacattctcaccctaatttacatctatctcaatagcctgcagtcctttagcctagaggcatagggttgagggcgcgtgcgtgcgtgtgtgtgtgtgtgtgtgtgtgtgtgtgtgtgtgtgtgtgtgtgtgtgtgttggtaggaaagttcagtagctgccgttctttttctgatcattgtctcctagttttaggacagtgtttttgtgattgttcagtcaggtctcaagcttgagctcctcctgcttccgcctgccgggtgcttgggttcagcgtgtgctgtcagggccaactttatgggatgctgagggttaaggtgggagagtaatcccggcgggtctgttggggtggggttgagcagaagaatggagactcactggttttttgtgcaccaaagtaaatacacagaaggaccacacgcagcactgctcaaggctttgtctattgtgtaccaacatgacctggggaaagcattctgcaaagctttgtcctgcagacagccgggtcaagttagagctttagcaacaggaagccctgggggcaccatccagcttgggttcttgtggcctgagcttttgtcctggtgaggccacgctcactgtgatggttccatggagcagctggagcctcccctcaggctggcactctccactgctcactttgggctgactggactgttttgagtgttttaagtgggaaacatgggaaggaagacagaactaacctgccgtgagtctgcttgttgagcacagcagtcttccctcagagtctcgagggccaccctctgcttcctgacacacgtgcattcctccagtgggacccaagcctcctgtactgctcagttctcacttagagtgtgagcccatgggggggtacaggtgcttacttgtttcctgacactgccatccagacatgtccagagttagcctcagtgaccagtaggcacttggtaagtccttggctgccagggtcacggtgaccaccaagactctgcaacagtcgcctttccctttttgaattttatgttctgagtatgagaccctgcggttgggtctccatttagtccagttgcttgtgtgactaacaaccctcagccctggtcctgcccctggtgaccgaggggctgcttaggtcaggcttccgtcttaaccgttgaccgtcaccgcccttctgcctagactgccgtccacacggggtttcaggcctctccaatgtgttgtagggagtgttgtgaagagtgaagactatgctttccccacttacgctgatcggcgtgactaccccttgcctgatgtggcccatgtcacgatgctgtctgccagccagaaggcgctgaaggagaaggagaaggccgactggagcagcctttccagggatgagaaagttcagtgtgggtatcagagggggtgcacaaacactcagtagtgtgtggaggcgattgcactgggtcagctctcccagctgggcttctagatacccattccatactgctggcttggccaaacgggagccatgtgacctcacagtcatgtgacctcgtgtctgagggctgtgctcacagctcttcattttccccttccatgtatgctggtgtgtgagtgcaggtgtgtgcacagttgtgtgttctagcctagcctgtgcagtccctgggatgggtttattcagggaggggctgagccctctgtaggtattctttaccttgcatctgtctcattcagtgtaccgcatccagtttaacgagagcttcgccgagatgaacaggggcaccaatgaatggaagacagttgtgggcatggccatgttcttcattggcttcactgcgctcgttctgatttgggagaagagctatggtaagtacagagggtgaggtaggcccaggacagctatagctcttggtgctgttggggtcttatgtggcctccaagcccacatagatagagatgctgtgatcatggcaacagttatgagctgcagcgtgcctttgtggccagatggtttgctttgtatagaatatcgtgttctgtagcttaattaagcctcatgtccacagaggactgcatagtgtgagctaggagacccattggctgcgtggctggctgttcccaagcatctggagtctgggatgtcggccttttccatagtgtttggacactgttgcgcttgcctgctctctgacatgcatcctctctgggtcaggttgtgttgcattccgagcaggccctcccctcctgagtgtgattgcagactactaacatgccagccctctgagtggcacccctagctgtgtgctgggccaccctgcagactctgccactgacagcttaatccgtaggatttccctgctgacctttcacaatcgagggaggttctgagataggagttacagtgccctggattaaagcccgtgtgagagaggggttgggcaggtggcagggcagccttcctcaccaagttgttctgttccacagtgtatggccccatccctcatactttcgatcgtgactgggtggccatgcagaccaagcgaatgctggacatgaaggccaaccccattcagggcttctccgccaagtgggactatgacaagaatgagtggaagaagtgagagcccgctgcctgccggctccctgcctccctcactccctcggcatgctggaagctgccgtatccaatggtccatgctaataaaagaccagtttacgtggtgtctgtgtggttcattctttggcagtcactagatgaaggtacctgtctccggagaggctaggtttctcacagtggaagtgaggagggtttaaggtttttgcatcattactctgtgtgatgtcaggtgcgtgtgtagggaacaatgtggggcttggtgttcgcccttcattttgctgtggtcaagttcaggtcgccaggctacgtgacagaagtttctgtcacttagaagttactacccactgtgatgggtaaatatattctgagtaggggacttgcgttttaacttgttgaggaagagtgtataaaaatggaacctgacaccattgcatacactagcaagattttgctgaaaggacccagttatagctctctcttgtgagactatgccggggcctagcaaatacagaagtggatgatcacagtcagctattggatgggtcacacggcccctaatggaggagctagagaaattacccaaggagctatagggaactgcaaccctataggtggaacaacaatatgaactaaccagtacctgggagctcttgtctttagctgcatatgtatcaaaagatggcctagtcggccatcactgcaaagagaggcccattggacttgcaaactttacatgccccagtacaggggaacgccagggccaaaaagggggagtgggtgggtaggggattgggggggtggggtatgggggaccttttggaagcattgaaaatgtaaatgaggaaaatacctaattaaaaaaaatggaacctgttaggcagtggttacttccagcatggggcttgggaggcaggggcaaggacaggcagatctctgagttctgggatagccagggctgcacagggaaaccctgtcttgaaaaacaaacaagcaaaaaaattgaaactagactgactactatggtggtctgagagattgtaggttatgacatttttacatggtcttaaaatcctgttagggtggtgtcttagtcagggtttctattcctgcacaaacatcatgaccaagaagcaagttggggaagaaagggtttattctgcttacaattccatactgctgttcatcaccaaaggaagtcaggactggaacagggagcaggagctgatgcagaggccatggagggatgttccttactggcttgcttcccctggcttgctcaacttgcttgcttatagaacccaggactaccagcccagagatggcaccacccacaaggggccctccccccattgatcactaattgagaagatgccccacagctggatctcatggaggcatttccccaactgaagctcctttctctgtgataactccagctgtgtcaagttgacacaaaaccagccagtacaggtggcctgacataatcctgtgtggtagcctacagaaattgccgggagttactttagttcttgaaattgtcaccactgaatagaggtaactttggggctgtgcagagcaggccaggctctaacagctggccaggcatggtgacactgtctccacaccagcacttagaaggcagaagcaaagccagagtgatgacagtaagtttggggacagtccggctgacagagtgttctaggccaaccagggctacgtagaccctgacaaccaaattgcagtgagaaagctgggatgtggccggtaaagggatgactgcccagcatgcctcatgttccaacttctgccacaagctggcagcagcagagctgcagcctgcagagcagtggctctgtgagtgccggcctggcccctgatgaggacttggaagattcagcctactaccttgtcccatgtaagcaccagagaccctgtctggaagggaagagatccttgagcttggacggtgctcatgcaagaggggggcctagcgaagcgtagctgtgacacggtggtccaagaagtcaagcagggcctgggctctctgcatggctacagcaagccgagcaggagccatggtcccgctgtggtttctccataatctagaaaaatctgtttttatttgttttttttgagattttcatattcaacatggttttaattggggttcagcaatcctagcctgtgatgagtcattctcgttgacacagggtttgagttgacatccacttttctttttcttttttctcctgggagcgtattaatgtccttagttgttgggacaaacatataatcgttctttttttttgttttgttttgtttgctacagggtttctctatgtagtcctggttgtcctggaactagctctgtacaccaggctggccttgaactcacagagctctcccctgcctccacctttctggtgtcaaaggcatgtgccaccatgcctggcttccaggtttttactgggagccttattgtaggattagtggtttgtggaggagaccggtcatgggttttcattgaaacttgtatacttttttttttttttttttttatttattatatgtaagtacactgtagctgtcttcagacgggcgtcaggtcatattacagatggttgtgagccaccatgtggttgctgggatttgaacttcggaccttcggaagagcagtcgggtgctcttacccactgagccatttcaccagccccgaaacttgtatacttgatactagttttttggttccattctctctctctctctcttttgttgttgttgttacataaattcaggtcacagtgatggctgttgttttcaatggaggacttaagtcagagggttgaagtgtcacgtctctcaggaatcaggtccccccccccccccccgagtcagctcggaccttctgcctgggagcacagctccgtcgtgaagatttctcacatccttccctaggtttgcagctcctgtcagagccactgaaagacatggaacttccctttgctgtggacctaaatcagagccaaaccatcctgcagaatgctaggaaatgtccttttttttttccaagatagtttatgcttccctgggactcatgacaaccctctgatattagcaccccaagtgttagcatcccggcatgcaccaccacgcccagctctactgcactgtttttatggcagcatgtctagtccgcatgcgcagaatgctgtttctccgtcggccagtggtgggcctttggctgtgcacctgccgcttctctgctcattcctgtgcacccaggtgcggcacctttctttctggtcaccttgtttctggtcaccttgcacttttatattctttgctttccgactgggcaccacttacattgccgccgctggcatctgagaagcggccactgctgagcactggcaggggtcgcactccattaggcctgggctggtgggaagtcaccttggacctcctctgaagcttccccaggactggggtggaggagtcttggggcccacaccatggcataaagtcttctccaaagggaagggtctcaacaagcgcaaatgtccctaccccttctggagcagtacagggcttgaacctggggcctctcatacacgcgcaggcaagcattgggttactgagctccatctccaggctttgtgcttgttctttaaagaagagtgatttcagagctggggaaatgaatccgtggttagcaacatgttctgcttttccagaggacctgagtctggtccccagcacccacgtcagatggctccaaattgcctgtgtaactctagctccaggggacctgatgctctcttctgggctctgccggcacttgcgctgccagaatcatgccccccataaacacagcattaaaaagaaatcttgtgtttttggtttgtgtttcctgagacaagggtttctcaggtgtcatttttgtagaccaggttggccttgaactcatagagatccacctgcctctacctcctgagttttgggatcaaaggcatgtgccaccacatccaaccctaaaccatctttagcagtgtagtggttcctgcttttaatcccagtacccaagagagccaggtttttgagggcagcctggtttacatagtttcaggactacatccagagagatcctgttacatcgagagcattattcgtttagtatgtactttgtatatgtgggtgggtacgtgggtgctatgttgagtgtgcagcggtcagaaggcaacctgtgggtatcagttctctactacacagggggtccaactcaggccgttcaggctctgcaatgggagactttcctgaggaaccacctcgccggtccatgcttacgtcctttgtcattcccgagacacacagctctggccaagaaaagggcctaaagataccttttcaaagggttgtcttctgctcccgggcctcttcactggcccctgtctcctgagtttggcacccaccacagctgtttccatgcactgtattctcagctctggacagcagggggcgctcggagatctaagcaaaccgtgtagagttggagcatccgaaatctgagccaagactgactgatgtgggagtcaactcagactcaacgacgtgggagcctcccatgttggtcttgttggagcacctgggacactgcctgggacataggtacttcataagtgcttagtaagggaaaacatccaaaccctatgggtgggcccacctcgagggggcttctaaaattacttcatctttttgttcttttgcttcccttcccctatgaagtcagcactgaaatcagccagacctaaatacctcagggtctccctcagctgcccgctgagctagtgcaggctgtgggcagcatcttgctttgggagggatattctgggttccactcctttcggaaaacacctgtgccaggttgatctaggcatggacgaggtgagacttggggatgagcatagaaagcaggtattctcatccttgaggaaactgttcctttaagaatccgatggttgggctgcagagatggctcagcggttaagaacactgactgctcttccagaggtactgagttcaattcccagcaaccacatggtggctcacaaccatctgtaatgggatctaatgccctcttctggtgtgtctgaagagagtgacagtgtattcacatacattaaaaaaaaaaaaaaaagggaagaaaagaaaagaaaaatcatccaatgattgatagtcgcttggtatggtggcaatccactggtcgctggctgcttgcgctttccaaaatggaggattttgaacagagggtaaaaatccaaggcagtgaggtttccctaagctttcccagtttttgcagtgaagttccacagtgtggtcatttaaccgtgagtttcgaccatccttgtgacaactcagctctgagtgctgcatgacgtttgctgacacccatggggtcccgaggcaatactggtagaataggctcagcaaacctgtaacatgctcacacaggatgcccggcaggcccctgaattcctgtggttcctggtggaacagttttcatggtcactagagcctccttaggaacgggacacaggactctcaggacatctggagtttgcactgctgtcacggtgcaggtggtagtaggactacctggcaaccagtgataagagctcaaaggtggatagtctggtgctgtggactgtcaggtttccccagtgacctgagtcactgcacactcacttctaggactcccctgggaaactggcctcacataggtgtggcccctccatccctgaggtgctgaacagggtccaagggggcaaactgacattaataagcctgttggttttcctggaaattaggcaagttgggggtcaccaccctacctaatggggagccccagcctttggacaggctggaagggcaggggtgcagagtttgtcaccacctagcaagtagctgtaatctagtgtctatgcatagcctatgatggttatatgactagctctacgctatccagagccatctaggagaaagcctccgagcacacccatgagggatcgtcttgacagggttaactgggtgcgaagccttatcttaaaagtgggcggcaccatttcctaggctggggccctggactgagttaagggaagacagtgaactgagtgccgacactcaccatttgttcctgacctcggatgctgcgtggccaactgcctcttgctcaaggatggcttccctgccgtgaattatgagcccaaatcaactctttcttaagcttgcttttttttttttttttcctccgagacagggtttctctgtatagccctggctgtcctggaactcactttgtagatcaggctggcctcgaactcagaaatccacctgcctctgcctcccaagtgctgggattaaaggcatgtgccataatttctcagtcacaggaaaaaaatcactgacatatgggaaactggcggtcacatcccgagtgaacagcagggggtgcaaggactccgtgctaggcctgggtctccagtggctctcctgcccccctgtacctcgccttcacaaacccgctatgccaaggtctgagctatttaatttttaaatttcttagaaattaaaaaaaattaaatttagggtggttttaaaatttaaaatggtttcaagttcttcaaacttaaaaccatttaaaattacatttgtttaattgtgttagtgtatgtacaccacagcacctgtgcagaggtcccagatcagtttgtgaaagttgaccctctcctagcatgtgggtctctgaggacaagctgtggttcccagaccaggccttacctgctgcgtgttctccctggccacatctgtgagtcctctgcttgatctggacaatccctgggaattgtgtatcttccttgatactgctgtagtttttaaggagaaataattacttctacagatgacccagagccaccccaaggaagggacataggcatctccatctacaggaacactgacctgtcccccacacggggaggggggactgctggcctccctgcagtcatttctttaagtgtgctataactctgcccaagagaggatgagatgcttaccctcaggccacgggccagcattgccaggccacgggccagcatcaccaggccatgggccagcattgccagccgctttagacatttcagcttacctctgaccacgtgctgccatctgtcccagctgtttccgcctctctttgcagcaagctgccctgaggaacgaggaaatggaaactcagggaggttggccagtgtgtggatgggtaacgtggggcttgcggtgaagagcgaggcctgggtcagaggctttgcttcttgtcttgatgtcctttggctctggacacagagttgctgaggtgtggtctcacttcaggtccacttcaaaggtgcttgcactggggccagctggtgtggggactcctctgctttaacaactcgaagaacaaagtaatacctgggtaatgtatttttgagcacctactatgtgcaaggcactatgaacataaaaggatagaatatgtggggtacagctcccactgaggaacccaagctctagaggggactctaagttttatcctcaccaccaccacaaccgccactgtcacttcaaacactattgttatcaataccaactgtcatcagaatcatcactgccattaccatcagcaccgccatagcatggcttacgccaccataatcaccactaccatggtcaccatctctatcattgtattcactcgaatttttcgaatcaccatcaataactgttaccacgaatgtggctataaccatcactgccttccccctgcacaagctagcgcctggtccttccatttgtgtaagatgtccatgcatccccctcctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacagcatgggctcaggtcagactgaagcctcacacgcatgagccgtggaagctggtttagtcagagatggctaggaactggcttctctgctggccaccgagactagccactgttctggtggcagagagtgccaccgtctggagctgaccacatgcagttagagggtgtggcccctggggattttaatgctgggttttgtgtgtggagacttgtggctcctgacagcttgactcccggtgtcactcccgggttgccatccatgtgctgactgggctgggctggagggctggggagcatggcatgtgttttttcccctttaaaggaccttgaggagagtttggaggaggacgtcttttcagattggggtcacctaggaagtggagtcatgaggcccagaggactttcccagccttcatggccggtacttcctcaaatgtccctgtggccttttcagaaaaccccaggttgggaggctggggtatgaggagtggagtgaggactgtggaggaaggagttccatgttgggatgttggggttcttggccttgcactcgtgttggggtgcctggtttacatcatctggtcagagccaggctcaacgtgctggctagtttcatgtcagcttgatacaagctagagccatctgggaagagggaatctcaagggagaaaatactccagaccagaccgacctataggcaagcctgtggggtattttcttagtgactgttgtgggagggagggcccagcccattgtgggcagtgctgtttctgggcaggtggtcctgggcgctctaacaggcagagcaagtctggaggcagcatccttccatagcctttgcaccgatgcggcctccaattcccaccttaaattcctgccctgattgccccatgaacctgggactcgagaactgaaataaagcctttcttccttagctgcttttggttatgatgttttttagcggtaggaatcctcaggaagacagcagaactgatgtgtgtgtgtgtctccttggagttttgtttagcaatgacctgggttggggtgagggttcaaagtgaagtttcctcctctcacactcgtgtagtctgaggtccaggtgggtggagcaggctcgtccaacttctggtgtttcattttagtctctcctatctgccttgtgtctgtcacatctcctcaacgatgccttataaggacagccgtcaatacaatcaagggccattttcatctggagtcgtctcattgggatcctgcttgcacacaaggtcacacccacggtgttaggagcccagccctcagtagatggcgctgcttcccgaagctcacctctgcagcaggggcgcagctggccttgcccgggactgggactggtcacaatctcagcacctgtgcacgagcccctcccccccctttttatttaaagacaagttctcatttatagcactggcttcatggtacttgctgtgggactcaggctggcctcaaactcatagcaattctcctgcctcatctcccaggcgctggagttagagatgtgtggcaccacatcttgaatgtgccttgggagtttgtcttcctggacacaggaggcacattttgtcccactttgttcccaaacccatttctcagagcaccgctgggccttcttgtggccagccatgcaccccttgctcactgctggtgtgcaggtgactcgttatctctggcctaagcccactggccatccctattcacacagactccacatggccactccagctcccaggacttctgctagaggctgggcgacggttccagctgcaggcagagcaaggagggtgtgtctgggcttactgcagggcagagggccccatattcagagttagactgtggcttttgcactcctggacctcacagaccccaccctgctggctg

SEQ ID NO: 1046 - DNA, 614 bp, Mus musculus
cagaatgttggcttccagagcgctgagcctgattggcaagagagccatttctacttcggtgtgccttcgagcacatgggagtgttgtgaagagtgaagactatgctttccccacttacgctgatcggcgtgactaccccttgcctgatgtggcccatgtcacgatgctgtctgccagccagaaggcgctgaaggagaaggagaaggccgactggagcagcctttccagggatgagaaagttcagttgtaccgcatccagtttaacgagagcttcgccgagatgaacaggggcaccaatgaatggaagacagttgtgggcatggccatgttcttcattggcttcactgcgctcgttctgatttgggagaagagctatgtgtatggccccatccctcatactttcgatcgtgactgggtggccatgcagaccaagcgaatgctggacatgaaggccaaccccattcagggcttctccgccaagtgggactatgacaagaatgagtggaagaagtgagagcccgctgcctgccggctccctgcctccctcactccctcggcatgctggaagctgccgtatccaatggtccatgctaataaaagaccagtttacgtgg

SEQ ID NO: 1047 - protein, 170 aa, Mus musculus
RMLASRALSLIGKRAISTSVCLRAHGSVVKSEDYAFPTYADRRDYPLPDVAHVTMLSASQKALKEKEKADWSSLSRDEKVQLYRIQFNESFAEMNRGTNEWKTVVGMAMFFIGFTALVLIWEKSYVYGPIPHTFDRDWVAMQTKRMLDMKANPIQGFSAKWDYDKNEWKK

SEQ ID NO: 1048 - DNA, 27406 bp, Homo sapiens
agacaagcctggccaatgtggagaaaccccatctctactaaaaatacaaaaattagctgggcgtggtggtgggcgcttgtcatcccagctactcgggaggctgaggcaggagaatcacttgaaccccagagggggaggttgcagtgagccaagatcatgccactgcactccagcctgggtgacaagagtgaaactccgtctccgtctcaaaaaaaaaaaaaaaagtcttttatactccatctcagcattctaagcaccgcatcatgaaatacccctcagttggggtgtagggtaaagaggtcccaagttaggaaggggcacgtgcacatgtccttagttctctccggcgtgctttgaaatggaagcaaggtggcagacctttgaagtttttgggtttcttttatggtaccatgtttctcaccagatgcagcttcctgcaggtctaaggccattattcaaaacaacaaaagctcatcctgttttggcataatggaatttgaatacactgtaataaagtctattctcagtctgcacaagaggaaacaaaattggtaccttgatttttttttttttgtagggaataaactggttaaaaatggatgtgtgtgttttttaaacacaatcctattgctctttttcctaaattcttgtttgggcctctgagtctccttcacgaccaaaagcagacaagacagttacagtccaagggtccctgccttgcacaggattaggatatttctggcctcctaagagttcacgaattaccatattgggtcaaaaccagggctcagtgaaccaactagacattctggtcatccacccaaaagatcaggattatgtctgtaaaatatctataatggtgctatcattgtgactttgctgaaaacaactccaaaacgactcatattttgtttctatcacctcttaatggaacagattccagaagctttctattgctgcttagaacaaacatctctatacactatcaaaggggcttgctctaaatttggtcaagttccctgatgagctgatccttgagcaccgtgctcccagccttcatgtgccatcatgggccggcctcctgagtgtgtcctcccctaaggtgacccacatctctgccccccgggtgtccctatccctgctctccagtgtagcctgcccttattttcacagtcagattggccactgtcttagtttcctattgcccttgtgacaagttacacatacttagtggcttaaaacaacactttttttttttgagagtctcgctccgttgtccgggctggagagcagtggtgagatcacagttcactgcagccttgaactcctgggctcaagtgatcctcccacctcagcctcctgagtagctgggactacaggtgtgcgccatcctgtctggctaatttttaaattttttgtagagacaaaggtttcatcatgttgcccaggctgatcttggactcctgggttcaagcaatcctcctgccttggcctcccaaagtgctgagattacaggcacaagccaccatgcccaattttttttttttaaggcaagaaataaattttattgaaggatttttcaccatccatagagattatcatatgattgtttttcttagaatttttaatgcatacattttttggattttctaacttcaaattccctaatttcttccatttctgaaataaaccgtacttgattaaagtgcatgttttattttttaatttttatttaagttctgggatacatgtgcagaatatgcaggtttgttacataggtatccatgtgtcatgctggtttgctgcacctaccaacccgtcacctaggttttaagccccgcatgcattagctatttgtcctgatgctctccctcccctcgctccccggctctgacaggcgctggtgtgtgatgttcccctccctgtgtccatgtgttctcactattcaactcccacttatgacaacatgcggtgtttggttttctgttgctgtgttagtttgctgaggatgatgccagccaaaattttttatcttactggtcagaagtctataatgggtcagcagagctgtgcttcttcaggatgctctagaggagaatccttttccttgccttttccagcacctagaggctgcccgcattccttggctcatggccacatcactctgacctctgcttccatcatccatctcttcctctcactctgaccttcctgcctcccctttacaaaggtctttgtgattacatgaggcacacccaggtaatccaggatattctctccaccctcaagcccttaacttaatcacatctacaaatcccttttgctacataaggcctggggattaggatgtggacatatttggggggttattactcagctgaccataccatacaacattttctaggaaaaaccataggacatattttttacttagctacaggcaacttcctgaagacccccagcagcagtctcagttggctactccatctctttcctgggctgaagccacctggttaggactcatagcccagtaaacacatatggtatcaccttgtacccactctcagagcacagaaaccacctggtacaaaagatgattcctatgacaaacacatgtatatctcaacttacattttgcctgctgagggacaaattcctgtaagaaaactccaagggcccaaccaaattccagcagaaaaatgtcatgacctggaactttaagtagaacctctttgaagaggttgcccttaaagcgaaccaggtcacaaaagctctggcctggctttagaatttagaacttttgaatgacacacatgagaataaccaagttagctgtatggatggctatgaggggtgcacacagcccgttcaccaactgaggaatggagaactcgaagggaggaacggagactcggccaagcctcagcactcacagcggcagggtggatgagttctaataagggtagtttcctgtgacagtccggaatctggaactaggcatcaggtgagagtgccctggagtggagtgggctgggggaagaggatggggcttgctggtggtgtaggtgtgggtgtggcagccaggtctccagtggctgcaggatcctgccctcagcccaaatggctcctgcatgaaaagctgcggtggatctaagtggcagctaggagtcaaggcaactagcttcctccgaagcgaggcaagacaaggcacagccgagaagccactcaacctctgttcccaatgaatccatttccatgtccctgcttcgctgtacgacaccccacaccctgatgtgcatcttgtgaaaaatcaagatgaaaataaaaggtcaggagaaaactctgtggagactgttgtcaatgtagtcaaactgactctgatatagacaccttccgcattctgcacttactcatgcaatttcatttactttttagagagaaaggacattttcaccttggcaggagtctaccaccctctgctcaatgtcctttttggctgcttctgttccagacatggaagagaactattaaaagggctggggccacccctttcattcccaactagactctttgcacagaggcagtagcttctcacagcagccttgctaaaatctgcactatccccccacgccccttgtgactgtacaataaccgtaaagaaggcgaggcagggaccacaacttgccacttaccaacaagatgagggtaacctgctgagccttcctatctgcagcaaaaagtaggccttggagttcagaagtagagcaactgttattttcactgagaaggaaagttccttctcaagtcagctgctgatctttctatggaatgagaaggagtgggaaccatgaaagaagagcttgggaggtcaatgggaccgagatagagggtgaagttcagggggaagaactcaaagggggaaccacagcatccctctccccatccccaaggtggcacgtgaatgttctggagatgaacaaagggcaggagggagtaggggcatgggagagctccagggcagccgccgtgcagaggagcagaggacaggcccacatggaggccacagcaagaattctagcctgaaatcatggtgatgaggccagtgagcaagccagcaagtcatctgcgcagaatgtaacagaaagctactccaccgcactagaaatcaacaaggggaaaagggcagaaagggattagagaagcgggttcaagctaatttccatactaacattttatgggtttctgctattaggaataattccttcactacctacgtcaaagggttataaggataaataagttaataggcgtaagtacttaaaaaaacataaaaagcatgcaaaaagcatgcacaaatgcaaggatttttttaatggaaaataatgaaaagcctttcaaaggaatctaatgttgtcctttgatagacagtctatggtctttcccctttatcaaaaacaattccaataggaagctctctgaatggaacagagccatgagaacaaggcctcatttacacagctgcatggatttagatgctttgtgaaaactgcatcttctatggctgataacctcataaactatggctctaaacactgagagttttcattgccttcaggttaggaagtcactaagtcaaaaagtgaataatataaatttaatagcttaactgaagtacaaaatttgtggatggactccagctgcaaattttcccctgtaactttcctctgaaagttatttcatgggcactggattgctgtctttttcatatttgcccactgctgagggaatgagtttttgtgaatatgagaaaagtcagggctgagtgcggtgactcacgtctgtaatcctagcactttgggagggcgaggcgagcggactgcctgagctcaggagatcgagacccgcctgggtgacacggtgaaaccttgtctactaaaataaaaaagaaatcagccgtgcgtggcggtgtgcgctggtagtaccagctacttgggaggctgaggcgggagaatcgcttgaacctgagaggccaaggttgcagcgagccgacatcgctccactgcactccagcctgggtgacagagtgagactccatctcggaaaagtcagtataaataactattgcctggcaaaacttgctgcttgttttcactgctgaagagtagttaccgcagggagtcaagtgtggaccttacttgctggatggggactcatgtggtggggggaggtgctggaggctggatgtctacagtgcagactgtaactaggaatgaggcgcgggagcaaggtcagagtgggcccctgcggtgcccggtgccctctcacgctcaggtagcaggcagtcactgtcccctctgggcatctttcctccctggtaagtggtttgggaggcagccctgctcccccgtggaaaattcatgtacaggtgacttgaatgcagttgtttatagttcctgggtttaactctgtcaagtactgcattcatatcccatagtcggaacagaagtgtttaactctgtcaagtactgcattcacatcccatagtcggaacagaagtgtttaactctgtcaaggttacttaagaatgagaagaataagcaacatctgacattccaaatgaggttcaagtttgtcttcaagaagctcctagaagtttctgacaggattttacatggccagcagccaccacaccttcttctcccactcctgggctggtcctcagttgctctgtgactcctcctccactcaacccataaaagccagagtgccccaagccacgttcctggggtgtgatgagagacactggttttcctccccgttcctggctcctcacggccctggttagtcttttgatagaatgccaggtgcgtgagcctcaggggcgctaggaccccaccttctcctgccctccttccactccactgttccctctccgcctttctgacggtgggtcttaagaccctccaggagagggtcccccctagacctcgggggaaggaatgctgatgtcatgaagctcccataaaaacccaagaggacggggagcttccatgcccctttcccatacctcgccctatgtgtctcttcatctgtatcctttgcagtgtcctgtataataaacccataaacataaggttttccctgagctctgtgagttgctccagcaaattaatcaaatccaaacaggaagccatggaaaccccaccttgaagctggtgggtcagaggttccagagcctggacttgctgctgagccctcaacccgtgggctctgacactatctccaggtaggcagtgtcagaacagaatgcggagacacctagctggtggccgctgcttggtgtgtggggaaactcctatacatccggtcacacaagtcttcttctgtgttgactgttggcggtgagagcagaggacacacgcggttggagagcttttccctacgcagtcctcaagtgctaagacctgctctcatggcttcagaagtcaccggcacaccactggttctcaatctacatccatctctggtctctgtactcagacccattcttcacctttcaacctaggacttcttcatttgaacatctcaaacttaacataccccaaacagaagtaatcacctcccctccagacctgtttctctgcctcttccctcaacaaatggcaccagtgcaccatcgtcccagcgcacaagccaggaacctaggtaacacccttacttccttttcccctaggtccatgcacgattagtcaccaagacctgtggattctcccacctgctctctcttctgtccccttctccgtacccatgctgcactcagttttgccacctccctgcctctagtcttgggtgtactcctgtctccagcatcctttctgctgcaggctggggccatcactcgaaggcactgatctgatcacgcaactctcctccagtggcttccctctgtcctcaggatggtgcccaaatgcctctgcatgatctacaaggtcactacaaagcaatctgtccaccactcaactctctctgcccgctgcccctttacactccatcctattgctctctccaaactcccccactcgctctcctctcccgcccactattttctcctgctctttgcacatgctggtcccttgaatgttctccctccatcccccacctcctgagggtcaaaggctggcccgctgcctgcatgttcctttctctgggcaacctgactgccctgattgcccaagcctaggctggctgacttctctcgaatcccttgccacttttttactaagctccgcctgtgaggtttaggtgctgtgcttgctggcttgctgcaccttcaagtgctaagcaggtactgtgtttcatccacagccatatccctcctcagcacgggcctggcacaaagcagatactcaaaaacatttattagaaaagtgaataatcccgcataaatgctactgatgaatctagctccctgcaagtcaatgcatttcacagatccaataattctcttgacaacagaacaattaagatggttggaaaggctgagcgcagtggctcatgcctggaatcccagcactttgggatgcggaggtggccgtattacttgaggtaaggagttcaagaccagcctggtcaacacagtgaaaccccatctctactaaaaatacaaaaattagctgggtgtggtggtggacgcctgaaatcccagctacctgggaggctgaagcagaagaatcacctgaatctgggaggtggaagttgcagtgagccgagatcatgccattgcactccaggctgggtgacaagagcgaaactccatctcaaaaaaacaaaaagatggttggaaagacctggattaaaacacacacacacactccccagtggtgtttcagtaatgacagcagatatcttcaagagctaaaatacttagttttataaatatcatctaagtattataatcatctgaatcctacccggaaatgatatgaagtttaactttaacaggcactcaaagatgtgcccaggaaccttacgccaggactctttgcccagagatacttcttgcttgcccagaactgacttgggtgtcataattagttaagttataaatggtagattatgaaatggcttcgttttacttggtggaggagggacacagataaagaaattctacttacaccttctcaagcttagctacttcttacatcaattagctactattttttagcatcacagtttattcttaaatgaaaaacaaacagcacctcagctcaggtatgcaggtctgaagctacagtttacttttccttcaggttttaacaactcgatggaatttatagatggtctttttcccttcattgatcaccggaactgaaaagctactgcctaaaattcacttaccaactagtctacctgcatgctacatcttttttcccactgtacttcaataaagctgtcattgcaaacaaaaacataaaagcgtgttggacagatcgtctgctcctgctgtttaatgtcacagaaattcgtttttttttttttttttttttttttgagacggagtcttgctctgtcacccaggctggagtgcagtggcgtgatctcggctcactgcaacctctgcctcctgggttcaagcgattctcttgcctcagcctcccgagtggctgggatgacaggcgcccgccaccacgcccggctaagttttgtatttttagtagagaaggggtttcaccatgttggtcaggctggtctcaaacttctgacctcaggtgatccgcctgcctcggcctcccaaagtgctaggattacaggggtcagccaccgcgcccggccccacagaaattctttagcttttaaaagccatggaaacattctagataagttgttaaccattaacgggaacaaattctctttacacaaagctcaggcacattcaatcaaggggagccaggcctaagatgcatcacacagatctgaccatgcaactacctttctacaagtgtctgagctccggggtgcccgagtaccgacagccaaagaagcatttacactttgccagataaggaatcggctctgcgaaggtgcgaagaaccaaatcctagcgattaatgtcccaacaacgtgaacacttcctgcaactcgaaatcctcaagggaaactctgtcgaatccccaccaagtgaacgatgacttgtttctacaaaggctactgatttcaggaaactaacgtataactcgtcgccttaaagtgcctctaaaagcatccacgacggttaaagtcgctgctactacgggacgctatttattcagcgccaagacccaagcgccatcgtggatcaccccattcctggccacggcaaccctagggagcgggtcctaggagcctgctggagggcgaccgctgggccagcttcctctctgctgactgaggggaggccaggctgcctgcaaggggaaggggccctttccgcgcttaccagggtgagagccacctccagcatgggggcgagggccagggtgccgtggaagagggggatgcagtccacgaagagggtgtggtgggcgccggggccgcccagggggaggtgctccttacgcggcttctgcttctcggccaccaggagcccgttgacggcgcagtgcgggtacttggcgccgtgcagcaccatcttgcagtaggcctgggtggtcagtttcaccccgggcatgctgacccgggagggccccggaggcccctgggcgcgcggctgaggcctggacccgctgcctggccgcgcggcgcctcagccgagaagcgggacgaggcggcggcgattgatggcgcggccgcgggctggcgggggacccttcaggcccggccccgtttgggcctcggctcctggaaaagcgactcgcgcctctgggaagccgcagccccagactccagtcgcgcttctcgcccggcgccgccggaaagcagcctctccaacgcctgccggaaagcagcccggcccggcattttacgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcaggtgagacaggaggtggccggtgcggcgccgccaggccgggccgggtcggggggccgggagccatcaagtctgcacgtccgcagcctggccgctcggcttcagcaggaagcaccgaatgggcctcggagccaggtgacattgaggccggcccgtggggactccgggctcggtggctccaggctcggggggccgccccgaagtgcccggtccatcttacccggtctcgcagcggctgcggaccggcctcgggcactgaccttggagcgcccgctggccgagggctcaggctgcggggaggcgggcccgcgctctgtgcctgcagcctccgcccttgctccttcaaaaggtccctgtgcaacccctcccgggttttgcggggctcccgggcggcgctcggctttccagcctggaaggcgcctattgtttgctcacgcaagggctaggcccaaggagagaagctagacgcgggcgttcagccctgacgtcatgcttgtttattctgccccaaggagggtatttccccacatcactctcaccagtcctccgaagggtcgatttaaagggggccgtgtaaggttgatgggcctgaatagaggagggcccgggtgagggggggtctcataggttttccgctctcctcagggattggaaattgatcggggctgtgttggcagccttctccaatttccccttctagtctatgtacaggcggtattaggttttaaacactcagttgaatgtgatgcgtgccacggtccctgtgagctgtcacctccccccaccgctccctgaagaatggagtctgtcacggcagcacagtgctttaatgatctctagctttttcagagtcaccttgttagcattttttcttcttgcctttttttgtttgagacggactcttgctctggttgcccaggctggggtgcagtggtgcggtctcggctcactgcagtctctacctcccgggttcaagcgattcttctacctcagcctcccaagtagcggggattacgggcgcccactaccatgcccggctaatttttgtattgttagtagagacgggatttcaccatgttggccaggctggtcttgaacccctgacctcaggtgatctgtccgcctcggcctcccaaagtgctggaattaccggcgtgagccaccgcgcccggcctctccttgtttttttaaaaagaccaatgttctgttaattacctgaagcgcgtatatattatggcagttgatttataatgaagctccttaaaagcatgccaattactaagaaaaacctcatcctaggtcattttgtgaattcagagacagtgataaagaatggatcatttgcgttggggagaagcaaacaaaaaaattccaaaatgctctggggcaaaaagaagactaattccttgctgtttgtccttattcatagagaaggtgtacatttttatctttcagaatgttggctaccagggtatttagcctagttggcaagcgagcaatttccacctctgtgtgtgtacgagctcatggtaagtgtgacttttcttacttttaaataggctgaactaatttcattttgctcctgctgtgtataaagccctgtgctggagttttaaagaccttaattcggctcttgagggtctttaggggagatataaatgttctcacagggcttggttctagattaagaagtgtttataagtcaaattgaatctcttctggatctttggttatactgatacttccccacttacccttcccttccgttccacttttttaagcttcgagatctacccctttcaaaagatcttctgcaccataactgactgaccttaatgacctccctccccaccttgcccccacaactcccaaccatttgcatcacctctgtttacattatagaggcaatggaaacgaaagagcctggacttcctagcctgagctgggttttcatctcatttctatcaaggactagctactgaagctcaggaatctctttgctcacctgaagtatatggacagagcttagttctgtgtctggcatacagcacatttacttttgcatgtatctggcgtctatctactttgtaccagacactgttaggcaccgagaagaaaaagaatatgaaatacacacactttccaggaggctgtttgcaatctgaagagggacggatgggtgaagacagtgttttattaagagatggctcctgggtagaagcatttagcccgatgtgggtttcagggaaggcttctggaggaaactctccagggtcttttcattgccttagtagagtctacaccctgcctggttagagctggtcttgcctgcctttccgatcttattactgactgttgtactcaaaacccaaaaactaccatcagaaccacccatccccacttgctcactgccccagccccctggccttactccattcctcccgtagagccccgagttgtggatggtcgctcctgtctaatcattcaccctcgatacaaatgtgcttttagaacggcctctcctgaccatcctttctcaggaagctccctgtcacctcaccttgctgtgcttttccttataacactggatgcctcatgaatgcatgtctatttgagtattgctgtctcagcctcttagagtgtaagccttttgaggccagggagcctgcctgtcttactcattgccgtatctccagcacataggaggcagatgaagacgaactgcagactcttagacaagtcttctctgttaagttttaacttacgtaagtcatacatgaataatacatgaatctgttctcaagatattaaagcagtctggaataccatcagccgtcactgaagtcagttgggatatttgtgtggtgatgcacctgagtaaggggtgcccagatacaccagatctccccagcagaggctcaacagaaatcggtccatgttgaagcggtgacaaacattccttacaatctggagtctttgtttttctctctctctaaaagaaatgtttggtatattaaccattgattttcccttaattgctgggggaccaggcctgaagctctgaagaacccctgaaaccatgaattggccattcttattctggaagatgcaattttgaggtttgcatgcaccaaggttttgagggtttatgtcgttataatagctttttccccccagtctccctgtcatggcatttacaacagctttacaagatgtaattcatataacagtcacccatttaaagtgtatcctccagtggtttttagtatattcattgagttttgtcattagcaccacagtcagttctagaacattctcatcacccatatttacatttatttttaataactctcatgtgtaagctgagtgttttaaactttagaaacttctggggggtgctgaacttgataaaaatattcagtatacaagtgttctttatagttcactcatcattttcatagaattagggttttaaaattagaaagtaattcaggccatttccatctcctgtccctcaaatcccagctcagttttgggatgaggtgtcaagtataagtttgtaagtatgccagtcatttgcacggctaagagaaacatctagagaagtctatatacgacttgcttaaagctgaatgttgatttactgttcacatgatttgggcgattttagtcactgggactgagctaatggagttgaagcattgttgcgggcattgtacctccagaccagtgtgtaatacaaagagttcttgcagacgtaggacagaattggagaaacagcttctaacagtgggaagactctcagtacaaccaagctattccttacctttctgatttctgaacttttttccatgtgacacctgctgctttgaaggcactaaaataacagaagcagatagagcagaaatcctcactcagatcttcctccttcctacctgtataacagtttgtggcttgccttgtctgttttgtgtgtttcgttacgcgtatgtgagtatgtgcacgtgatttccagaaaggagaagcgcacgatactgcccgtgctctgtgactcctgagtgcatgcttcctctgcatttgggctcctaggtcggcctcgtcctgtggacgttgccccttgtttcgtgccatccacacattcctgatgcccccctgctctactctttctccagagtactttttccaaacatgtgatttgcacatttgttatgtttattgtttgttttccacttctagaagtgtgccgctaggcaggaatgtttgatttcttcactgatgatcccagatctctagaaccctgccttgcctgtagagggtgcttggtaaatgtgctctgaatgaatggctccatgatcctcgtttctaagagctagcacgatttctcacttagtcctggttggacacaggttccctggaacagtgctgtcgtggttatcttctcacgtgtctttgtttctgaacttgaaacgcttttgagttttttattgtttttgttcttcctcattagtttgagtcccttgcagataggctttcattttgtccagtcacctgttcagggagccctgagggccttggcccatgtctgcaggtaactggtttttttatttttatttttttattttgagatgaagtctcgctctgtcaccaggctggagtgcagcggtgcgatctcagctcactgcaacctccgcctcctgcgttcaagcgattctcctgcctcagccttccgagtaactgggactataggcacgtgccaccacgcccggctaattttttgtatttttagtagagacggggtttcaccatattagccaggatggtctcgatctcctgacctcgtgatccgcctgcctgggcctcccaaagtgctgggattacaggtgtgagccaccgcgcccagccctgcaggtaactgttaatgtaggaagtgctgcctctgggcaccttggccccagggttcattagcagttgcccctggtgggtttttgttggctgtgatgagaagtgcttctgttccccctccaccacactcctgcaactgtttaaacagtggctgtgaccccctgagatgatccagggtttcaaggcgtgcacatgtctgtgtttcggttttcagaagtatcaccttggggtgactctcaacctacatggattttcaaagatttattcaatgtgtttttcagaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagagagcagtcttgcacaggagggttgctctgctgggtttcggggtcactgtgccagggccccagtttatgtgctcaccagtcacttagctctgccagctgacaggatcttttgctaggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctgggttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtgggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccctaactactttgtacagcacaccacgttttcagtagcaatttatgtgctcaccagtcacttagcaaaagatgacttcgtgaaggttcgagcaaggataaggggactcattcatttaatgactgtctcgactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacgacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaccctttgtgatcagttctttaatgatacctaaatgaaagctaattaaaacaataggtttctcccaagggtctggagtaaatatattttgggtgcaaatgaaatggcaaaaatctagtatcttaaattgtataaggggacattatataaaaactgaaaatatagaattccttgatgtaggaaatttgaggtttttggcaagagatctttatataagtaaaatcccattatcgtaggcacaccggcaggagttaccacaaccctttttttttgttttgggagacggagtcttgctcttgtcacccaggctggagtgcagccgcacaatcttgggtcactgccacctccacttctcgggttcaagggattctcctgcctcagcctcccaaggagctgggattacaggtgcctaccaccacgaccagctaatttttgtattttttagtagagacggggtatcaccatgttgtccaggctggtcttgaactcctgacctcaggtgatctgcccgccttggcctcccaaagtgctgggataacaggtgtgagccagtgtgcccggcctatgaaccacttttcttctgggactgtccctccctccctgcagttttcttttttttttttttttttttttttactgatcattcttgggtgtttctcgcagagggggatttggcagggtcataggacaatagtggagggaaggtcagcagataagtgaacaaaggtctctggttttcctaggcagaggaccctgtggccttccgcagtgtttgtgtccctgggtacttgagattagggagtggtgatgactcttaacgagcatgctgccttcaagcatctgtttaacaaagcacatcttgcaccacccttaatccatttaaccctgagtggacacagcacatgtttcagagagcgcagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccgttgtcatcatggcccgttctcaatgagctgttgggtacccctcccagacggggtggtggctgggcagaggggctcctcacttcccagtaggggcggccgggcagaggcacccctcacctcccggacggggcggctgctgggcggagatgctcctcacttcccagacggggtggctgccgggcggagggtctcctcacttctcagacggggcggccgggcagagatgctcctcacctcccagacggggtcgcggccgggcagagacgttcctcacctcccagacagggcggcggggcagaggcactccccacatctcagacgatgggcggccgggcagagatgctcctcacttcctagatgggatggcggccgggcagagacgctcctcactttccagactgggcagccaggcagaggggctcctcgcatcccagacgatgggcggccaggcagagatgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagtgaaaccccatctccaccaaaaaaatacgaaaaccagtcaggcgtggcggcgcgcgcctgcaatcgcaggcactcggcaggctgaggcaggagaatcaggcagggaggttgcagtgagctgagatcgaagcagtacagtccagcttcggctcggcatcagagggagaccgtggaaagagagggagagggagaccatggaaagagagggaaagggagagggagggggagggagggagagggagaggaccctgcagttttcatgttggctagggtgggcggccaccagttcagggaggacagccccactctgaggtctgactgaggtgtgggtgctggccccgtctcccttggactgcttgtggcctgctcagctccctggctactcacaactctttgatctaaaaagtagtcacaaggccagtgtcaaagcggtggtcttacgagcatcatcctggccctggcaagctctctccaggactcatcctgttacctgtcccacccaagcaccagttcccaaactggagaccctgtctggagaagagaacaaatctgcagcctgtgtgctgagagtagcagagatggttggcagagaggggtttcctgccagcactgggggataggaatgaggcaaggggagagaatggccccggagaagcacagctgtagccaggaagggaaaggggacccttagatcttgcccagaggaaatacatgggacaaagaccttggctggctggaaggtttgggctcagttcaaaatcaagagcaggtcaaatacaccccaatcgagcaccttccagtgctgtagaaacgcccttgatcccttgttctcgaaggaccagctgagccccccgggagagtgggatgcagggggctacagggccttgtggagtcttgccgtgaggactcgtgtgaaccccttggtggtttaactacaaaagcccacactgccctctgggggatgccattttcagttccttgcccgagggtgggctcctgggggtggtaggggaagctgaagtagttgaccccggccccactggtccctgaccctttgcctggctctggtggagccgcctgccctgggccaggcagcaggccaggctcatcatcgcctgcatctccctcaggagaggccgagaggaaggagctgtcaccccaggatgaaggcagaggtgtctgtggaatcgagcctgctgtacaagccctctacttttagccttgagtgagtccttgagaagtccggctcttcctggcctttccctcctactgcttaggaagctgtgctcttgaccttgctaagagaactgccatttttccattggattcagattccaaaacgtggctgtccatcctgattttgtcctcacgcttaaaaaaataaaaatccctttttactgccattttagtgggaatttgggaggccgcaggggttcatggctggattcagcccatgatccttcactggtcacccgcatgccatggggacgtgatgctgacctgaccccaggtgctcactttcccaggctcacagggaggcagaccacaagtaaaacaaatacacagagaagtagaggatccagcagggtggagggagggggcacagggagaaaaggttatgggtgggggttggttgggcagatgtcactgaagaggtgacatttcggctgagacttgaagatgagccgagccactcacgctgaaacctgaggggaggtcgggctggcaggtggacacagcaccaagcctgcacagcaggcatgacgctggaggcagaacagggcttggtgtgttcaaaggacagcaagacggccaccaggcagaagcactgtgggaggaggcagggtgggggtgtggcaggggtgctcagatgccagggcacatggactgcggcccacaagaagaggaggactgagctctttctgagtgtgtgtgtgcggggtctcatttcacccctggactgcccctcccagggtgctcagggaaaatattgaggctccttaacgaggcaggaggactttgagcaagatgagcccttgggacaaccccaacttagctcactggaggctggagagggccctgtctccccacgccggggcctcaagggaagatgcctcagagatgaggctcctcacccgtccagggcctgcatctccacgtggggccatcacagagacctcaccccccagcctaaccttgaagctccttggaatttaagatacactgtgtccctctttgtcactcttcttccttctctgctcatcttcctcccagttggcagttttctactctccagaatttaaaaattcacggccaggcgtggtggcttgagcctgcagtcccagctacttgtgaggcttaggcgggaggattgcttgaggccagcagttttttttgtttttttgtttttgagatggagtctcactgttgcccaggctggagtgcagtggtgtgatctcagctcaccgcagcctccacctcctgggttcaagcaattctcctgctttagcctcctgagtagctgggattacaggcacacaccaccacacctggctaatttttgtatttttagtagaggtggggtttcgccatgttggctaggctggtctcgaactcctgacctaaggtgatccacctgcctcggcctctcaaagtgctgggattacaggcgtgagccactgcacccagctgagggcagcagttttgagaccagcctgggcaacatagcaagaccctgtctcttaaaaaaaaaaactgcttataaaaaaatcattacctatatagggcaggacagcagcagacacattaaaagacatcttagaagctggaagataagggagcagtggtttcctctagattaatagtaccagctaagcttttaaccaagaggagggaaaaaatgaagagtgtctaccaccaccaagcccttgctgagaagagtgctgaaagatgtggctcaggaagaagaaaactgctcaaagaggagtgagatgccaggagaaatggtaggcaaaggaactgaaaaccatgaacgcaaagccactcaagcactggctgaatacagcagtaaaaataatggtgggcaatttggtttaaaaagcaaagaggagggggttccgggaagatggtggcagagtgtttgaatttccctgaatccccatgtaaagacagagtaactagatagcaaaaccataaacccaatggacaatactaggtgagagagtcccacgaacccctcacgatctgcggaatacaaatgcgtggggacaagtcacctgcgccacagcccgacacagcatctgctttggtgcagcaggacgcggagggaagcaaagggacggcgggtggacctgggacacagcagcggggcactcactgggaagcacagcgaccctcctgtgacgctgagaggccgccccgtgcagaagcaggcgattgtggggcttctcagtgggtcccgaaggggctggagcgctctctatacccactctcccaggctaccgtccccgggcagggatccacactgcagagaaactgccggcagtggaaagggactgaccaggacaggcaaagaaagtacaggcaagatccagattctcgtggggaaagtgtagagagcccgaaatcccagaggccaggtccatgcttttgaacctcaaaagaaaacaaccccagcgggagctcttgggagtaggaaagttttcctgagccccgcctccttccagaaatgcaggaaaatgagtttgggctgcagtgaagaatctgcgctgtaacggattaaaatcccggggtggagagacagacaaagcggcaggagagcatgggcagggctcagaacgagagcaggggacacgagctggggccgtggagaaggaaccatcgcagagggacggaggcatggcatggcccgggccacatgggtttctattccgcgtgaacaggtctgtgcagacccatccacaaaggctgagggagcccagaggccgaagaaagaggctgacaaattcagtttctcagaaataataaacataatttttttttttaagatacaggatctccatctgtcccccaggctggaatgcagtggtgcaatcatagctaactgcagcctcgacctcctggactcaggcgatcctcccgcctcaggtagctgagtagctgggactacagccatgtgccaccagacccagctaatctaaaatttttgtgtgcagacaaccaatggctatgttgctcaggctggtcttgagctcctcgctttaagcgatcctcccacctgggcctctcaaagtgttcagagtacaggtgtgagccgctgcacctgaccagaaagaaataataggaacttaggaacagaaatagggacttacgaacagatagtggctccccatacctgccttccagaaagtcacctttatacagcaggcgtttgaggtaaagacatgggcagctgatcacgcctcagactttcttgccaaagctcgttaccactggggaggttggataagcatctttgggagcggttatgaatgccaaaggcattgtttaaagactttcctgcagaacagcttggtgtgcaggagtccagcattggtcatcacggcagttttgctccaagatggcatcactcttgccacgcaacagactgcctccctaccgctcccgctcgctcccccgggctgcctgcaggcactgctgttgaggtaccctgaggtggcagcttcatgagggagcaccaggcagccactcagtggcaggtgggtgacattagaccccctcctccagcggaggggcagagatttgtcctccaagaataggcccatattctggaaatggagttgccttccctgcaacagcaccgtgcatgcctcatttgctgtctgggcgtcccacacatcgctctaatcaagaagctcactcacttcacagccagagagtaaagggttagggctcatgcctcagtggtgaggacaccactggcctcaccgttgccctcatcggaagcagccgcccagttgaaatggtcatcccaacactctgcgacaggccagtgaacgctaacactctgaagagctggggcaccatcccgccggatgcaggacattattttgtaaaaaataccaatttttaaaactgtggcagaatacatagaaaatagaattagccattttaacctttttttttcattttctttttttttgagaccaagtcttgctctatcgccaggctggagtgcattggtgcaatctcagctcactgcagcctccgcctccctggttcaagctattctcctgcctcagcctcccaagtagctaggactttagctaattagctaggacgcccagctaatttttgtatttttagtagagacggggtttcaccatgttggtcaagatggtctcgatctcttgacctcgtgagccgtccgcctcggcctcacaaagtgccgggattacaggcatgagccacggcgcccagcctttttttttcttcattttcaaaatgcatcacttaattttccttacaaggtagccacgcattaaacatgtaacaatcacaggatttcttcagcaagccctagtgcttccgtgagctttcctggagctcgtggctcgaggtgtcctgaggtttcaaatattacagctttctccatggccataagttcctctgatgtttgggttactgaacacaaactcgctggatgatttgtcttcaacatggtccatttctgttcctaaaagtgttagctgtgccttcttttctttttttttgagctggaatcttgctccgtcacccaggctggagcgcagtggcatgatctcggctcactgaaacctctgcctcccaggttcaagcaattcttgtgcttcagcctcccgagtagctgggattacatacaggtgcatgccatcacatccagctaatttttggaatttttttcttttttttttttttagtagaggcaggttttaccatgttggccaggctagtctggaactcctgaccttaagtgatccgctcgcctcagcctcccaaggtgctgggattacaggcgtgagccactgcgcccagccctagctataccttcttttcgatgaacattctgactccatcttgaacaacttcttcattagagcctccttttgtcttcatgtattctagagtataagaaagcacagccccaggttcggacactgagtttcacacctgtgtgctcagatgcatctttaagaagttgttctgtcttgttcactactgaaggtgtcagggtagccgattagaagcacacaattctcaggcatcatggacatgccccgtttccttgtgtgtaagcatcaccacttgttccagaactttttcatcttccaaactgaaactctgtccccaccaaacactccctccccatttcccctccccagcccctggcaccccccatcctgctttctgtctctacgaatttgactagtctagggaccaccaatcagtggattcatacagtgtgtggctttttgcgcctggcttatttcactcagcaagttgtcttcaggattcatccatgttgtagcatgtgtcagaatttcattccttcttaaggctaaataatgctgcattgaacagatagaccacatttttgtaccccaaaaatatcccgcatgttgtttttccactcgtctgtctgtggaaatcaggttgtttccaccttctggttatggccaatcatgctgctacgaacacaggtgcacaaatatctgcgggactccccactttcagttctttggggtgtattcccagacgcgaaagcagttatgcaggtggcaatgcctcacctgtcccctatcatgcaggcccgagggcctccaccctgtcaaggtgagtgttctcttttttcacacagcactgtgctttgcgtgggagaccactagagcctgaacgtgcaggtcagggagccggtggctagaagtatgagtggctccactcacgatcacccataataaccacttacgtgatttatttatgtttattatttatttagtatttttaaaaaaatttttgttggtagtagaatttattcaaatgtgccttaatataggcgctggggcttggtcatggtgctcttgatacataaggcccggacattccgccagtttttcttgggcaatgacaccaacaaggtgacagccaggtgaatgtcatatacaagctcatcatctgtcatcttcacgtgacccacagccacagccagatataacaccttcttcattcggaattgattgtggacttcgcctcatccactttggccaccgtgtttttgttgtgtgtgagcagggaagggaagtttcccgccttatttaggcctgggccaaggattcgtgaaatctgcttgatcagagaccccgaggccaaaaatgcatcatacttcttggccagcttcttgaccagttttttattctcgttgagttttttcagcgcctcgatgtccatgtgatgtccatgtgggggatacccatggccttggcctcgtcacagtgctgctggtcctccaggacacacacggagaacttgggccggggagtggacttcagcctgatggtgcctgagaagcgcttgtccttctgggggtcatagttcttcaagctgatctgtgactccactgtctctaggaacttgcggtgcttgtgctggttcccacgtaggacttcccacactgcctcgtacagggtgtcgcgagagactttgctgctcatggcttctcccactgtgctaactggaaaagagctctattattattattattattattattatttttttagacggagtcttcctttgtcgcccaggctggagtgcagtggcgccatctctgctcactgccagctccacctcctgggttcagtccattctcctacctcagcctcccgagtagctgggactacaggtgtccaccaccatgcccagctaattttttttttttgtatttttagtagagatggggtttcaccatgttagccaggatggtctcaatctcctgacctcgtgatctgcccacctcggcctcccagagtgctgggattacaggtgtgagccaccacacccagcctattttttagtagagacagggtttcactatgttacccaggctgatcttgaactcctgggctcaagtgatcctcctgccttggtgccccaaagtgctgggacgataggtg

SEQ ID NO: 1049 - DNA, 799 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctg

SEQ ID NO: 1050 - protein, 179 aa, Homo sapiens
RAVAAGSGGRMLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWKTVVGGAMFFIGFTALVIMWQKHYVYGPLPQSFDKEWVAKQTKRMLDMKVNPIQGLASKWDYEKNEWKK
